United States Patent 10,888,096 (BIOPESTICIDES FOR POTATO LATE BLIGHT DISEASE) - sequence listing, part 6

SEQ ID NO: 9 - DNA, 1551866 bp, Pseudomonas fluorescens KENGFT3
tgaacagcccaaaccaaccggtatggacgccaagccacagggggaccagcccaaaccaaccggtgtggacaccaagccaaaagtcgagtcccagccgcctgtccggccggtcccaaaagatgtgcccaggtcggatgacaccacctacggattcaactccacgactggcaagccggaaacgaccctgacatccgcttccgataagccagaattcaatatttgggatcagaaaggcatagatacctttgatttttccggcttcaagcaggaccagatcatcgacttgcgcagtggttcgctttccagcgtgggtggcttgcgggaaaacgtcaggatcggcacctcgactatgatcgaaaacgcagtgggtggtagtggtaacgaccgaatcattggtaacagtgccgataacgtgctgattggcggtgcaggcgccgattgcctggttgggggcggcggttggaatacgttcaagttcaacgcttttgccgactctacccgcacgcaagccgatttgctgttggacttcaacacgggtcaggacaagattgatctgtcgcaaatgtccattgatggcaaggttgcatttaactttgttgaggaatacaccggcaagaccggcgataccattatcaagtttaacccgcaaacagggcgttacttgttggcgatagacttggatggtgacggcaagacggacttcctgatcaagagcacccgcatgatcagcccggaagatgtcatcgggttgaacataagggatgctggttatctgtaacgctgtaatggcgagctagcaaccatcgcctttggagtaagacagggcaggactttttcatatgatcaagtcctgcttttttgtgcctgtgaatacctgattacgtgtgcccaacatttgctgatcttggtcacaccgctctcaggcggtggccgccatgaccccacgagacgcacccaggaatcgcagcaatgcgatcaatggaaaggcgctgcccaccagcatcacgcccagccaaccgccgtgttcatacacactgctggcaatcgccgagccgaatgcaccgccaatgaagatgctggtcatgtacaacgcgttgagacggctgcggctattggcgtcaagggcatagatggcacgctggccaagcaccatgttcatctgcacgcagaagtccaggaccacgccggtgaccgcaaggccgaccacgctgtacagcgggtgcacaaacgccggcaggaagctcaatgccccgaacagcattgccagcaacgaggcgcgatgggtgtggccggcatcggccaggcgcccggcgatgggcgcggcaatggcgcccagtgcgccgaccagggcgaacagcgcgatttcgctttggctaaggccatggttacgcgccagttccagcggcgcggcggtccagaacaggctgaaggcagcaaacatgcagccctggtagaacgcccgttggcgcagcagcggctgcccacgcagcaaggtagccagggagcgcagcaattggccgtagctggcgcggtgatcgggttggcgcttgggaatggtcagcagcaggaccacgctgataagcgccatcaacgcagcggcggccatgaacatcgcgcgccagccgaagtggtcggcgactacgctggacaccggtcgcgccagcaggatgcccagcagcaggccacccatgatgctgcctaccacccgaccgcgggattcggccggggccaggtgcgcggccagcgggatcaggatttgcacggacaccgagctgaaaccgatcagcagcgacaccagcaggaacagattgggttgttcggtaaacgcagcacccagcaggctggcgatggccaccaccgtggtgaagatcatcagcttgcggttttccaacaagtcgcccaaaggcaccaggaagaagaggccgagggcgtagccgatttgcgtcagggacacgatcagactggccattgccggtgtcaggccgatatccggggcgatcagttcaatgatcggttgcgcgtagtagatgttggcaacgatggcaccgcagcaaaacgcaaacagcatgaccatgccccgggtcatggtgcctgtagcgtgagaggttgggttcatggtgttctcataaggcgaaggacgatggggtgagagaataaagacatgggccggcagtgagtaggccgcttggcgtgataactgtcatgccgcgaaataatgactcaatgcaaaacccaatgtgggagggggcttgctcccgatggcggtgtgtcagtcagcctatgccttggctgacacaccgccatcgggagcaagccccctcccacatttgttaccgcatttcttcagttattgaccactgtagatctggtcaaacaccccgccatcattgaagtgggtcttctgcaccgtgcgccagtcgccaaaggtcttctccaccgacaggaagtccaccttcgggaagcggtcggtgtacttggccaacaccttggggtcccgtgggcgcaggtaattgttggccgcaatttcctggccttccggcgaccacaggtacttcaggtagtcttccgccgcagtacgggtacctttcttctcgaccactttatccaccaccgacacaggcggctcggcttcggcggacacgcttgggtagaccacttcgaactgatcgcgaccaaactcacgggcgatcatttctgcttcgttttcgaaggtgaccagcacgtcgccgatctggttggtcatgaacgtggtggtggcggcacggccaccggtgtccagcaccggcgcttgtttgaacagtttgccgacgaaggtcttggccttctcttcgtcgccgccgttcttgagcacatagccccaggccgacaggtaggtgtagcggccattacccgaggttttcgggttggggacgatcacctgcacgccgtccttgagcaaatccggccagtctttcaaagccttggggttgcctttgcgcacgatgaacacggtggcagaggtgaacggtgcactgttgttcggaaggcgcgtcacccagttgtccggcaccagtttgccgttgtcgaccagggcattgatgtcggtggccatgttcatggtaatcacgtcagccggcaggccgtcgatcaccgagcgtgcctgtttgctggagccgccgaaggacatctgcaacgtcagcttgtcgtccgggtgctcggcttcccagtgcttctggaaggctgcgttgtagtccttgtagaagtcgcgcatcacgtcgtaggagacgttgagcagggtggtcgcggcctgggcggagcctgccaaggccaggctggcggccagaagagaggcgctgaggatttttttcactgctcattccttgttgttggagaagaggggaggcaatttgccagcgactatagccgggcctgcatagacctataaagattaaaacgacctttgcttattccagtttatgaaagaggttactgccacagcgcgagcaaaaagctgcattgggttcatggctgttcttcttgcacgccgggcagtcggtttgcagctgctcaccgcgcatggcactggccagctctgcagtaaaaatgcccgtcggcaccgcgatgatcgaataaccggtgatcatcaccagcgacgaaatcacctggcccagcggcgtcttgggcacgatatcgccgaagcccacggtggtcagggtgacgatggcccagtagatgccctttggaatactggtgaacccatgttccgggccttcgatcacgtacatcagggtgccgaacaccgtcaccagcgtgcacacgctgaccaggaacaccacgatcttctgcttgctgccgcgcagcgccgccatcaggtagttggcctgcttgaggtacgggctgagcttgagtacgcggaagatgcgcagcatgcgaatgatgcggatgatcagcaggtactgcgcatcgctgtagtacagggcgaggatgccggggacgatggccagcaagtccaccaggccgtaaaagctgaaggcatagcgcagcggcttgggcgagcaatacaggcgcaggccgtattcgatggcgaagatcagcgtgaagccccactcgatataggccagcacatccgcgtagttctggtggatttcatcgatgctgtcgagcatcacgatcaccaggctggcgaggatgatcagcagcaggatgccgtcaaagcgccgcccggcgacggtgtcgctttggaaaaccatgatgtagagccgctggcgccagtcgttgttactgtccataagtcctgcctgaagcgaatatcgagcaagcctagggggattcgaacgggctgtccatgtggggtttgcgcagcattcgctggccggcgcgcaccagccagcaggcgaggataaacggtgcggtcagcgcaggcaggtgcagggcggcgaaacctggggtgaggatgattgccagcaggatgcccagcagcggcaaccacggctggcgacatgacaagcccaggaccagggcgaccaatgctgggttatagctgtgcaggccgagcagggcgccagtggggtcgttcagccaaaggccggccagcacgccgaggctggcaccgccgagtgcccacaacgcggcgcggcggtcggccagcagcaagcccgcggcgatcaatacgcctgccatgggttgctccaacagcatgatttgtccaagaccgataaatggagcggcgagaatagagaaggtgccgggctcggtcagcgcaagggcgcttccaggtacgcacccgagcagcaaccagccgaggccaacaaagggcgcggtgtaggcgggcaagtcctggggctggttcgcgtgtttcaaccattgccgggtaaggatcgcgctcaagcccccgcacgccaggatcaacggtggcaccagcgccgaccaggcaaagtgctggctgatcaacaagcccagcagtacgccgttgtagctgtacagtccagcctggcgctcagccttgggatagccacggcgctgggccgtgagcaaacccgcgaccccgcccagcagcgcgccgccgagcaaggccggggcgccgatcaggatcgccagcaggcacagcaggccgcacagtgggtggcgttgcaggaaaatctggctgaagccattgagcagagcttcggcccagtcagggcaggtgtggttgtgcatagcggctccctgtaggagcgagcttgctcgcgaaaaaaccaagggcgccgcgtgcattcaggatacccgcgtcatcgttgacgttcttcgcgagcaagctcgctcctacagtagggtttcgatacgcagcgaattggtcgaccccggctgcccaaacggcacccccgcggtaatcaccaaggtatccccgcgttgcgccataccctgggcctgggcgatttccaacgcggtggaacacacctcatccacctggcgcagacgatcattgaccaccgaatgcacgccccacgccacgctcaagcgccgcgccgtggacaggttcggcgtgaggttgaggatcggtgccaccggccgttcccgtgcggcgcgcaagctggaactgcccgactcgctgtagttcaccagcaccgccaccggcaggatgctgctgatgcgccggatcgcacagctgatggcgtccgacaccgtggcatccgccttgggccggctgacgtccagttgcgcctggtaatccgggccgttttccacctggcggatgatcttgctcatcatctgcacggcttccagcggatactcgcccgacgcggtttccgccgacagcatcacggcgtccgcgccttcggccacggcgttggcgacatcggtgacttcggcacgggtcggcgccggggagaaacgcatggactcgagcatctgtgtggcgaccaccactggcttgccgagttggcggcaggtgctgatgatgtctttctggatctgcggcacgctttcggccggtacttccacgcccaggtcgcctctggctaccatgatcgcatcgctcagctcggcaatttcctgcaggcgctgcacggccgagggcttctcgatcttggccatcaggaacgccttgtcgccaatcagctcgcgggcctcgcggatgtcttccgggcgctgtacaaacgacagtgccacccagtccacgcccagttccaggccgaagctcaagtcgcggcgatctttggcggtgagcgggctgagttccaacaaagcttgtgggacgtttacgcctttacggtcggacagctcaccgccattgagtacggtggtgtcgatggcgtcggcatgcttggtaatcacgcgcaggcgcagcttgccgtcatcgagcagcaagtccatgcccggttcaagggctgcgatgatttccggatggggcaggttgacgcggcgctggtcgccgggcgtcgggtccaggtccaggcgcagggcctggccacgaatcaactgcaccttgccttcggcaaagcgcccgacccgcagctttggcccttgcagatccatgaggatgcccagtgggtagttcaactggcgctccacctggcgaatccactggtagcgctgggcatggtcggcgtgttcgccgtgactgaagttgagacggaagatattcaccccggcttgcaccaactcaaggatgtcatcgatgccgtcggttgccgggcccagggtggcgaggatcttgaccttcttgtcaggcgtcatgtttggcagtctcaaggatcaggatggcacggaagtcgttgacgttggtgcgggtcggctcggtgatgatcaagtcgcccagggcgtcgaaatagccgtagccgttgttgttatccaactcgtcgctggccgacaggcccagggcttcggcgcgggcgtagctgctgggggtcatgatggcgccggcgttgtcttccgagccgtcgatgccatcggtgtcgccggccagggcgtacacgccgggcaggcccttgaggctgtcggtgaggctgagcaggaattccgcattgcgccctccacagccattgccgcgcacggtgacggtggtctcgccgccagacaggatcacgcagggcgccgccaatggctggccgtgctggacgatctgccgggcgataccggcatgtaccttggccacttcccgcgcttcaccctccaggtcgccgaggatcagcgggctgaacccggcctggcgcactttcacggctaccgcttccagggattgctgtgggcgggcgatcaattggaagtggctgcgggcaagtaccgggtcgccgggcttgaccgtttccgagtcggggttttgcagccagctgcgcaccgaggcaggggcgtcgatgccgtagcgcttgagaatccccagggcctgctgcgaggtgctggggtcgccgacggtagggccggaggcgatcaccgtggcctggtcgcccggcacatcggaaatcgcgtaggtgtatacggtggccggccatgccgccttggccaagcgcccgcccttgatcgccgagaggtgtttgcgcacgcaattcatttcgccgatggtggcgccggatttgagcagggctttattgatggcttgcttgtcggccaggctgatgccttcggccggcagggccagcaatgcggagccaccgccggaaagcaggaagatcacgcggtcgtcttcggtcaggtggctgatcaactccagcacgcgctgggccacggccaggccggcagcgtcggggaccgggtgggccgcttcgaccacctcgattttttggcacggcgcgccgtggccgtagcgggtgaccaccaggcccgacacttcgccctgccagcaattctcgacgaccagggccatggcggccgcggccttgccggcgccgatcacgatcacccggccactgcggtcggcaggcaggtaaggctcaagcacttgccggggatgggcggcgtcgatggctgtggcaaacagctcgcgaagcaggtgttgcggatcgaccgacataagcgggctcccggattcttgttattagcgttgggacttggaatgcaatcaaagggtgggagggggcttgctcccgctagcggtgcatcagtcgacatagtggttgaatgacagattgctatctggagcaagccccctcccacactggattgcattccaaggtgggttacttgtcgcggatcgagaagttggccatatgctccaagcccttgatcagcgccgagtggtcccagttaccgccaccaatggccgtgcaggtgctgaacacttgctgggtgccggcggtattcggcaggttgatccccagttccttggcgccggccaaggccaggttcaggtccttctggtgcaggttgatgcgaaagcccgggtcgaaagtacccttgatcatgcgttcgccatgcacttccaggatcttcgacgacgcaaagccgcccatcagcgcttcccgcaccttggccgggtcggcgccgttcctggaggcgaacagcagcgcttcggccaccgcctggatgttcagtgcaacgatgatctggttggcgaccttggcggtctggccatcgccgttaccgcccaccagggtgatgttcttgcccatggcctggaacagcggcaatgcacgttcgaaggtctgcggttcgccaccgatcatgatgctcaaggtgccggccttggcgccgacttcaccgccggacaccggtgcgtccagatactgcgcgccggtctcgttgatcttcgccgcgaacgccttggtggcggtgggggagatcgaactcatgtcgatcaccactttgttcggcgacaggccggcggccacgccgtcggcgcgcaacagcacgtcttcgacctgtggggtgtccggcaccatgacgatgatgaattcggcttcttgcgcgacttgctgcgggttggccagagcgatggcgccagcgtcgatcagcgcttgcggggccttgccatgatgctcggacagaaacagttggtgccctgctttctgcaggttggcggccatgggctggcccatgatgccggtgccgataaatccgattttagccatgatcaaaatcctcttttttattcggtaggcagacttgttgaggtctgccagacacatcaggtccaatgtgggagggggtgtgtgttagagcgcgttatgggttttgagccagcccaaacctgcttcggtggtggtcaatggcttgtactcacagccaacccaacccgtgtagccaatgcggtccagatgctcgaacaggaagcgatagttgatctccccagtccccggctcattgcgccccgggttatccgccagctggatgtggttgatcacacccaggtgcgttgccatggtccgcgccaggtcaccttccatgatctgcatgtggtagatgtcgtattgcaggaacaggttgtcactgcccacctgctcgcgaatcgccagggcctgggccgtgttattcaggtagaagcccgggatgtcgcgggtgttgatcatctccatcaccagcttgatgcctgccgcttgcagcttgtcggcggcgtacttgagattggcgacaaaggtcttttccagggtttcgtcttccacgccctgtggccggatacccgccaggcagttgatctgggtgttacccagtacctgggcgtaggcgatagccagcttgaccccggcgcggaattcctcgacccggtccgggtggcaggccaagccgcgctcgcccttggcccagtcgccggccggcaagttgaacagcacttggctcaggccgttggcatcgagctgcgccttgatctcggcggagctgaactcatacgggaacaggtattccacgccttcgaagccggcatcggcggcggccttgaagcgcgcaaggaagtcctgttcggtaaacagcatggacaggttggcggcgaaacgcggcatagggttctccttaatcgagcagggaaatggcggtcggtgcatcgttgccgaccagggccaggtcttcgaattcattgacggcgttgatttcggtgcccatggaaatattggtcacccgttccagaataatctcaacgatcaccggcaccttgaattcttcgatcatttcctgggcgcggcgcagggccggctggatctgccctggctcgaacacgcgcagggccttgcaacccaggccctcggcgacggccacatggtcgacgccatagccgttgagctccggggcattgaggttgtcgaaggacagctgcacgcaatagtccatttcaaagccgcgctgggcctggcggatcagccccaggtaggagttattcaccaccacgtggatgtacggcagcttgaattgcgcgcccaccgccagttcttcgatcatgaactggaagtcatagtcgcccgacaacgccactaccttgcggctcgggtcggccttgaccacgcccagcgccgcaggaatggtccagcccaacgggccggcctgaccgcagttgatccagtggcgtggcttgtagacgtgcaggaattgcgcgccggcaatctgcgacaggccgatggtgctgacgtagcaggtgtctttgccgaacacctggttcatttcttcatacacgcgctgtggcttgaccggcacgtcgtcgaagtgggtcttgcggtgcaaggtggctttgcgctgctggcagtcgtgcaaccaggcactgcggtccttgagcttgccggcggctttccattcgcgggccacttcgataaacatcgtcagggcggagccggcgtcggaaacgatgcccaggtccggggtgaacacgcggccaatctgcgtcggctcgatgtcgacgtggatgaatttacgcccttcggtgtagacctccaccgaaccggtgtggcggttggcccagcggttgccgatacccagcaccacgtccgacttgagcatcgtcgcgttgccataacggtgggaagtttgcaggccgaccatacccaccatcagcgggtgatcgtcgggaatggtaccccagcccatcagggtcgggatcactgggatgccagtcaattcagcgaactccaccagcaattcactggcgtcggcgttgatcacgccaccgccactgaccagcaatgggcgctcagcctggtcgagcagggccagggctttttcgacctggatacgcgtggccaacggcttggccagaggcagcggttggtaggcatcgatatcgaactcgatctcggccatttgcacgtcgaatggcaagtcgatcagcaccggacctggacggccggagcgcatttcataaaaggctttctggaacgcgtagggcacttggcctggttccagcacggtggtcgcccacttggtcaccggcttgacgatgctggtgatatccacggcctggaagtcttccttgtgcatgcgagcgcggggggcttgcccggtgatgcacaggatcgggatcgaatcggcggaggcgctgtataagccggtgaccatgtcggtgcccgctggcccagaggtgccgatgcacacaccgatattgccggccttggtgcgagtgtagccctcggccatgtgcgaggcgccttcaacatggcgagcaaggacgtgatcgatgccgcccaccttctgcaaggccgaatacagcgggttgatcgcagcgcctgggataccgaaggcggtatccacaccttcacggcgcatcaccaggacggcggcttcgattgctctcattttgctcatgattttggtgcctcttgcgttttgtaattgtatacaagtggtgtcgatgcaaagtgtattcacggcgggctacgcaggtcaatgtattttgtgaacgggcctttgcgtccgtcggaatggcttttttcgacgtatggagcctttgttcgaaaatattgtatacaaaaacaaatatcattgtgttctatttgtttggtcgagcatctgatcaaacagaacgccaaggctttacccataacaagataaggacggcacctatgagcgctttaaccttgaaactcgcgacccaactggccagtcaggcccttaccgctggccgcacgatttcagctgcgccgctgacgattgcggtactcgatagcggtggtcacttgattaccttgcaacgggaagacggcgcgagcctgctgcgcccgcaaatcgccatcggcaaggcctggggcgccatagccctgggcaagggttcacgtttgctggcgctggacgcacagcagcgtccggcatttatcgcggcgttgaacagcctggggcagggcagcgtggtgccggcgccgggtggggtgttgattcgggatcaggcgggattggtgttgggggcgatcgggatcagtggggatacgtccgatattgatgagcagtgtgcgatcacggcgattgagggggtggggttgatggcggatgcgggggtgtctgcctgatcctgtgtgactgttagggccaatcgggggcaagcccccgattggcacaggcaccgcggtctatcagtccggctcacaccccttgagcaccaaccgaataatcgtctgcgccgccgcctcatagtcggcttcatccaacttggccttgccggtcacggccgagatctgccagtcaaagtccgcataggtctgggtcgccgcccagatgctgaacatcaggtgattagggtcgatagtcgcaatcaacccacgatccacccagttctggatgcaatcaatattatgcttggcctgggcgttgagctgttcaacctgttcggtgctcaagtgcggggcgccgtgcatgatttcgctggcaaacaccttggaggcaaatggcaggtcacgggaaatgcggattttcgagcggatgtagttgctcagcacttccttgggctcgccgtctgggttgaacggcgtggaggcggccaggatcggctcgataatgctttcgagcacctcgcggtagaggttgtccttggacttgaagtagtaatagacgttgggcttgggcagcccggccttggcggcgatgtcgctggtcttggtcgcggcgaagcccttgtcggcaaactcctcgcttgccgcccgcaggattttttctttgttgcgctcgcgaatgctgctcataaaccagaggtttccttgccatgacaggcggttgcgcatggtagcaccggccatccgcgggcctcaacaatctgcccataacgccttgcgccgcgctatgctcgcccgatctcccccttacggatacttgattcatggcaggaagcagcttgttggtgttgatcgacgatatcgccgcggtactcgatgacgtcgccctgatgacaaaaatggcggcgaagaagaccgccggtgtgctgggtgacgacctggcgctcaatgcccagcaggtctccggggtgcgcgccgagcgggaaattccggtggtgtgggcggtggccaagggctcgtttatcaacaagttgatcctggtgcctaccgcgctgttgatcagcgccttcgcgccctgggcggtgacgccattgttgatgctcggtggtgcctacctgtgtttcgaaggcttcgagaaactggcgcataaattcctgcacagcaaggccgaagaccaggccgagcacgcgcaattggtcgaagctgtggccgacccggccaccgacctggtggcctttgaaagggacaagatcaaaggcgcgatccgcaccgactttatcctctccgcagaaatcatcgccatcaccctgggcaccgtggccgaagcaccgttgatgcagcaggtggtggtgctgtcgggcattgcgatcgtcatgaccgtgggtgtgtatgggctggtggcaggtatcgtcaagcttgacgacctggggctgtggttgacccagaagccgggtcaggtggcacgccgtatcgggggtgccattttgcgcgccgcgccgtacatgatgaaaagcctgtcggtgatcggtacggcggcgatgttcatggttggtggcggcatcctcacccatggtgtgccggtggtgcatcactggattgaatccgttagccagagcaccggggcgctcgcgtggttgatgccgacgttgctgaatgccgtggcggggattattgccggggccgctgtattggcagtggtcagtgtggttggcaaaagttggaaagcaatcagagcttaaccttgcgggcacaaaaaaggccattcaatcgaatggcctttttcatggcgcttggcttactcggcaatctgcaacttgcgcgattcggtatagatataccgcaccttctcatattcaaacggcgagttcatctgcccatagcggaagctggtctgatagcgcttatctaccgcgcgcagggcccagatttccgggtggttggagctgacttctgacacgttgaggaagttgatctgggtctcggcgctgtagtcgacgatcaggccggtggtgtcgcgcaggttcgacgggccgaagatcggcaggaccacgtaggcgccgccgggcacgccgtagaagcccagggtctggccgaagtcttcactctggcgcggcaggcccatggcggtggccgggtcccataggccggcgacgcctatggtggtgttgaccagcaagcgcccggtggtttccagggagcggtggcccttgagctgcagcaggctgttcaacaggttgggtacatcgcccaggttgttgaagaagttgctcacgccggtacgcaggaaacttggcgtgacatagcggtagccattgaccaccggcaggaacacccactggtcgaagcggtagttgaagtggtacacgcgacggttccacgactccagcgggtcatacacgttgagagcggtcagcgatgagcgttcgaactcgcgctggtccaggccggggttgaacttgagcttggtcagcggctccttgaagccgtcggcaccgaccttgaccggttcatgggccttgctgttgtcggcattggccacgcctgtgcacatcagtgcggcaagcagcaaaagatatttagccacggaagaactccagcatggcgtcggcgttgacgcggtaattgaggttgccgcagtggccgcccagcgggtagacggtcaagcgattgccgaaggttttacgcaggaaacccaggtcgccagggccgagaatcacgtcgtcggcgttgtgcatcacggcgattttcgggctgtcgcgcagatagtcctccagcgcgtacaggctcacctggtcgaccagctgcagcaggctgccgccatcggaacgggcgcgccacatcgggatcacttgttcggtgaggtagcaatcgaagtcgcattgcagggcacgcttgaggaacggcgtgaggctggtgccttcggtgatcgggtatttaggcgggatgatcaggccgcggcggttgatcaggtccgaggtaaaggcgatgtcggcagccgaaaagcggaacgaagtgccgatcaacatggccatctgttcgttgctcaggtgctgcttggactgttggaagtcatagagcagggcatcgttgaggtcgatgtagcctttttgctggaagtagcgggtcagtttgctcaacaccagctcatagaaggtagtggtgttgttgatgcccttgacctcggtctgtaccagcttgtcgaggttggtgatcgaggtgtagaggttgaccggcgggttgagcagcagcactttcttgaagttgaaggtgcggcgtgtctcgtcgagcttgctgacgaacgctgcatccagcgcgcccaggctatagccggtgaggtagaagtcggtgaccggcagcgaggcgttctgcgcgcgcacggcttgcatcacgcggtacatgtcttcggcgtcttcctgggtgatacccggggtggcgaagcgcgaggcagcgctgatgaagtcgaagctggtgggcgatgacaactgcaccacgtgatagccggcctggtaatacagcttcttcaggtattcgttgatgctgctgtcgaaccgcgcaccggtgccggcgatcaggaagatcagcggcgcagcacggtcctgcttggcgatgcggtaggtgagtttcttcaccgcccagaaattgtccggcaggctgaactcgcgttcggggcgcatattcagggtgtagtcggattggttgatctcatcatcggtcggcaaggttggccgaagatcgggaggcgtggtggcgatggtcgcttcgaacgggttggtcaaagggtagccatagctggcctggtcgatatcgacggccagtgctgacgcactcaaaaataggctgcccagcaaggcagcacagcgcaaggaacggagcatgacttaatccctaagaggaaacgtgctgaatgaagttcgcaggctatgaccaccgcgttgccaccgaagtgccagcctgcggcacgaaaagtcggaaaaagcgtcggaatcgggggtaatagttgccagacgatacactttgccgagctatgttgaacagatatctgcgcgaacaccttgctaacggccgcggtgggattaagctgagcgccgtttttgcctatcggagtgccccatgtcccgccgcttgccgttgattttgctgcttattgccctgccgttatggctggccgccagctatgccgcacgttatggctttatggaggatgggcagtgggtcggcctctgcgctgatgaagccagccgctgggagtgccaggcgcgtgccaacctggggttgatgattcacttcaaggtgctgggctgggcggcgttgatcacgtcggtgctggcgtttttcgtgccggggcgtgcggggtgggctttggcggtgctggggatggtgttcgggttaccggcgctggcgttgtacaacaccacgtttgcggtgttcgcggtggtgattgcggggttgcggttggtcaggaagcctcggggcgcctgatagggccaatcgggagcaagcccctcccacacttgattgggttcacatatttctatttgtgaatacggtcaagtgtgggagggggcttgctcccgatggcagtgttaagccttgcgcacccgcaagcaacgccacaaagcggcaaccatgagtacgctgaccactgcccaaccccaagcctgctggttcaacaagccttcccggtacaactgcggtgcaatgccggcaccgataatgaaggccagcagcgcaatctcccggcgtggtcccgttaccggtcgcatcaggtacaccagggctggcagcaccagcgccgcgcttgggaagctgcggtaacgcgggtcaaacaccagcgccagcatcattaccgcccccgcaaacccggcaatcgccaccagccagccagcgcgttgttccagccagtcaaacgctcgcacgcgccagccgtcacggacgctgagggccagggcggcgtgggccagcaccagcaggttaagtaccaccagcaaaccggcccatacccactcatcgttgaagcgtgcggtgacgcgggtcagttcggcccaggtgccgatggaacaggctgcaacggcgcccagcaagggcagcatcagcgccgagcgcgtgctacgtacgcggccgccgagcaccagggtgccgagcaggatgagcccgcccacgcccagccacagcggccagtacggcacattggttacggggccggcgaggatggccttgtcctggcggtctgcatcgaacagcccccaatacccgccgacagcaccttcactggcgcgcttccacggttggtcaaaggcttcgatcaggttgtagcgccagccattggcttcggccatggccacgaagccacgcatgaacttggcctcattgacccggcttggcacggcggtttcgcgctggcggccttcgctgggccagccagtctcgccgatcacaatgtccttgggcgcgaactggtggccgaaggtctggcgcacatcgcccacgtgcttgagcgcctggtcgatgccggatgggtcatcttcccagtacggcagcaggtgaatggtgaggaaatccaccgccggggcgatttccgggtgttgcagccagaactcccagacatcggcataggtgaccggctgtttgatctggcttttgactgtttgaatcagcgccaccaattgcttggcggtcacttccttgcgcaacagggcttcgttgccgacgatcactgaggtgacgatgtcaggattggcattggcagcagcgatcagttcgttgatttctttctcggtcgccactggatcgctgctgacccaggccccggccatcaccttcaacccatgcttgcgcgccaggtcgggcaaggactccaggcccgtcatggagtaggtgcgaatgcactcaaaacgcgtggcaagcagtgccaggtcggcgtccatgcgctcggggcgcagcttgaacggctggtcgaagggcgactgatccttgtcgaacggcgtataggacgcacactgcatcttgtggctggcgctggcgacgtccggcaacaccaccggccggccgaggccgtaccagtagccgacaagggtaagtaggccgaggatcaaggcgagaaaatagggcagggcagggaagcgggcagtcgcgggcatggtcggcttatctgggggagcaaaggcgcgcatcttacccgcaattgactcctttcagtggggctgcatgattttgacatgcaaagttcgggcggaattctggcgtcaagttgtaggaagtctcctgctggctatgtgatgtcgtttcttgctcagccgaggtcgctggcagagcaggtccatggaccctgcaggttgattatcgaagggtcagaactccactgatgtcttgggcaaccggatcgatgcgcgtgaaggaggcgcggtgcaccctataacaacagtttgacgtcgctcggcatccgtcgggcgcagcactttcggggaagtactatgaagatgcgacgactcttgggcgcagctgccacgttggtagttgcgatgggctccacactggccagcgccgacagcaagaccctgagcctcggctacgtggacggttggtccgacagcgtggctaccacccatgtggcggcagaagtgatcagggaaaaacttggctacgacgtgaagctgcaagccgtcgccaccgggatcatgtggcagggcgtcgccaccggcaaactcgatgccatgctctccgcctggctacccgtgacccacggcgaatactgggccaagaacaaagacaaggtggtcgactacggccccaacttcaaggatgcgaagatcggcctgatcgtgccggagtacgtcaaggccaaatccattgaagacctcaagaccgataccaccttcaagaacaagatcgtcggcatcgacgccggttcaggcgtaatgctcaagaccgacgaagccatcaagcaatatggcctggactacaagctgcaagccagctcgggcgcggcgatgatcgccgaactgacccgtgccgaagacaagcaggactccattgcggtgaccggttgggtgccgcactggatgtttgctaagtggaaactgcgtttcctggacgaccccaaagggatttatggtgctgctgaaaccgtcaacagcatcggcagcaagggcctggagaagaaagcaccggaagtggcggctttcctgaagaaattccagtgggcctccaaggatgagatcggcgaagtcatgctcgcgatccaggaaggcgccaagcctgatgcagcggccaaggattgggtggccaagcaccctgagcgcgtagctgaatggaccgctaaataaaagccactgatgcacccctgtgggagggggcttgctcccgatcgcgatatgtcagtcacagattttttgactggtacaccgctatcggagcaagccccctcccacactggtttcgcaccgcctcaaatcttcctgcgctttggccatccctcgctacactcgatctactactaaggtcgtctggaaccctttccacagccgcatacagtggatacgttccaataataaaaaagctgtgctgcgaggataaaaacaatgaacgacagcatttacctctcgattcaaaacagcccgcgtttcaaggagctggtcaggaaaagggaaaagttcgcctggattctctcggcgatcatgctagggctttactccggtttcatcctgttgatcgcctacgggccgcaagtactgggggccaagctcagccctggttcatccatcacctggggtatccccatcggggtcgggctgattgtctcggccttcatcctcaccggtatctatgtgcgacgcgccaacggcgaattcgacgacctgaacaatgcgattctcaaggaggctgcgcaatgatccgtcgtctattggctgtattcggcgcttgcgtctttgcgcccgccgtttgggcggcagatgcattgaccggtgaagtgcacaagcaaccgctgaatatcgcagcgatcctgatgttcgtggcctttgtcggcgcgacgttgtgcatcacctactgggcgtccaagcgcaacaagtcggcggccgactactatgcggcaggcggcaagatcaccggcttccagaacggcctggcgattgccggtgactacatgtcggcggcgtccttcctgggtatttccgcgctggtgtttacctctggctacgacggcctgatctactcgatcggcttcctggtgggctggccgatcatcctgttcctgatcgccgagcgcttgcgtaacctgggcaaatacacctttgccgacgtggcgtcctatcgcctcgggcaaacccagatccgcagcctctcggcctgtggctcgctggtggtggtggcgttctacctgatcgcgcagatggttggcgcgggcaagctgatccagctgttgttcggcctggactaccacgtggcggtgatcctggtcggcatcctgatgtgcttgtacgtgttgttcggcggcatgctggcgaccacttgggtgcagatcatcaaggcggtgctgttgctgtccggtgcctcgttcatggcgctgatggtgatgaagcacgtcaactttgacttcaacatgctgttctccgaggcgatcaaggttcaccctaaaggtgaagcgatcatgagcccgggcggcctggtgaaagatccgatctcggcattctcccttggcctggccctgatgttcggtactgccggcctgccgcacatcctgatgcgtttcttcaccgtgagcgacgccaaggaagcgcgtaagagcgtgctgtacgctacgggcttcatcggctacttctatatcctgacctttatcatcggcttcggcgcgatcctgctggtcagcaccaatccggcgttcaaggatgcggcaggcgccttgctcggcggtaacaacatggcggcggtgcacctggccaacgcggtgggtggcagcatcttcctgggctttatctcggccgtggcctttgccaccatcctcgcggtggttgccggcttgaccctggccggtgcctcggcggtatcccatgacctgtacgccagcgtgatcaagaagggcaaggccaacgagaaggatgagattcgcgtgtcgaagatcaccaccatcgccctggcggtgctggctatcggcctgggtatcctgttcgaaagtcagaacattgcgttcatggtcggcctggcgttctcgattgccgccagctgtaacttcccggtactgctgctttctatgtactggaaaaacctcaccacccgtggcgccatgatcggcggctggctgggcttgatcagtgccgtgggcctgatgatcctcggcccgaccatctgggtctcgatcctgcaccatgaaaaagccatcttcccgtacgagtacccggcgttgttctcgatgatcattgcgttcatcggcatctggttcttctccatcaccgacaagtcggcggcggcagagaaagagcgtgcgctgtacttcccgcagtttgtgcgttcgcagactggcctgggggcgagcggggcggttaaccactaaggttatagctggatagaaaatgccccggtcgaaaggccggggtatttttttgcctgaagatttgtgttgggtggacttgctcccgatggcggtacaccaggcaccacaaacaaaaacggcctccgctaagggaggccgttctcattacaagcaagccgctaagtgcttacttgcgatcttccagcttggtaatgtcacgcgactcgtagccggtgtacaactggcgcgggcggccaatcttgtacgggctggagagcatttccttccagtgggagatccagcccacggtccgcgccagggcgaagatcacggtgaacatgctggttggaatgccgatagccttgaggatgatccccgagtagaagtcgacgttcgggtacagcgagcgttcgatgaagtacgggtcggtcagggcgatctcttccaggcgcatggccagttcgagttgcggatcgttcttgatgcccaactccttcaacacttcgtcgcaggtctgcttcatcacggtggcacgtgggtcgcggttcttgtagacccggtgaccgaagcccatcaacttgaacggatcgttcttgtccttggccttggcgatgaaggtgtcgatgttcgacacatcgccgatttcatcgagcatggtcaacacggcttcgttcgcaccgccgtgggcagggccccacagtgcagcgataccggcggcgatacaggcgaacgggttggcacccgaagagccggccaggcgcacggtggaggtggaggcgttctgctcgtggtcggcatggaggatgaagatccggtccatggccttggcaagcaccgggctgatcggtttgatctcgcacggggtgttgaacatcatgtgcaggaagttttccgcgtacgtcaggtcgttgcgcgggtacatcatgggctggcccatggagtacttgtagaccatcgcggccagggtcggcatcttggcaaccaggcggatcgcggaaatttcgcgatgctgcgggttattgatgtccagggagtcgtgatagaaggccgacagggcgccgaccacgccgcacatgacggccatcgggtgggcgtcgcgacgaaagccgttgaagaaggtcttcaattgctcgtgaaccatggtgtggttcttcacagtgctgacgaactgggctttctgctcggctgttggcaattcgccatttagcagcaggtagcaggtttccaggtagtccgattgttcagccagttgctcgatcgggtaaccgcgatgaagcagaatgccattgtcaccatcgatataggtgatcttcgactcgcaggacgcggtcgacatgaagcctgggtcgaaagtaaaacggcccgtggccgtcaggccccgtacgtcgataacatcgggaccaacggtgccggttaaaatgggcagctcgacgggggctgcgccctcgatgatcaactgcgcttttttgtcagccatgtggcctcctatttatgcttcaaatcatcagacagaccccccacgcagggcccgcaccactatattgatataaatccagatgtcaatttgcctaaagtcttgcgccagaaggctttaaccgtactttttcgtcgaaattgactgccgtttacgccttttatcccgtcagcgcaatcagctattagggtgaggtgtgcgcgttgtcattagtaacctaactgtctatactcggccaccgaccgccaagggcttttgggcttgctttcattgggggtcgcactccctgggtggtgcttacctgaccagtcgcactccccaacaactttgccctgattgttaggggctcttcagtgtgaaaaaaagccgtgaatagccaacgacctgtaaacctagacctaaggaccatcaaactccccatcaccggcgttacgtcgttcctgcaccgtgtttccggcatcatcctgttcctgggcttgggcatcatgctttatgcattgagcaaatccctgggttccgaggaaggatacgccgaggtgaaggcatgcttgaccagcccgctggccaagttcgtagcatggggcctcttgtcctctctcctgtatcacctggtagccggtgtgcgccacttgatcatggatatgggcatcggtgagacgctggaaggcggccgcctgggctcgaaaatcatcatcgccatttccgtggtgctgatcgttctggcaggagtttggatatggtaaccagcgttacgaatctgtcgcgttcgggcctctatgactggatggcacagcgtgtgtctgcggtcgttctcgcggcttatttcattttcctgatcggatacctcgtcgcaaacccgggtattggctatgagcaatggcatggcctgttttcccataatgcgatgcgaatcttcagtctgctggcccttgtagccctgggcgctcacgcctgggttggcatgtggaccatcgcgactgactacctgacgccgatggcgctgggcaagtccgcgactgcagtacgtttcctcttccaggcagtatgcggcgtcgcgatgttcgcttacttcgtctggggtgtgcagattctttggggtatctgattcatggctaacattccaactatttcattcgacgccatcatcattggtggcggcggtgctggcatgcgcgctgcgctgcagctggcccagggtggtcacaagactgccgtgatcaccaaggtgttcccgacgcgttcccacaccgtatcggcccagggtggtatcacctgcgccatcgcgtccgccgacccgaacgatgactggcgctggcacatgtacgataccgtcaagggttccgactacatcggtgaccaggacgctatcgaatacatgtgtcaggagggcccggccgcggtgttcgagctggaccatatgggcctgccgttctcccgtaccgagcaaggtcgtatctaccagcgtccattcggcggtcagtcgaaggactacggtaaaggtggccaggctgcccgtacctgcgccgcgtccgaccgtaccggtcacgcgctgctgcacaccctttatcagggcaacctgaaagccggcaccacgttcctgaacgagtactacgcggttgacctggtcaagaacgcgcaaggcgagttcgttggtgtgatcgctatctgcatcgaaaccggtgaaaccacctacatccgtgccaaggctactgttctggccaccggtggtgcaggccgtatctacgcttcgaccaccaatgccctgatcaacaccggtgacggcgtcggcatggcactgcgcgctggcgtaccggtacaagacatcgaaatgtggcagttccatccgaccggtatcgccggcgccggtgtactggtgaccgaaggttgccgtggtgaaggtggctacctgatcaacaagcatggcgagcgtttcatggagcgttatgctccgaacgccaaagaccttgctggtcgtgacgtagtagcccgttcgatggttaaagagatcatcgccggcaacggctgtggcccgaatggcgaccacgtactgctcaagctcgatcacctcggtgaggaagtgctgcacagccgcctgccaggtatctgcgagctgtccaagacctttgcccacgttgacccggtggttgctccggtgccggttgttccgacttgccactacatgatgggcggcgtgccgaccaacattcatggccaggcgatcacccagaacgccgatggccaggacgagatcattcatggtctgttcgcggtaggcgaagtggcctgcgtatcggtccacggtgccaaccgcctgggcggcaactcgctgctcgacctggtggtattcggccgagctgccggcctgcacctggagaaggcgctgaccgacggcatcgaatacgatgacgccaccgacgccaacatcgaagctgccctggcgcgcctcaacgctctgaacgagcgcactgatggcgaagacgtggcaaccctgcgtcgcgaactgcaaaactgcatgcagaactacttcggtgtgttccgtaccggcgaatacatgcagaagggcattgcccagctggccgatctgcgcaagcgtatcgccaacgtcaagatcaacgataagagccaggcgttcaacactgctcgtatcgaagcccttgagctgcaaaacctgctggaagtggctgaagcgacggcgatcgccgccgaggttcgtaaagaatcccgtggtgcccacgcccgtgaagactttgaagatcgcgatgacgaaaactggttgtgccacaccttgtacttcccgggtgacaagcgcgtgaccaagcgtgccgtgaacttctcgccgaagacggttccgacgtttgaaccgaagattcggacttactaagggtggctgccatgttgaaagtcagtgtttatcgctacaaccctgatcaggacgccgcgccgttcatgcaggaattctcggtcgataccggtggtaaagacctgatggtgctggacgtgctggccctgatcaaggagcaggacgagggtttctcctatcgtcgctcttgccgtgaaggtgtctgcggctccgacggcatgaacatcaacggcaagaacggcctggcgtgcattacgccgctgtctgctgttgtcaagggtaacaagctgatcgttcgtcctctgccaggtttgccggttatccgtgacctggtcgtcgatatgagcatcttctacaagcaatacgagaaagttaagccgttcctgcagaacgacacgccggctccggccatcgagcgtctgcagtccccggaagagcgtgaaaagctcgatggcttgtacgagtgcatcctgtgcgcttgctgctcgacttcgtgcccatccttctggtggaacccggacaagttcctgggcccagctgccctgctgcaagcgtaccgcttcctggcagacagccgtgataccaagacgtccgagcgcctggcttcgctggatgacccgttcagcgtattccgctgccgcgggatcatgaactgcgtcaacgtatgtcccaaaggcctgaacccgactaaggccattggtcacatccgtaacatgctgctgcagagcggcgtgtaactgacgttgtagtaatagcaggaccgttgtgcccgtaaatgctgcggcgcaggcttcaaccggcgccgtagttttaacttgagcagcgacttacaaagccgcggctcttattttgaagaaatgagacaagcaggggcattcgggttggtacccgaactatcagcgtgatcctaagtggcttgttttggtcgctgcacttggccttttgcaagcagactcggtgttttcgccggtggtgtccccaaatcgagggtgaccaagcatgcaagaaagcgtgatgcagcgcatgtggaacagcggctatctttcaggtggtaacgctgcctatgtggaagagctttatgagctctacctgcacgaccctaacgctgtgccagaagaatggcgcaccaaatttcagacgttgtcttcagacggcaacgctgccaccgatgtatcgcacgcaacaattcgcgatcagttcgtgctgctggcaaagaaccagcgccgcgcccagccggtttccgccggcagcgtgagcagcgagcatgagaagaagcaagttgaagtactgcgactgatccaggcctaccgtatgcgtggccaccaggcagcccagcttgacccgctggggctgtggcagcgtcctgcacctgcagacctgtcgatcaatcattacggcttgaccaatgccgatcttgatacgaccttccgtgccggcgacctgttcatcggcaaagaggaagcgagcctacgcgaaattcacgaagcgttgcagcagacatattgccgcaccatcggcgctgaatttacgcacatcaccgattccgagcagcgccactggttccagcaccgcctggaaggcgtgcgtggccgcccggtattgtccgccgatgtgcgcagccacttgctggagcgcgtgaccgcagctgaaggcctggagaaatacctgggcaccaaatacccaggcaccaagcgttttggcctggaaggcggcgaaagcctgattccgatgctcgacgaactgatccagcgttccggttcctacggtaccaaggaagtcgtgatcggcatggctcaccgtggtcgcttgaacgtgttggtcaacaccttcggcaagaacccgcgtgagctgttcgacgagttcgaaggcaagaagaaggtcgagctgggttccggtgacgttaagtaccaccagggcttctcgtccaacgtgatgaccaccggcggtgaagttcacctggccatggcgttcaacccctcccacctggaaatcgtttcgccagtggtcgagggttcggtacgtgctcgccaggatcgtcgcaacgacgccaccggtgagaaggtcctgccgatttccattcacggtgacgcggcattcgccggtcaaggcgtggtcctggaaacgttccagatgtcgcagactcgcggcttcaagaccggtggtaccgttcatatcgtcatcaacaaccaggtcggctttaccatcagcaacccgctggatgcgcgctccactgagtacgccaccgacgttgccaagatgatccaggcgccgatcctgcacgtgaatggggatgacccggaagccgtgctgttcgtgacccaactggctgtcgactaccgcatgcagttcaagcgtgatgtggtgatcgacctggtttgctaccgccgtcgcggtcacaacgaagcggacgagccaagcggcactcagccattgatgtatcagcagatcaccaagcagcgcaccactcgtgagctgtacgccgaaagcctgaccaaggccggcgtggtggatgatgagcgtgtccaggccaaagtcgacgaataccgcaacgccctggacaatggcctgcatgtagtaaaaagcctggtcaaggagccaaacaaagagctgttcgttgactggcgtccgtacctgggccacacctggactgcgcgtcacgatacctccttcgacttgaagaccttgcaggaactgtccgccaagctgctggaaattcccgaaggtttcgtcgttcagcgccaggtggcgaagatctacgaagaccgtcagaagatgcaagccggcggcctgccgatcaactggggttacgctgaaaccatggcgtacgcgaccctggcgttcgaaggtcacccgatccgcatgaccggccaggacatcggccgtggtacgttctcgcaccgtcacgcggttctgcacaatcagaaagacgcttccacctacattccgttgcaacacctgtacgaaggccagccacgtttcgacctgtacgattcgttcctgtccgaagaagccgtactggcgttcgaatacggctactcgaccaccacgccgaacgcgttggtgatctgggaagcccagttcggcgacttcgccaacggtgcccaggtggtgatcgaccagttcatcaccagcggcgagcacaagtggggtcgcctgtgcggtctgaccatgctgctgccacacggttatgaaggtcagggccctgagcactcctcggcccgtctggagcgttacctgcagctgtgtgccgagcacaacatccaggtgtgcgtgccgaccaccccggcgcagatctaccacttgctgcgtcgccaggtgatccgcccgctgcgcaagccgctggtcgtactcacgccgaaatcgctgttgcgccacaaactggccgtctcgaccctggaagacctggccgaaggttcgttccagaccgtgattccagagatcgacacactggacgccgccaaggtcactcgcctgatcctgtgcagcggcaaggtctactacgatctgctggaaaaacgccgtgccgaaggccgcgaagacatcgctatcgtgcgtatcgagcagctctacccgttcccggaagatgacctcatggagatcatcgcgccttacaccaacctcaccaatgtggtgtggtgtcaggaagaaccgatgaaccagggcgcctggtacagcagccagcatcatctgcgtcgcagcatcggcaaccacaacaaggccctgggcctggagtacgccggtcgtgatgcttctgctgcacctgcctgtggttatgcgtcgatgcacgccgagcagcaggaaaaactgctgcaagatgctttcactgtttaacgccttcgcgctgactgaaaccgaattttaaggacctacagataatggctatcgaaatcaaagccccgtcattcccggaatcggttgccgatggcaccgttgccacctggcacaagaaaccaggcgacgccgtcaagcgtgacgagctgatcgttgacatcgagactgacaaagtcgtactcgaagtgttggctgaagctgacggcgtgctgggcgcaatcgctgatggtgccaatgagggcgacaccgtactgtccaaccaactgctgggctcgatcgaagagggtggcgctgccgccgcgccggccgctgctgctccggctgctgcgcctgccgcttcggcgcctgctgccgcaccggctgccgctggcgaagacccaatcgctgcaccggctgcacgtcaactggctgatgaaaacggcatcaacctggcttccatcaagggcaccggcaaagacggccgcgtgaccaaggaagacgtggttgctgccgttgaagccaagaaaaacgccccggctgccgcacctgccaaagctgctgctccggctgccgctgctccggtattcgctgccggcgatcgcaccgagaagcgtgtaccgatgacccgtgtacgtgccaccgtcgccaagcgtctggttgaagcccagtcgaacatggcgatgctgaccaccttcaacgaagtcgacatgaccgaagtcatggccctgcgttcgaagtacaaggatctgttcgagaagtcccacaacggcgtacgcctgggcttcatgtcgttcttcgtcaaagcggccaccgaagcgctgaagcgcttcccggcagtcaacgcctccatcgacggcagcgacatcgtctaccacggctatgcagacatcggcgttgccgtgtccagcgaccgtggcctggtggttccggtactgcgtaacgccgagctgatgagcctggctgaaatcgaaggcggcatcgccggcttcggcaagaaagcccgtgacggcaagctgaccatcgacgagatgaccggtggtaccttcaccatcaccaacggtggtaccttcggttcgatgatgtcgacgccgatcgtcaacccaccgcaagccgcgatcctgggcatgcacaacatcatccagcgtccgatggccatcaatggccaggtcgtgatccgcccaatgatgtacctggcactgtcttacgatcaccgcctgatcgacggtaaagaagccgtgacgttcctggtgaccatcaagaacctgctggaagacccggctcgcctgctcctggacatctgatagaagcagccgcaagttgcgagctacaagctgtaggaaaaagcagcttggcttgcggcttgtggctaaaagcttgtcgcaaatagaggatctattttcatgacacagaaatttgacgttgtagtgattggtgcaggccctggcggctatgttgccgccatcaaggccgcgcaactgggcctctcgactgcctgcatcgaaaaatacaccgacaaggaaggcaagctggcgctgggcggtacctgcctgaacgttggctgcattccttccaaggcgctgctggacagctcctggaaattccacgaagcccaagacggcctggccattcacggtatccaagggatcagccgtgagaccctgcgcatggatgttcctgccatggtcggccgtaaagccaacattgttaaaggcctgacttccggcgttgctaccttgttcaaggccaacggtgtgacttccatccagggccacggcaagctgctggccggcaagaaagtcgaagtaaccaagccggacggttcggttgaagtcatcgaagccgaaaacgtgatcctggccccaggctcgcgcccaatcgacattccaccggctccggttgaccaaaacgtaatcgttgattcgaccggcgccctggaattccaggccgtgcctgcgcgtctgggcgtgatcggcgctggcgtgatcggcctggagctgggttcggtctggtcccgcctgggctccaaggtcaccgtgctggaagccctggacacgttcctgctggctgccgacaccgccgtgtccaaagaagcgctgaaaaccctgaccaagcaaggcctggacattaagctcggcgctcgcgtgaccggctccaaggtcaacggcgaagaagtcgtggtgacctacaccgacaaggatggcgagcaaaccatcaccttcgacaagctgatcgtggctgttggccgccgtccggtgaccaacgacctgctggcttccgacagcggtgtagagatcgacgagcgtggtttcatccatgtcgatgatcattgctctaccgctgttccaggtgtttacgccatcggtgacgtggttcgcggcatgatgctggcgcacaaggcttccgaagaaggcatcatggttgtcgagcgcatcaagggccacaagacccagatgaactatgacctgatcccatcggttatctacacccacccggaaattgcatgggtcggcaagaacgaacagcagttgaaaaacgaaggtgttgaagttaacgtcggcaccttcccgttcgctgcttctggccgtgccatggcagccaacgacaccggtggttttgtcaaggtcatcgctgatgccaagactgaccgcgtattgggcgttcacgtgattggcccaagcgctgcagaactggttcagcagggcgcgatcggcatggaattcggcaccagtgccgaggacatcggcatgatggtcttctcccatccgaccctgtccgaagcgctgcatgaagccgcgttggcagtgaatggcggcgccatccacatcgccaacaagaagaagcgctaagcgagataataagaaaccacggcggagttgcccgtcgtgagccttgcgcgcaagactcaccgcggaatatccgctggacgcagccttgtgcagctttacgggccttgagccccgcaagttgcgcaagcagcagtcacaggtggcgcggcactcataatgagcgcagcgccgaatgcgcagtacctaacgaagacggtaaaaagcatgaatcttcacgagtatcagggtaagcagctgttcgctgaatacggcctgccagtttccaagggctacgcagtagacaccccggaagcagcagcagaagcttgcgacaaaatcggcggcagtgagtgggtggtcaaagcccaggtccacgccggtggtcgcggtaaagcgggcggcgtcaagctggttcgcagcaaagaagacgccaaggccttcgcacagcagtggctgggcaagcgtctggtgacttaccagactgatgccaatggccagccagtcaccaagatcctggttgaatcgtgcactgatatcgctaaagagctgtacctgggcgctgtcgttgaccgttcgagccgtcgcatcgtattcatggcttccaccgaaggtggcgtggacatcgagaagatcgctcacgaaaccccagaaaaaattctgaaggccactatcgatccactggttggcgcccagccattccagggtcgtgaactggcgttccagctgggcctggaaggcaagcaagttgcccagttcgccaagatcttcgtaggtctggccaaactgttccaggatcacgatctggccctgctggaagtgaacccgctggtgatcaaggctgacggcgatctgcactgcctcgacgccaagatcaacatcgacgccaacgccatgtaccgtcagcctaagctgaagactttccacgatccgtcgcaagacgatccgcgcgaagcgcacgctgccaagttcgaactgaactacgtagccctggaaggtaacatcggttgcatggtcaacggtgctggcctggccatgggtaccatggacatcgtcaacctgcatggcggcaagccagccaacttcctcgacgtaggtggtggcgctaccaaagagcgcgttaccgaagcgttcaagatcatcctgtccgactccaacgtcgctgcagtactggtcaacatcttcggcggcatcgttcgttgcgacatgattgccgaaggcatcatcggtgcagtgaaagaagtcggcgtcaaaatcccggttgttgtgcgccttgaaggtaacaacgctgaactgggcgctaaagtactggcagaaagcggtttgaacatcatcgcggctaccagcctgaccgacgctgctcaacaagttgtcaaagctgcggagggcaagtaatgagcgtcctgatcaataaagacaccaaagttatctgccagggtattaccggttcgcaaggtagtttccacacccagcaagccatcgagtacggcactcagatggttggcggtgtaacgccgggcaaaggcggtaccgagcacctgggcctgccagtgttcaacaccgtgaaagaagcggtagaagccactggcgccaccgccagcgtgatctacgttccagctcctttctgcaaggactcgatcctggaagcggcattcggcggcatcaagctgatcgtgtgcatcaccgaaggcattcctaccctggatatgctggacgctaaagttaagtgcgacgagctgggcgtagtcctgatcggccctaactgcccaggtgtgatcaccccaggcgaatgcaagatcggcatcatgcccggtcacattcacttgccaggtaaagtcggtatcgtttcccgttccggcaccctgacctacgaagctgtgaagcagaccactgacgccggtttcggtcagtcgacttgcgtcggcatcggcggtgacccgatcccgggctcgaacttcatcgacatcctgaagctgttccaggaagacccgaagaccgaagcgatcgtgatgatcggtgagatcggcggttcggctgaagaagaagcggctgcctacatcaaggcacacgtgaccaagccggttgtttcctacatcgctggtgtgactgcccctgcgggcaagcgcatgggccatgctggcgcaatcatctctggcggcaaaggcactgcagacgagaaattcgctgcgctgcaagacgcaggcgttaaaaccgtgcgttcgctggcagacatcggcaaggccttggctgagctgaccggttgggctgtcaagtaagcctcgcgcttagctgacgcttcaccacacaaaggccaccttcgggtggcctttgtgcattctgggtctgggatatggcccttctgtaggagcgagcttgctcgcgaaaaacgtcgacgataacgcgtacttcctgaatgaacgcggcgcctgtgagtttttcgcgagcaagctcgctcctacgaaaaacctatattgctaaattaagtatgaaaacgcgacatttgaatgtcgcttatcggacagtgcgccccgcaacagtgcgtttgtcagtctaattctgtaccctaaccgcctctttatgcgtccgcatcccaaaaggaagctgcgcgctagtacggtcagccctcatcagggccggcagcatttccctcatccatagggaagccctctctaaattccgattcagtagtgtggtatttcctcaaatgaaagtgttgaaaagccaggatatcctggcgttgggctttatgacctttgccctgttcgtgggcgccggcaacatcatcttcccgcccatcgttggcttgcagtccgggccccatgtctggatggcggcgctgggcttcttgatcaccgcggtcggtttgccggtggtcaccgtgatcgccctggccaaggtcggtggtggcatggatgcgctgagcagcccgatcggcaagatcgctggtggcctgctggcggcggcggcgtacctggcggtagggccactgttcgcgaccccgcgcacggcgacggtgtcatttgaagtgggtcttgcgccgttgaccggtgaaagtccgttggcgctgttcctctacagctcggtgtatttcctggtggtgttcttcgtctcgctgtatccaggccggttgctggacaccgtaggtcgtttcctcgcaccgttgaagatcattgcgctggccatcctcggtatcgccgcgtttgccttgcctgccggcgaagtaggggttgctactacggaatatgtcgccgcgccgttctcccaagggtttatcaatggctacctgaccatggataccctgggcgccctggtgttcggcatcgtgatcgtcaacgcgatccgctcccggggtgtcgagtcgcccaagctgatcacccgctacgcgatcattgccgggctgattgccggcgtgggcctggcgctggtgtacgtcagcctgttccgcctgggctcgggcagtcatgccgtggctgctggcgccagcaacggcgccgcggtactgcacgcctatgtgcaacatacgttcggctccctgggcagcggcttcctcgccgtattgatctccctggcgtgcctggtcaccgccgtgggcctgacctgcgcctgcgccgagtacttcagcaagatcctgccgctgtcctacaaaaccctggtagtgatcctggcagtgttctcgttgttcgtgtccaacctgggcctgaccaagctgatcgccttctccattccggtactcaccgccatctacccaccgtgcatcgtgctggtggcgctgagcttctgtaaggatttctggcaggagcaagggcgtattgtcggaccggtaatgctggtgtcgtttatctttggctgcatcgacgctctcaagggggcgggcctggcggattggatgccagcgcaattgacccacctgccgctgagtgagcaaggcctggcctggctggtgccatcagtgatgaccctggtcgtggcggtggtggtcgaccgcctgctcggcaagcgtagcgaagccatcgcataacagattgtttgaggctgtattgaaatgccccgtatcaatcgatacggggcattttttatgcgtatgaggttacatatttctaaagttgtaacccggtaagagtggaaggagggtttgccctctctcaaagtttaccgcgttcgccacaccctctcatgtaataggaccggcatgtcgttcgttgaaaccaaccaagcccacctgctcgccgcaatctggtttgttatctgctggggcggctatacccgttacgccacctggaaagcccgtgacaccgcgtgtctggccagcgtgctgcatctgtaccgcgaagactggatgagccgcatgctattgcgcgataaccgcatcgccgacgccagcgtgatcggcaacctggaacgcaatgcctcgttctttgcctccagcactttgatcattctcgccggtattctcacggtgctcggcgcttccgaacgggcggtgtcgttgctggcggacattcccatggtgcagcaggcgtcccgtgggatgtcggagatcaaattgctatgcctggcactggtatttgtctacgctttttttaccttcagctggtgcatgcgccagtacaactttgcggcggtgctggtgggttcggcgccgatgatcggtgagcgacaagtctcggaacaggagcgcaaagcgttcgcgtcccgggcggcgcgggtgatttccatggcggccaaccaattcaaccttgggctgcgttcttattatttcggcatgaccatgctggcctggtttgtcagcccttggctgttcatgttgttgagcagcggggtggtgctggtgctctattaccgagagtttcattccgcggtgctgcaagtgatggtctataccccgaccgatatgtctgcgccggagtcggtcaaagaggccgcacgctgattacgcctgtgcccggcgcaaaataagcagataaaaaaagcccgctatctaagcgggctttttttgcggaatcagaccagcctattaaggcttggcaggctctgctggtgcggcaggtgcagcttcttttgcggcagcttcgttagcttcagcctgagctttggcagcatcagcgttttctttcgcagcgtcgttcactttatcctgtgctttagccatgtcttgctgagcttgttctttatgtgcagcagcgtcttgggctttgtcttcggatttcttgtcgcaggcagccaggccgagggcagcggccagcatcatggaaatagctaatgtcttgcgcatggggtgtttctccttattgaagatatctactggcctttcgagcctaatgggccagcattagttccttttatcccaaagatatatatacgttttcgcacagaaacttttttcggcgtttttagtccgccggattcacactaataagagtctaaaaccaatgaccgaaaaccccttgttagagcgtgccgcacgctttgtttcggcgctgcgccactgccaggtgctgggtgttgccgtgcatgcggccagtgaggagggcatgaccctcgtgctgccttacggcccgcatatcgtcggtgatcccctgagcggggtaatccatggtggcgcgctgacttccttgatggacacggcctgcggcatggccaccctgtgcgtattagccgaattcgaggtgtgcccgaccctggacctgcgcatcgactacatgcacccggcccagccccataaaccggtctatggttttgcccaatgctaccgggtcaccactgatgtgatctttacccgaggtgtggcctaccaggacgacccgcaacagcccatcgcccacgtggtgggcacgttcatgcgcatgggcaagcgtctcaaaggcacgcaggggctaggcagcacggtcaggggagagcagacatgacccataggttcaagacccgcctggagcaggccctcgctcgcggcaattacgacgcacttctggacttggtgccctatgccaagcttatcggtgtcgaatgcacccggttgggggatgagcttctgtttcgcctgccggccagcaaggacaatattggtaacccgatattgccggcgttgcatggcggagtgatcgccggctttatggagctgtcggcgtcgatgcacctgctggtgtctaccggcgctccgagcctgccgaagattatcgacttctctctggattacctgcgcgccggccagtttcgcgacacttacgccaaatgccaggtatggcgccagggccgccgtgtggcgaatgtggcgatcaccgcctggcagagcaccccggccgaaccgattgccaccgcccgtgcacatttcaagattgaggaattggtccgcccttgaaatcctggtcttagcccccaactttgatgacaacccgccgccaaccctcaagggcgcggccattgccatccaattggagtttgatgaccatgagtgtggaaactcaaaaggaaaccctgggcttccagaccgaggtgaagcagctgctgcacctcatgatccattcgctgtattccaacaaggaaatcttccttcgcgaattgatctcgaacgcctctgacgctgtcgacaaattacgttttgaagccctgtccaagccggagttgctggaaggtggcgcggaactgaaaatccgtgtgagctacgacaaagacgccaagaccgtcaccctcgaagacaacggtatcggcatgagccgtgaagaggcggttacccatctgggtactatcgccaaatccggtactgcggatttcatgaagaacctctcgggcgaccagaaaaaagattcgcatctgatcggccagttcggcgtgggcttctactcggccttcatcgttgccgacaaggtcgaagtgttcagccgccgtgccgggctcgacgccagcgaaggcgtgcactgggcttccaagggtgagggtgagttcgaaatcgccaccattgataaggctgaccgcggtacccgcatcgtgctgcacctgaaatccggtgaagacgaattcgccgatggctggcgcctgcgcaacatcatcaagaaatactccgaccatatcgcattgccgatcgaattgcccaaggagcaaaccgctgccgaaggcgaagagcagccggccgaggaatgggaaaccgtcaaccgtgccagcgccctgtggacccgtccgcgtaccgaaatcaaggacgaggaataccaggagttctacaagcacatcggtcacgactacgaaaacccgctgagctggagccacaacaaggtcgaaggcaagctggaatacagctcgttgctctacgtgccggctcgtgctccgttcgacctgtaccagcgtgaagcgcccaaaggcctgaagctgtatgtgcagcgcgtgttcgtgatggaccaggccgaatccttcctgccgctgtacctgcgctttatcaaaggtgtggtcgactccaacgacttgtcgttgaacgtgtcgcgggaaatcctgcagaaagacccgatcatcgattccatgaagtcggcgctgaccaagcgtgtgctcgacatgctggaaaaactggcgaagaacgaacctgagcaatacaagagcttctggaagaacttcggccaagtgatgaaggaaggcccggcggaagactttgccaacaaggaaaaaatcgccggcttgctgcgttttgcttcgactcaaggcagcgatgcagagcaggtcgtgtcactggccgaatacctggcccgtgccaaggaaggtcaggacaagatctactacctgaccggcgagaagtatgaagccgtcaaggatagcccgcacctggaagtcttccgcaagaaaggcatcgaagtgctgctgctgaccgaccgtatcgatgagtggctgatgagctacctcaccgagttcgacggcaaatccttcgtcgacgtcgcccgtggtgacctggacctgggtaacctggactccgaggaagagaagaaagaagccgaggaagtcgccaagtccaaagagggcctggttgagcggatcaaggcgtccctgggggatgcggtcagtgaagtacgggtttcccatcgcctgaccgactctccggcgatcctggccatcggcgagcaggacctgggcatgcagatgcgccagatcctcgaggccagcggccagaaagtgccggactcgaagccgatcttcgaattcaacccggctcacccgctgatcgagaaactcgatggcgagcagagcgaagagcgttttggcgatctatcgcacattctcttcgaccaggccgccctggcagccggcgacagtctgaaagatccagccgcctatgtgcgccgtctgaacaagctgttggttgaactgtcggtttaatacccgcgtagaaaaacccgcttcggcgggttttttcgttttaccgcacctcaactggagaaaatgatgagccaagtcactgtacgttccgtggtctatcagattgatggtcagtcttatgaaagccgcctggcgttcgatgccagtcacaaggcccccctgccggggctgttgatggcgccgaactggatgggggtgagtgcgggcgccgaggagatcgccaagcgtgtcgccagcaaaggctacgtggtgctgattgccgacctctacgggcaaaccgtgcgtccgagcaatggcgatgaagccggcgcggcgatgatgccgctgaaaaatgaccgcccgctgctgaataagcgcatgcaagcggcctttgaacagctgcaaggtcagaccgaggcggccgtcgatacgtcgaagctggcgaccttcggtttctgcttcggcggttgctgctccctggagttggcgcgtactggggcgccgctcaaggcggcgatctcgttccacggcacccttgatacgccacgtccggcggatgcgaagaatatcaagggctcggtgctggtcttgcacggtgcttccgatccgttggtgcccaaagaacaactgccagcgttcgaagatgaaatgaacgcggcgggtgtggattggcagttgctgagctacggtggcgcggtgcattccttcaccgaccccgaggccaatgtgccgggcaagatgatgtacgacgccaagaccgctgcacgggcgttccagtcgatgcataacttgttggatgaagtgttcaagggctgattgcgcagccctatcggggcatggggatctacacattgtgtagctccccggtaaccacgatgcgcagcgagtcgctcttgatcttgctcttgctcttgatctggcttttgatcttaggcgccccgttaaaccacgctggccggaattcgacagggatttggggggtaaaccggcagggatgccggtttagccgccccgcgccatggatggcgcgtggcggcggccccccaaatccatggcggattacgggcacaccgagcctgggcgaggtgccgagtggtggggcaagagcgtttggttactttgcgcttttcaaagtgacccgctgtaaaagcggaaccaatattggccgttgcccaaataacggatatgtactcggtctgatccaacattctggtcggctgtcaggccgccatcgggggcaagccccctcccacacttgaactgtgaacagtcaaaaatgtgggaggggcggtgcgacgactcgacttgctcccgatgactatctaacaggcaactcaattctttctgattcacccggtaccgtcggccaatccccagccgcccaccgctgccgtgcctgctcgatcatcgccggatcgctcgccacgaaattccagttgatccgccgcggtccatccagcggcgcgccgccaaacaccatcacatggcaaccggtttccgcaaacagtgtcatctcttgccctgacggcaataccaccaggctatgcactgccagcggctcgccgtcgagctgcgcatcaccttccagcacatacaccgcgcgttgctcatgctcatcggggagcaataacgtggtagccgtctgcatccgcacctcggcatataacgtgggcgagagcacaggcaccggagacttgagacagaagccatcaccggcgatcagacgcacctgcacaccgagattatctctcaccggcaagctcgccgccgggtgatggctgtagtggccaggcccggtctcgtggtccttgggtgaggccagccacacttgcaggccatgcaggctgaaaccactggccttgagcatgtcgggtgtacgctcgacatgggcaatcgcgctgcccgcggtcatccaactgacatcgccggcctgcaccacttgatccgagccgaggctatccttgtgctgcaaggcgccttcaaacagataagtgagggtggacaggccgatatgcgggtgctggcggatattcatgcccgtgcctggtgcatagcgggtcggcagcatatggtcgaaaaacacaaagggcccgacgctgcggcattcacgggaaggcagtgggcgcaggatcggctggccttcgacatcttcggcgcgggggcggatcacggtgagggtggtcatggggcatccctgtctgagcgggttggatgcggctgagcataacccgctcgatgggaagttggcgctatgcgctgaaggcaccttccgataatttcgtctcgatgctgatttcggcggtggtcatcagcttgtgtaccgggcacttgtccgcgacgcgatgcaactcctcacgttgctcattgctcagcacacccttgagggtcaatttgacgctgagtttatatttgcctttttgctcttcggcggcgtcatgggtcacctcaacggtcacgccggtgagcgggatatctttcttctgcgcatagagtctgaccgtcaaggctttgcatgatgccagcgctgcatcgaaataatcgtggggagagggtgcggagtcgtcgccacccagactcttgggcaggtcagtaaacagctcgtggttgttgatattgacgctgtgacggaagttttcagcgttcagtgtattgacggtaacaggcatggcgaacctcacaagagggcaggatgaaggtcatgcagttatagagcatgctggcgctcgagtgttccagtttttccgcgttgaaccgggatgactggcgcaaggtctacccgtatcagcctgattgaggttttatcgtgctccgaacccgcttgagtctcgccttgttgctcgctgccagcagtcttgtcgtgcaggcccgtgactatgcctacagtgacgcgcacctgcattacgtggattttttccaggaaacggcaggcatggacaaactgctcaaggcgatggccgaaaaccgcatcgagcatgtgatgatttccggtatccccgtggccaagaaatggcatgaagacgagcccaagcgcccgcgctactacgccggtgatgacgccgatgcctattggtacagtgccaccgatgtgattgtcgcggcagcggtcaataagctggccgccgaacaacgccaacactttcatccgttcctggccggcttcaatcccaacgacaagaactccgcggcgcatatccagcgcatgctcgacctcaatccagggctatggcagggcatcggtgaagtgttcacccggcacgacgacctcaccgccttgacatccggcgacacgcctcgggccaataacgaggccatgacgcgcatctatcacctggctgccgaaaacgacctgccggtgatgctgcactccaacatcacctccaagcgcgagcgcaacccgctgtatctcgcggaggtcgaggagccgttgcgcaaccacccgcacacacgctttatctgggcccatgctggtaccagcaaggaaatccaccgccatcaggtgcagatggactttttactgcccaccttgaaccgcatgctcgaggcgtaccccaacctgtatatcgacctgtcctggagcatgctcaggccctacctgctggatgaggcaggtcagcctcggccggaatgggtgaagttggtggagcgcttcccggagcgctttatgctcggttccgacgtggtcgggcgcttcaataaactgggcaaggaaatgcgccgcttcgacccgtttctcgatgcgttgcccgaggacgtggcccgcaaggtggcgcggaataatttcctggcgatactgcccaagtcgcctcgcaatggcgtcacaccctgatactgcgttttttgccttgaccggtgcgaagcaggcgcctcggtttccgttcacccataaaaaagccccgaaccagtcggggctttttcaggtgactcagcctgcggggcttacttgccctgccagcgtttcagtaccagggtggcgttggtgccaccgaagccgaagctgttgctcatcacggtgtcgacttttacatcttcaacggtcttggtcaggatcggcatatcggcgacgactgggtcgatctcgtcgatgttggccgagccggccatgaagttgccttccatcatcagcaggcagtagatcgcttcgtgaacgccagcggcgcccagggagtgaccggacaggctcttggtggagctgattttcggagccttgtcgccgaataccgcacgtacgccttccatttccttggcatcaccgaccggagtcgaggtgccatgggtgttcaggtagtcgattggggtatccacggtggccatcgccatctgcatgcaccggatggcaccttcgccgcttggcgcaaccatgtcgtagccgtcggacgttgcgccgtagccaacgatttccgcatagatcttcgcgccacgggccagggcgtgttccagctcctcgaccaccaccatgccaccaccgccggcgatgacgaaaccgtcgcgcttggcgtcgtaggcacgggaggctttttccggagtttcgttgtactgggtggacagtgcgcccatggcgtcgaacaggaacgactggctccaatgttcttcttcaccaccgccggcgaatacgatgtcctgcttgcccagctggatctgctcaacggcagttccgatgcagtgggcgctggtagcgcacgcggaggagatcgagtagttcacgcccttgatctggaatggcgtggccaggcaggcggaaacggtgctgcccatggtccgcgtgacacggtaagggccaacgcgcttcacgcctttttcgcgcaggatgtccagcgcttccatctggttgagggtcgatgcgccgcctgagccggcgatcaggccggtgcgcacgttcgacacctggtcttcgctcaggccggaatcggcgatcgcgtctttcatggccaggtaggcgtaggcggcagcgtggccgacgaagcgatagatcttgcgatcgatcagctcttcgaggggcaggtcgatggagccggaaacctggctacgcagacccatttcggcatattccgggttgaagcggatgccagggcgacttgcacgcaggttagcggtgacggtctctttgtcattgcccaggcaagaaacgatgcccagaccagtgataacgacgcggcgcatgcggataacccttaaaagttgtcagtggaagtgaatacgccgacccgaaggccttcggcagtatagatctcgcgtccgtcgacagtcaccgaaccgtcggcgatggccaggttcagcttgcccttgaggacgcgcttgatttgaatgttgtaggtgactttcttggcgctcggcaggacctggccaaagaacttcacttcgcccgaacccagggcgcggccgcggcccggcaggccttgccagcccaggtagaagccgaccagttgccacatggcatcgaggcccaggcagcctggcatcacagggtcgccttcgaagtgacaggcgaagaaccagaggtccggggtgatatccagctcggcgaccaattcacctttgccgtacttgccaccctcttcgctgatatgggtgatgcgatccaccatcagcatgttcggggcgggcagttgcgcgttacctgggccgaacagctcaccgcgactgcagcgcagcaggtcttcccgagtaaaggcgttttgtttggtcatgcgagctcctcaataatcccatgcggcagggtagggtaaatcttcccgaaccgaatgaagcgttcatgcctcatagcggcagcctacacatagactattgcgttgtagtgaaagtcacagcggcaaggtactgaatgtacacttgttcactgaaattttaaaccgggcctgtttatcggcccgttcgggtgcctaagactgccgcactttcgtctttcacgccagtcagagttggctgatggcgcggcgctattgcacccagcgctgcaggatttcctgcaaatccgtgcgtttgaacggcttggccaggtaatcgttcattccggctgccaggcacgcttcgcggtcaccctgtaatgcgttggccgtcagggcgataatcggcagatcagcgcagccgggcagttggcgaatctgtcgagtggcttcgtagccgtcgatcaacggcaagcggcaatccatcaagatggcggtgaaaatcaggctctcggcgctgcggatcgcctcggcgccatcggtggccaggctgacttcaaaacccaggctgcgcaacatggcttcgaccactgtgcgattgaccgggttgtcttccaccagcaacacgtggcgtccgtcgccggcactggttttgccaacggcgtctggagcaatggcctgcacctggtgctggtcgatggccagcgggatttccagggtaaacaccgagccccggccttcttcgctccgggcccgcaaggtgccgcccatgcgctcggccagggtgcgcgcaattggcagtcccaggccggtgccgccgtaacgtcttgaaatggaactgtcggcctgctggaacgcatcgaacatcagctccaggcgttcggcagaaatgccaataccgctgtcgcgcaccgtgcaggtgaaccagaccagttcgtggtccagggtttgccaatggggctcgacggtcacgctgccatgttcggtaaatttcaacgcgttgccgatcaggttgaccagtacctgccggatacgtgtcgggtcgccccgcacttgcagggcttccatgcccgcgggaatcggcaactccagggtcagcccgcgctgctgggcgctgtgctggaaggcctgggcgcagctgttgatcaggtccgccaggttgaaggaaatatgttccagttccagtgcggcgcgctcaatgcgtgagaagtcgaggatgtcgttgataaccttgagcaagtgctcggtggactcggaagccagcgccgcgtactcggtctgttcttcggtcatctcggtggtttccagcagttgcagcatacccagcacaccgttcatgggcgtgcgcagttcgtggctcatcatcgccaggaattccgatttggcgttgttcgcacgctcggcttcctcgcgggtctggatcaactgggcgatggcttgttgctgttcgcgactggcttggttgaggccctcggccaggttgttgatatgccgcgacaggtcgcccagctccgagtcatcgacaatcggcagtggggtcttgtagtcgccctgctggatcgccttgaccgcgttgcccatggcgctgatcggctgcgacaggctcgccgccaggcgacgcgccagcaggaaagtgaacagcagggcgaacagtgccaggaccccggccttgaacaggatctgttgctggcgctggctgaacgcgtcgttggacatgccgacgatcacccgacccaggtaatctgcgcggggtgccatggggccctttaggttgtccaggaggaagtcattgcccagctcgatatgttgcaggcggatcggcgcctggaacactttcaccgacagtgagcggtcatgcttctccgatggttgctcgacatacaccaggatgttttcggcgctgtcctgaatctccaggaagcgtacgtggggcgtggccaaggtcgcgcgcagcagggattcgagcacatcgttgttgccggaaatcaccccgtactcggtggcgggcgccagttgattggcgatcagttggccggtgtgatccagttcctggcgcaaatcctggatccgcacgaaggtaaagaaactgattaacagcagggtcagcaacagcgcggggcccagggtaatgagctgggtgcgggtgttgatatcccaacgacgacgcaaggtcatgggcgtttttctccttcggccaagcgggcggcgacggcggcttcatcgacctgttcgatgcccagtgagcgcgcgacttgcgggttgcccacgactttgaagtgttccgggtacaaggtctgcggccaattggccggagcgtggtccagcaggcggtccagcacggcgagccagtcgggctggtcactgtaggtgctggccaggctgccggccctgacaaacccggcattggggcccaccagcggcagttgttgggcgtagctgctcaacaacaggttctttgcggttttggggttgtacaattgcgggtcgtcgaggccgagtagcacgtcgctgttcttgaacagggtttgcagcgcacggctgtcattggtgttgttccaccgttgcggcacgatttccaggcccatgggtttggcgaactgcatcagttcgcgaagcaggaactcgctgtcggcaccgtaaagcacgccgatgcggcgggcctggggcaggatgctggcgatcaggtgcaactgacgttccagcggcgggtcactccacagcaggctgatcttcgccggatgcgtgttgcccatgcgttgccgggcctgcaggcggctgattcgcagcaccagggtcggcgggccttgagcgtcctgcagacgccaatccaggccgggcaggtcgaggaggatcaagcgggtgctgacgggcaaacggctcggcgctggcaagtccttgagcggggtgaaggtgatctggtcttcggggcgctgttgcgcaagggcctgggtaaaggcttgtacgccggcactgtcttggactgctgtcagcaggatgtcggcgctccacgccggggtcgccagcagcagggctgccagcagcacgccgcggcaccagcgcagtggagtccagaagagggtcatccgtgactgatcgcccatgtcagaagtccagctccgcgctgaagtagaggacgtgacgatgatcgtagttattgtcggcccaggtggtgggctggttatcaaggcgttgttgcagcatgccggccagttccacattggtcttggccactgcaatgcgcttggccacccgcaggtcgacccgttggaagcgatattgattgagtgcgtcgtcgccataatagaacactgcgctggaccaaccctggccccattcacgcaaccatccggccgaaccgctgttgcgggcggtttgcgccttgtccaacgggttgctggaggaagcgtcgacataagcataggtcaggcgcaggcggtcggcgttgctcacgcgccagtccaactgtgattctgccccggtaaaacgcgagctgttggcgttgctggcgatgtattggttgttgcgcagtggcgagctgatcatgtcggtgatttcgtcatagaacagcttcacgtcgacatttagccccaggtcggcaaagaaaccgttgtagcccagctctcgtgagcgcatcaattctttgtcgaggttgccggggccgcgagtcacgacaaaatattgcccggaatcttgcccataggccggggagctgagattggtgacgaggtagctccagttgacgttgttctcgaacatgtccggcgagcggaccgcctcggagtaaaccgcccgcaagccatggcgcgggttgatcaggtaattgaccgccactcgcggcgtcagggagttgccgctcaggtgggtgtcttcgtacatggcgccgccttgcagcagccagtgttcgctgggccgccattccagctggccgaacaggcgccaggtggtgtcgtccagtgtgccgttgaagtaggtgtccgagtcggcgcggtcatagcggtaattgaaaccgctgagcaggcgcaggctgtcggacaggctgagggtgtcttgcagttccaggtcgtagcggctttcccgggtactttggtcgatatcgccgcagacagggtccttgccaccctggtgtttccactgatcgagcacttgattggccagagcctgttcagcggcgccgccgggtggggcggagccttggctgtaggtctccatgttgcgagccagccgttcggcgtaattggggttgagctgccataactgggtcagctgcgggctgaatgagaccttggcgtcacaggctttccagatttgccggcgatcccactgctgcgccgatccctggatgtagaggctgtggtcggggttgaaatcgaagttccagcgcaatgagcctgcgtagtccttggcggtaatgtcggagttgttgccgccttcagtaatgccatcaaataccggcgtgtaggtataaggacgctggttggtgccttccttgacgctcagctgccagccgaggctctgttgcgcgttcagggtctggcttaccgccaggctgaaacggttgagacgccgtccatcacggcggtcggcgccgacggcattactgtcaaagccatcgtcctgttgcccggacagggacaggcgcaaatcgccggtctcccagcccacaccctggctggcatagaagtcgttgatcccgcgttcaccgcgggtgaccttcatgcgcgaaccctggctgttggccggcgagcgggtgaggatattcaccactgccatcagcgcattggcgccatagctgacggtgttggggccgcgaaatacctcgatgcgctcgatatcctccatggctaccgggatatcgctccagtccaccgtggccaggccggcgcgatacaccgagcgaccgtcgatcaacacctgcatgcgccgtgcatcactggcgctggtgccgtggtagttcaccgacgcctggttgccggtggtgtagccgaccatcatcccgggcaccagccgcagcagttccgaaatgtcccgggcgccgctggccttgatcagctcgctgtcgatcaccgtcatgctgccgggcacggcggcggccgattgcttgaggcgcgtggcggtcaagacctgcggcagcggttggccgtcgagaaacagatcgtcagccagtgcaggcaggctgcacaagagcatcaacaatagagatgagcgaggaggagggcccagatacacggcacggccttgttaatgacggatagccgcccatgttaactgaggcgggactatttgccagtcgtcggatttgcaattacctagcacaggcgtggcattttccgacaggcgtgcgaattgatacgggggctggccgcaagcggggcgccccgtataatgccgccatcgccactggtatggattaacggattgcatatgacagaacagcgccctatcgcggtcctgggaggcggaagttttggtaccgccgtggctaacctgctggccgagaacggccagacggtgcgtcagtggatgcgcgaccccgagcaggccgaagcgattcgcgtgcatcgtgaaaacccccgttaccttaaaggcatcaagattcatccggcggtcgagccggtcaccgatctgctggacaccctcacggcctgcgacctgtgctttgtcgcgctgccctccagcgctttgcgctcggtgctggccccccatgccgaacgcctggcaggcaagctgctggtcagcctgaccaagggtatcgaggcccataccttcaagctgatgagtgaaatcctcacggagatcgcgcctcaggcgcgcattggcgtgctgtccgggccgaacctggcgcgggaagtcgccgagcacgccctgacggccacggtggtcgccagcgaagacgaagccttgtgcgagcgtgtgcaggcggtgttgcatggccgtactttccgggtctatgccagtgccgaccgttttggcgtcgaattgggcggcgcgctgaaaaacgtctacgcgatcattgccggcatggccgtagccctgggcatgggggaaaacaccaagagcatgttgatcacccgcgccctggccgagatgacccgctttgcggtgaaccagggcgccaacccgatgacgttcttaggcctggcaggcgtgggcgacttgatcgtcacctgctcatcgcccaagagccgtaactatcaggtcgggtttgccctgggccagggcctgagcctggaggaggcggtgacgcgcctgggcgaagtggccgaaggggtcaacaccctcaaggtactcaaagccaaagcccaggaagtcggcgtgtatatgccgctggtcgccgggctgcacgcgatcctgttcgaagggcgcaccttggaccaggtcatcgagctgttaatgcgggccgagcccaagaccgatgtcgactttatttccaccagtggtttcaactgaggaacgcatcatgaacgatccgaaagccgcccccaaatacgagtcgattgccttgcgcgtcctgtggatgctggtattcgcgctggtgtggcaggtggcgcaattgctgctcggcgcgctggtggtggtgcagctggtttaccgtcttatctacggcgcacctaacctgggcctgatgaactttggtgacagcctcagccagttcctcgcgcagatcggtcgcttcggcagcttccacaccgagcaaaagccctggccgttcgccgattggccagccccgcgtgccccggaaggcgaagccgctcacagcgtgccaccggctccgcaccccgtgcgtgatgaagagccaaaactatgaagttgtggattctgcgccacggtgaggcccaagggcatgcccgtaccgacgccgaacgcaacctcaccgagcatgggcgcgccgaagtattgcgcagcgcggcgcacctgattggccagcccctcagcgccatcattgccagcccctatgtgcgggcgcagcagacggcgcaattggtgcaggaagcgttggggttcaagccgcaaatccgaacggtgccgtggctgacgcccgacggtaacccgcagcaggtgctggaaaaactcgacaccgacgacaacgtgctgctggttagccaccaacctctggtgggtagcctgatcagctttctgctgcacgggcatcagcgccagccgcagccgatgtacacggccagcctcgcagagcttgagggggactttccgctggccggcttgatgagcctggtcgatgtgaagaatccgtagataggtattcacacagcgttggtgcgacgctggacctgtggcctgacgacgatctaaatgtgggagggggctacaccccgatggcggtgagccagctccagatgaatttgctgacactccctcatcgggagcaagccccctcccacattggatcctcgctgtcttgagcatttcgttcgcttgactgaccggggccgcgccaaaatcatgtagacacctatgcctcgatagcggccttatagcctattgctctagcaggccgttgcctttgtatgtgctatacagtcaaccaagcaagtgcttggttgactgtttggcggatcactaaggagcgcgtcccatgcctgtcgcttttcgtttgccgttgcaggttttcttcgagcgtgaagcgcggcacccgcgcaaggttttcctggtgcagccccttgatggcggcgaggtgcagaccctgacctggggcgatgtcggccaccaggcccggtgcgccgcccattggctgcgtggccgggagttgccccagggctcgcacatcgccctgatctcaaaaaactgtgcgcactggatcatcgccgacctggccatctggatggccgggcatgtctcggtgccgctctatcccaacctgaccgccgactccgtagcccacgtgctgacccattccgaggcagcgctggcgttgatcggcaagctggatgattggccggcaatggcgccgggtattccagcgggtgtgccaaccatcagcctgccgctgtgcccggcggggacgttcgatttcagctgggtggacctgcaagcctgctcaccgatccaggacaaccccgaacctcttgcctcgacactggccaccattgtctatacctccgggacgaccgggctgcccaaaggcgtgatgcacacgttcggtgccctgggctttgccgctacccgcggcaccgagttgtttggcctgggggagggtgaccggctgctgtcctacctgccgctgtgtcatgtggccgaacgcatgtttgtggaaatggcctcgatctacaccgggcaaaccgtattttttgcgcaaagcctggagaccttcctgaccgatttgcgcagggcacgaccgacggccttgtttggcgtgccgcgtatctggaccaaattccaactgggggtctacgccaagctcccggaaaagcgcctcgagaccctgttgcgcctgccgttcatcggcaagcgtgtcggccataaagtgctggcgggcctggggctggatgcgctgcgcattgccctgtccggcgcggcaccggtgcccgaggcgctgttgcgctggtatcagcgcctgggcctggatgtgctggaggtgtatggcatgagcgaaaactgcggctactcccatgtgtgtaccccgggtacgcaaaggcttggctggatcggcctgccatgccctggcgtggaagtgcgcatcgacctctcgggcgaggtgcaggtgcgtagcggcgcgaccatgctgggctatttcaaggacccgcagaaaaccgctgaaacgctcaccgaggacggcttcctgcgtaccggcgacaagggcgagcaggacgctgacggtcgcctgcgcctgaccgggcgcctcaaggagatcttcaagaccagcaaaggcaaatacgtagccccggcaccgattgaaaatcgcctggccgaacatgcgcgcatcgaacaggtctgtgtggttggggaggggctcggcgcaccgatagggctttgcgtgttgtcggcgccgcatgaggaccgtcgaacccttggcgccggtctcgagcactggctggaacaggtcaatgctgccctggataaacatgagcgcctgcgccagctggtggtggtgaaagacagttgggcggtggaaaacggcttcctgaccccgaccttgaagatcaagcgcaacgtgatcgagtcgacgtacgggccacaattgcaggcatggagcgcgcgcaccgaaaccgttctgtggcaggattaggaacgtaataaaatcaacaaggacaaccccatgagcctgtggcgcacccaaccgaatattgaacaactcaatgcgatgcagaaaaacaccatcggcgagttgctggatattcgtttcgaaagcttcgacgacgaatccctcaccgccagcatggtggtcgatcaccgcacccatcagccttacgggctgttgcacggcggcgcctcggtggtgctggccgagagtgtcggctccatggcggcctacctgtgcatcgacgcgagcaagttctattgcgtgggcctggaggtcaatgccaaccacctgcgtggcgtgcgtagcgggcgggtgacggcggtggccaaggctattcatatcgggcgcacgacccaggtttgggacatccgcctgagcagcgacgacggcaaggccagctgtatctcgcggctgaccatggccgtggtgccgctgggcgaaaaaccaccggcgcgataggcgtggcgtgagtgtcatcattcctggcagttacagtcattgccgcaggacgccggcatggtgacaatccacctctgttttcgtcgatggaacctgtatgccgcagcacgtgttttttacccacgccaatggcttcccatcggccacttacggcaagctgtttgccgccctggccccggaatatgcggtggcgcacctgccgcagcacggtcacgaccccaggttcccggtggacgataactggcagaacctggtggatgagttgatccaccatctgcaacagcagccggagccggtgtggggcgtgggccattccctcgggggcgtgctgcacttgcacgcagccatgcgttgcccgcagttgtaccggggcgtggtaatgctggattcgccggtgctgacccgggcagaccgctgggtgatccgtgccgccaagcgttttggcttcatcgaccgcctgacgccggctgggcgcaccctcggtcgccgtgaagagttcaccgaccttgaagccgcacgcagctattttgccggcaagaccctgtttcgtggctttgatcccgattgttttgacgcgtacctgcaacatggcctgcagcaagtgggcgaccgcctgcgcctgcgtttcgatccggccaccgaaatcagcatctatcgcggcgtaccccacaccagcccgggccaggtgcgccaattgaaggtgccgctggcggtggtgcgtgggcgccagagccgtgtggtgatgcgccaccatgccagcggcgtcgaccgcctgcccatgggcgaaatgctcaccatgccgggcggccatatgttccccctggaacgcccccaggacaccgccaccttgatcaagaacctgttcgcccgctggcaagcccgcgagcgcagttgcgcatgagcacacctgtcgaagaagttcgcctgagcctgccgcacatcgagttggcggctcatctgttcggccccgaggatggcctgccggtgatcgccctgcatggctggctggacaacgccaatagctttgcgcgcctggcgccgaagctgcacggcttgcgtattgtcgcgctggacctggcggggcacgggcactcggaccatcgtccggcaggggccggttatgccttgtgggattatgtctatgacgtgctgcaggtcgccgagcaattgggctggcaacgttttgcattacttggccattccctgggtgccatcgtttccctggtgttagctggggccttgccggagcgtgtgacgcacttgggtttgatcgatggggtgatccctccgaccgccagcgccgagaacgcggccgaacgcctgggcatggccttgcaggcgcaaatgagcctgcaagacaagcgtaagcctgtctacggcacgctcgatcgagcggttgaggcgcggatgaagggcgtggtggcggtcagtcgtgaagccgcggaactgctggcccagcgcggcctgatgccagtgccgggcggttacacctggcgcagcgacagccgcctgaccctggcatcgccgacgcgcctgaccgatgagcaggccatggctttcgtaaggcgcgtaggttgccctacgcagttggtggtcgcggctgacggcatgctggcgaaacattccgaattgctttcccagctacccttcaccgttgccacgctgccaggcggccatcatttacacctgaatgacgagtccggcgctgctcttgttgcagactgtttcaatcggttcttctccacgccttgacttggcggggtcaactgccgaggctgggcggattgaaagggagtcaaccatgtacacactcaatatcgctgtgacctccattggccaggactcattgatccgatgagcctgggtaaaggatgtctccgtgcccttggcctttgctgtttcagccccctggtgttcgccgctgacgtgtcgggcagccaggatctgcctgccgtggcccgccaggttgacgcgcagatcgtcgattatcgccccgccgaagaaaaggaacgcatctaccccatgggcgcgatccgcaagatcagcggccagttgcgctacgagggccaggccaccgcgcgtggccaagccactgcaatcacctatgaattgcccgccgagcacagctccagcgcggcctttaccgcaacgcgcgaagcattacaggccaagggcgcgcagttgttgttctggtgccaggcccgcgattgtggcgaaagcagcctctgggccaatgaagtgttcggcaacgccaagctggtgggggccgacggccagcaggagtacttgctgctgcgcctggccgctccgcaggacaattccctgatcgcgctgtacggcatcacccgcggtaaccgtcgcgcttacctgcatgtcgagcaactcgacgccagcgcgcctttgggtaatctgctgccgacctccgccaccctgttgcgtgaactgaaaagcaccggcgagctggactttccggcgctgggtgccgaacctgacaccacgtggctgaccttgatttcccgcggcctgaacctcgacaccaccttgcgcatcagcctgaccgggcccaccgccgaaacctggcgccagggcctgatcgatgccggcgtgcgcgccgcacgtctggaaaccggcaccggtgacgctaaaggattgcacctgcatctgatacgctgaccgtcatcaggcgaacggacccgcgccgttcgcctaagctctcttccaatagccttagtctcgagatacccgatgctcaataacgatcgcctgctggtgcaaatcctgctgctggtgctgttcggtgccagcttctgggtcatggcgccgttctggtcggcgctgttctggggggcggtgctggcatttgccagttggccgctgatgcgtttgctcacgcgctggctgggtggccgggagtccctggccgccggcatcctgaccctgggctggatgttgctggtggcagtgccgctggtatggctggggttcaacctcgccgaccacgtgcgcgatgcagtggcgctgatcaaggatatccaggtcgacggcttgcccgaggcgccgtcctggctgggttcgattccgttggtcggcgagcgcctggcgggaatgtgggacagcatcgatcaacaaggcgcggcgctgatggtcagcatcaagccgtacctcggccaggtcggcaactggttgctggcgcgcagtgcgcaaattggcggcggcatcctcgagctgaccctgagcctggtcttcgtgttctttttctatcgtgacgggccgcgcctggcgatgtttgtgcaccgcctgctggagcgcctgatcggcgagcgcgccggctattacatcgaactggtggccggcactgtgcaacgggtggtcaacggtgtgatcggtaccgcagcggcccaggccctgctggcgctgatcggcttcctgatcgctggcgtgcccggtgcgctggtgctgggtattgtcaccttcctgctcagcctgatccccatgggcccgccgctggtgtggatcccggccacggcctggctggcgtggaagggcgactacacctatgccgtgttcctgggtgtatggggcacgttcgtgatcagtggcgtggataacgtgctaaagccgtacctgatcagccgtggcggcaacctgccgctggtgattgtgctgctgggcgtgtttggcggcttgatagcgttcggctttatcggcctgtttatcggcccgaccttactggcggtggcctacagcctgctgacagattggagcgccactcaggcgcaagtccgccgcgaagacaaaccctgtaactgaggcgttcaggcgcggggcagccacatgacggcggtcaacccgccaccaggtgtttcttccaggctcaagcggccgcccaagcgctccgccgcttccttggaaatcgtcatgcccaggccgacgccgccggagttgcggttgcgtgacccttcgagtcggtaaaacggctcgaacaccgcttcacgcttgtcggctgcaatgcccgggccatggtcgatcacgcgaatgaccagcgcgtcgctcctgtccgtcagttcgatatatgccgtgccggcatagcgcagggcattgtcgatcaggttgttgaggcatgagcgcaaggccatcggctgtacttgcaacggtgcacaggtaccggaaaattgcacatcgctgccttggtcctgggcgttttcgctgagggactccaccagcgcctgcacatcaagccagtgccgtgtctcgctggtgcgttgttcgtgcaggtagctcagggtggcatcgagcatgccgatcatgtcgtccaggtcctggcgcatctggccttgcagttgggtgtcctcgatctgttccaggcgcagcttgaggcgcgacagcggggtgcgcaggtcgtgggagaccgcaccgagcatgcgcgcacgctggctgacttgctcgcggatacgcttttgcatgaggttgaaggtcgacgctgcctgccgtgcttcgcgcgggccggactccaccaggggcgggctgtcgaggtcgatgctcaagcgctcggccgccgcgctcaggcgctggatcggccgactcagcagcttggcaccgtaccaggcggcgatgatcaacgagataaattgaaacgtcagcggtaccaacggcccaccaaaccaagggcgaggttccttgcgcagtggcttgagggtgccgtccggttgttcgacgaacacctcgggaggcgggggaggcggccggccgtagtggtggaaccagaagatcgccagcacgtgggccagcacaatagccaccagcaataggccgaacaatcgcccgaacagcgtattgagggtggcacgcatcaaccgatatcccgggcgtcgaacaggtagccttcgccgcgtacggtcttgatcagttgtggcgccttgggatcatctcccagcttctggcgcaagcgcgacaccagcaagtcgatgctacgatcaaaggcttcgatggagcggccacgggcggcatccagcaattgttcgcgactcagcacacggcgcgggcgttcgatgaagacccacagcaagcgaaactcggcgttggacagcggcaccaccaggccgtcatcggccaccaattggcgcagcacactgttgaggcgccaattgtcgaagcggatgttggtgcgttgctcgctgcggtcatcgcgcacccggcgcaggatggtctggatacgcgcgaccagctcccggggctcgaacggtttggacatgtagtcatcggcacccagttccaggccgatgatgcggtcggtgggttcgcaacgggcggtgagcatcaggatcggaatgtccgactcagcgcgtaaccagcggcacagcgacagcccgtcctcgcccggcagcatcaggtcgagcaccaccacatcgaaggtttcggcttgcatggcttggcgcatggcggtgccgtcggtgacacccgaggcgaggatattgaagcgcgccaggtagtcgatcagcagttcgcggatcggcacgtcgtcgtcgacaatcagcgcacgggtattccagcgcttgtcttcggcgataaccgcgtcttttggctcttcggttacgggggcggagggggtatgcatagtgcgatcatctgcctgggttgttgcggtcagcataggcgcccggttccaagcctggaagtaccgggcgggcggtcacgtgcgcgaggctaggcccacggcgtgttgagggcgtgtcgagtctgtaccagctttgaaacaattgcccgaaatggcgtctctcgggcgtttgatcagtatttaccgatcatcggatcccgcaaccgcgctgcttgcgctacaatccgcgccgatttcgacttgcctgagagcccattccaatgtccgtctgccagactcctatcatcgtcgccctggattaccccacccgtgacgccgcactgaagctggctgaccagttggaccctaagctttgccgggtcaaggtcggtaaggaactgttcaccagttgcgcggcggaaatcgtcggtaccctgcgtgacaaaggcttcgaagtattcctcgacctgaaattccacgacattcccaacacgacggcgatggcggtgaaagctgcggccgagatgggcgtgtggatggtcaatgtgcactgctccggtggcctgcgcatgatgagtgcgtgccgcgaagtgctggaacagcgcagcggcccgaaaccgctgctgatcggcgtaaccgtgctgaccagcatggagcgcgaggacctggccggcatcggcctggatatcgagccccaggagcaggtcttgcgcctggcggccctggcgcagaaagccggcctggatggcctggtgtgctcggccctggaggcccaggccctgaaaaatgctcacccgtcgttacaactggtgacgccgggtattcgcccggccggcagtgcccaggatgaccagcgccgtatcctgaccccgcgccaggcgttggatgcgggctccgattacctggtgatcggccgcccgatcagccaggcggcggatcctgccaaggcgttggccgcagtggttgccgaaatcgcctgatactcaagttagcgcggtaaaaaatgtgggagggggcttgcccccgatgaccatgggtatctacacaactgtgtagcaaccgacggtaaccatgatgcgtagcgagtcgcttctgatcttgcttttgatcgtaggcgccccgtcaaaccacgctggccggaattcgacagggatttggggggtaaaccggcagggatgccggtttagccgccccgcgccatggatggcgcgtggcggcggccccccaaatgcatgtcggattacgggcacaccgagcctaagcgaggtgccgagtggtggggcaagagcgtttggttactttgcgcttttcaaagtgacccgctgtaaaagcggaaccctaagtggccgttgcccaaataacggatatgtactcggtctgatccaacattctggtcggctgtcaggccgccatcgggagcaagccccctcccacatttggatcgtagagtatcagttagatagcggtcggccatcaggctccagggagagcaagcttatttcccaggggcaaatcccctcccacatttcgatctgcagtgtgtcagctgacttttagaaccaacttgccaaagttctcgccgttgaacagcttcatcagcgtttccgggaatgtctccagcccttcgacaatatcttccttgctcttgagcttgccctgggccatccaaccggccatttcctgcccggccgccgggaagtttgccgcatgatccatcaccacgaagccttccatgcgcgcgcgattgaccagcaatgacaaatagttggccgggcctttgacggcttccttgttgttgtactggctgattgcaccgcaaatcactacgcgggctttcagcgccaggcggctgagcacggcgtcgagaatgtcgccgccgacgttatcgaaatacacgtccacccctttggggcactcgcgcttgagagccgcgggcacgtcttcgcttttgtagtcgatggcggcatcaaagcccagttcatccaccaggaacttgcacttgtcggcgccaccggcaatccccaccacgtggcaacctttgatcttggcgatctgcccggcgatgctgcccacggcgcctgcggcgccggagatcaccacggtgtcgccggctttcggcgcaccggtctccagcaaagcgaagtaagctgtcatgccggtcatgcccagggcagacaggtagcggggcaggggcgcaagcttggggtcaaccttatagaagccacgaggttcgccgaggaaataatcctgcacgccgacggcgccgttcacgtagtcacccacggcaaatttcggattgttggaggcgatcactttgccgacgcccagggcgcgcattacttcaccgatgccaaccggtggaatgtaggacttgccctcattcatccagccacgcatcgccgggtcgagggacaggtattcattgcgcaccagcacctggccatcggcgggcgtgcccaccggcacttcctggtaggtgaaggtttcccgcgtggccgcgccgaccgggcgtttggcgagaagaaattggcggttggtctgggcggtcatggcaaggactctttagaaatgaatcatgagtgatagaccttcagtgcctggagggcaaggttgtccgtggaagacgaatgcccgtcgataggcctcactgataatcagccgggtgacgttatcactgcgatccatgcagcgccaaccggccttctgatagtgctgacgcgctgctcccggtgttggctagactcgctccatcgctacttctcccataggacgcttcccatgagcatgacgttttccggccaggtcgccctggtgaccggcgccgccgctggtattggccgtgccaccgcgctggcgtttgccgccgaaagcttgaaggtggtggtcgccgaccttgatgtggcgggcggcgagggcacggtagcgctgattagagaggccggtggcgaagcgctttttgtgcggtgcgatgtcacgcttgaagccgacgtgcagcaactgatggcgcagaccgtcgccacctacgggaggctcgactacgcttttaacaacgctgggatcgagatcgagaagggcaagctggccgatggcagtctggacgagttcgacgccatcatgggggttaacgtcaagggcgtatggttgtgcatgaagtatcagttgccgctgctgctggcccagggctgcggggcaatcgtcaacacggcgtcagtagcggggttgggggcggcgccgaagatgagcatctatgccgcgtccaagcatgcggtgatcggcctgaccaagtcggcggccattgagtacgcgaaaaagaacatccgcgtcaacgcggtttgcccggcagtcattgataccgacatgtttcgccgtgcctacgaggctgacccgcgcaaagccgaatttgctgcggcgatgcacccggtcggccgcattggcaaggtcgaggaaatcgccagcgcggtgttgtacttgtgcagtgacggtgcggcgtttaccaccggccaggccctggcggtggatggtggtgccacggcgatctaggacttcatctcatggactcttagaaagtgagtgggctgctgtgaggggtttccagagctggcaaagtgccgtgtcctaatatgtatcggaaggtaaataatccaataaaatcaatactttaatataggttttcgacggggttgaacgggcttctgtgcttaactgttttaggtttacagacagttgaagtgagtggctcatggatttagggatcgatcgacaagcccaggtaccggtggttcagcaaatcgtcagcgcagtggcagaatggattcgcaagaatggggtgagccccggaacacgcttgccgtccattcggcaattggccctcgacaacctgttgagccagtccagcgtgatggaggcattcgaacggttggtgtcccagggcctgctggcctcgcggcacggttcggggtatgtggtggcgcaaccgccggcagccgacgaaaaccactggtacgaaggtgcggaacaggtctggggcgcctttaccgatagccccttgggcgagctgaaactggggtgcggctggttgcccgacgcttggcgtgaaagcgacgacatcagctatgtgatccgcgaggtcagtcgtaccgacacagctggcctgttcagctacagcacgccgttggggctgccggcgctgcgcgagcaactgctcaagcgcctgactcagatccatgtgcccaccagcctggaccgtatcctcaccacccatggcgccagtcatgcccaggatctgctgatacgcacgctgctcaaggctggtgatgaggtggtggtcgagacgccgggatacggcaacctctatcgtcaattggactttcagggtgtcaggctactggaggtgccacgtaccaaaggcggcccggatatcacagcgttggaagtgctgctgcaaacccatcgccccaagtgcctgttcatcagcagcctgtaccacaaccccaccggcaccagtctgtgccgccgggtcgcggagcgtttgctggaactggcccgggatcacgacttcctgatcatcgaggaggacgtctacggcgacctgcaacatgccagctgcacgcgcttgtcggcgttgccccacggcgaccgggtgatctatatctcgagtttttccaagaccctgagcagcgccttgcgcgtgggctacctctgtgccagtgccacaatcattacccaattgacccatctcaagaccctgacgggaatcggcacctcacgctttgccgaagccatggtggcgacgttgttgagcaacggcacctaccgcaagtgggtgcagcgcctgcgcaggcggctgaacgcgcaaatggccgcgaccttgcaagtgttggaagatgaggagtggcaagtcttttccgtgcccgctggcggtatgttcctgtgggcgcgacctggcttggctgacccctcacgcttgcaggcgtgcgcccgacgcctgggggtgttgctgtcgccgggagggttgttcagcccgacgggtgagcgcagcgagtggctgcgcatcaatgtggcctatgcggctgatcagcgggcattggcattgttccgtgccatgggcgcaaccagatcgacctcgaccattctgaaaacgacgagcatgtagctttttgccattattccggcgccagccgcttgtgctcagtacccatgggttgccaatctcactgcttgtaaacctggcttatggcatctgccatcgcaagaggattcaaggcaatgatttcgggcgtgcaacgacgtttcgccaaccttggtatggcaaaaaaactgggcttgggcttcaccttggtactcctgctcacggcgctggtggcggcgataggcgtgtggtcgctgcaaaccgtcggccagcgttttgacgggctcacgagcatgtcttcgctcaacagcggcttgctcaaggtgcgcttgatcgagcaggactacgcactgcacgccgactccaaggccgttgacgacctgcatgccggtgtcgaggcgctggcggcgcaggccgccagtctcaaggcccggtctgtggccaacgagcaagtgatgagtgacgttgagcaagccttggcggcgtaccgcaaggcgttcgatgagttcgtcgaactgaatcagaccaaggacttggcgctggaaatggccagttggtcagtgtccagcgtggcgaacaacctggatgtgttgcaagccggcctggcggacgacggtgcttatggcctcaaggaaagccaaggcaaagagggggccgaatttatcgagcaggcggggcaggtcagccaggtatcgcgcttgatgctgcaagccatggacgaggcgcgggtgcgcctggaccagagccgcaaggctgacgccgatgccgctgagcagggcaaaatcgagcaggccgaccaggcgctggctgaagtcgagaagctcaagagcagcgtcaaggaccccggctaccagaccgtcctcaacgaagtctccgggcacatcgcgtcattcagtgaaaaactcggcgagtacaccgggctgctggcccaggagaaagtcgtctatacgcaactgcacgaccgcgctgagcacgtggtcagtcgcgtcaaccaggcgtatgccgccgaagaccagtccatgcaggcacagttgcaacacagcgcgatgctgatcatcggctcatccgccctggctttgctggtgggcttaatcgctgcatgggtgataacccggttgatcgtggcgccgctgcgcagcgtgatcgccgtggcccaacagattgccgcgggtgacctgagtgggcgcatggaggtcagccgccgtgatgaaatcggccaattgatgcaggcgatgcagcagatgggcagtggtttgagccagatcgtgcgtgggttgcaggccggtatcgaacaactcgccagttccgcgcattcgttgtccagtgtcaccgagcagaccaaccttgaggtcagcagccaaaaggaagaaaccgagcaggtcgccacctcgatgaatcagatgaccgccaccgtgcatgatgtggcgcgcaacgccgagcaggccgcccaagcggcgcagacggcggatgacaaggtcgacagcggccagcaggtggtacgtatgagtttgcagcgtattgaattactggcggcgtcgagcagcagcgccagcgccagcatcgagggcctcagtgcagagatccagaatatcggcactgtattgagcgtcatcaacagcgtggctgaacagaccaacctgctggccttgaacgccgccattgaagcggcgcgtgccggtgaacagggccgtggctttgccgtagtggccgatgaggtacgggcactggccaagcgcacccagcaatcgaccgaggaaatcgagcgcctggtcaacaccttgcgcagtgcggcacaggcgtcggtgcagcagatccagcacagtggcgaactggtgaagcaggcggtcggtgatgccctggaaactgaaagcgccttgggtagcattgccgctgccgtgtcactgatccagcagatgaatcaacagatcgcggccgccgccgaggagcaaagctcggtggccgaagagattaaccgcagcgtcacctgtatccgagccagtgccgaccactcggcgttgagcatgcaaggcaacgccgcatcgagcctccagctggcgcagttgggggtagagctcaagggcatggtggggcatttccgcctttgatcgcagcgacggcgctgcgatcaataggcagggcgatcaggcgtgattggcgaggaaggtcagcagggcttcattgacgaattcggggttctcgcgactggaaatatgcccggcctcggggatcaggatcaggtcgcagccaatcagttcggccatttcctctgactctgcgggcggccggggtttgtcctgctcgccgcacatcaccagggtggtgtcggaatccaggcgtggtagttgcgccaggatgtcttcgcgactaaagatcaagcggcccaggggcacgatgctttccagcagttgctccctggaatagctttgcagggattttcgaaaatcccggtacagcgccgattcgcggtcgatgcccgggcggaagaagatcggtgcgatcacatccagcaacggttcagggatctcgccagcgtcttcaatcatattgaacagcgagaaatagtactggcgtgttgcttcgggttcggcgccgaggtaggtgtccatcagcaccacgctgttgacacgctcgggagcctgcaatgccaggcgtgcgccccacatgccgccgaccgacaggcccaccaggttgatctgctcgatgcccagatgctcgagcagcgccagggcctggcgggccaggccatccagggacttggtttgcgtcggcagcgtgcccgactcgccatggccccacagctcggggacgatcacccggtattgctgcgacagcgcttcaatctgcggcgcccacatgtcgctggcccacaggtagcttgaacctaacaggacgaccgggccggtgccctggtcaagataatgcagcggttgtccatcaatcacggcaacaggcataacaggcctctaacttcacggagtgaggggcacttttttacgctagttgtgggtggggggataggtgcaaagtgatggcctgtgaggtgagggcgctatccagctgatgccccgcaatccagatatgggagggtgcttggccccccctcccacatttggatcgtcttacaccaggtaaatcgcccatgctgcacgttattacctgggctatcagtcgtagatagctttcttcttccactcggcatcggcgtcgacgaccttcaacccctcggtcaactcgttgacttcgtcctcggcgggctggctgttggtcagtaccgtggagttggcgcgtgccagttgcgattccagcagttgcagctgcgcgctgtagagcaccggctccggttgtttgcgcaagtactgcacaccacgctcgaaggccaggcgcgcctggcccggttggccttgctgcagggcatgctggccgaggttgttaaagaactcgatatgcagcagcaccaggatatgacggatttccttgatccagtgcttggcctcgttggtcggcaggaagccgtcctgggctgcacgggtgacttggccgtgcaaggcttcgagcaaaaagcgcacgtccttggccttggcttcggtctggatcggcgccggtgggttggccactggaatcgattcgccctgggcgatcagtgcattcaactcggcgatacgtgccttgagtggcgcgctggatttgttgaggttcaacaggcgctgagtaacgttcagttccaggcgggccagcaacagtttgagcgccggggtcatcagttggccaggaaaggtctcggtgatttcaccgcagcggcgcagccgatcattaagctcgatctcggtgcgctttttttccagcttattgttttccaccacatggttcatgtagccaatggcgatcagtattgcgatcccggctattaccagcagggtgatcatgagtggtgtcaccggtgtgacctctttatagggtttgctgtggagtgtagtgactgggtcagccggcggataggattgatcgaccaattgcccaggtactttcttctatataggtaggcgtgcgctgtatggctgcacattgccatcacttgcctgggtgaactatagcgtcttggcgggcgccagaatataggcgccaaggctcggacgccgacaaagcccgggaaggtcggtaaaccatggcgaagtcattgatttaaataaatttatccttgggggttgacgacctttcaatccatccatagaatgcgcgccacttacagcgtaaagcacacagcgaaacgcggtagggagtgaatgttgtacgtgtgtccccttcgtctagtggcctaggacaccgccctttcacggcggtaacaggggttcgagtcccctaggggacgccatatgcgggaatagctcagttggtagagcacgaccttgccaaggtcggggtcgcgagttcgagtctcgtttcccgctccaatttttaagcagtgttgccctcgggcggcattgagtgaaaccaggaccaagtcttcggataaggcctctgggcactgaaatacacaccatgtgtttcagtagcgtgtccccttcgtctagtggcctaggacaccgccctttcacggcggtaacaggggttcgagtcccctaggggacgccatttgcgggaatagctcagttggtagagcacgaccttgccaaggtcggggtcgcgagttcgagtctcgtttcccgctccatatttaacaaaaacgccgatcagtaatgatcggcgtttttgtgtgtgctgaatttacctcacccgcgcaccgccagcactcaagtggccgcaggcgcgtcttgccttggcataaaaaaccgcgcaaacagttcggactgcgactttatattcaacttgctatagatgttgcggcggtggactttgatggtttccgtcgacagcgacagcttcccggcaatctccttgttggaaaaaccgctgagcagcaacttgagtacatctttttcgcgagtggttatctgggcctccaactgggctatggcttcagcccatggcgccggctcggcgatgttcttttcctggtcgctttcaaagcacatgcgttggtgcatcatcgccgtcacccacggcttgatcatgtcgagcatggtgacttgcgcctgtgtgaatcgcacgttgctgccaaacgacatgcacaaagttctgtcggcatcgaggcgtacgttgtattgcgcctcatcgaccgagatgaattgcgcgaaatactgatggtagtactcggtctcaagaaagtgttccggcgcaatatcgagcagatggaagaagccgctctgcgggttttctcgatcagcgatataaaacgggtccagtagataaagacctttcacatagcgatgaataaaggcgtcaacctcttcgctgtcagctacctcaggcaggctgatcacgcgcacagagtgatcgccgaaaaccagtacaacccaattgtctatctgcacgtattcattcaatacacgaatcaatgagctccagaattctggccgattgagctgcatgatcagtttgccaacggatcgatgccaggccaggctatgaaggtcaagcgacatgttctacccctttagggttagggattggcaggccagggctaagtatttctaggtatttactattcaaccatgcccggtatattcaccccgaactaacgatagccatgaaggcatgtcgggtggacaaggatagtcatatgagtcgatcacacttgcgagctatttttttagccttgctgctgggtgccgcaatcagtacaccggcaggcgccgcccaatcttcgttgtatctatataactggttcgggtttcttgagccgcagaccccgagtgaattccagcaggaatccggcatcaagttgcacatggacgccttcgacagcgcggaaatcatgcagagcaaggtgatggccggacgcaccgggtatgacctggtggtggccacctccaatgtgctgcccgggctgatcaaggccggggtgttgcagccgctggatcgctcgcaattgagcaatctgtcgcacatcgatcccgatatcctcgctctgctggcggtcaatgatcccggtaatcgctacgccgtaccctacgtatggggcaccaccggcattggctacgacgtggataaggtcaaggcggcactgggtgaggatgccccggtggacagctgggacctgatcttcaaggaagagaacatcagcaagctcaagacgtgtggcgtggccatgctcgactcgcccagcgagatcatttcgattgccttgcactacctcgggctcccgagcaacagcaccaaccccgaggattaccagaaggcccaggccctgctgttgaaaatccgcccctacgttctctatttcgactcatctcgcatcgacaccgacttggccgacggcaatatctgcgccgtcgtaggctgggccaacggtgccctggcggcgcaggcgatcaatgaaaagtccaacagcggacgcaagattgcctacagcctgccccgggaaggggcattggtctggtctgagaactgggtgctgctcaaggatgcccggcaccccaaagccgccctggaatttatcaactacatgctgcggccacaggtgatcgccaagacatccaactacatgctctatcccaacgccaataaagatgccacgcagtttgtcgaacagaagctgcgggataacccgtggatttatcccgataaaaagaccatggccacattggtcccgctcgagcccttgccgctgaaggccgagcgcattcgcacccgtgtgtggaccaaggtcaagagtggtacgtgagggtagaactattggccggctgaccacagggcgggggccgggggagggagacagcatgcgccaaggtgttgatcagggctatctggagtcagacgactataaggcatacaaagagattgaagagcagattggcctttgtacgcccgaacaagcctgggccatgtattacgtctcgacgggcatggtgcgcgagaacattaccctggcagtgatggagcacatcggcaggggtaaccgcgcattgctgcttgagttccctgacctggtgcgggtcgaggggcgcaactatgagcccggagcactcgcgtccaactggcccttgttgcgacgctatcgtgaatagcctcatgggccgtctttcctatcagaagcgcagctcgtcgtaggccattcttgtaaaacatgtagggatagtctgtactttttgtgggggaggtgcgtttctctgtcgtgctctctactctggccacccattctccttgctcacttcagagaaatgcccagatgcttcaactcgatttttattcaacattggtggccgcttcgctggtgttattgctggggcgatggctggtgacgaggatcggcttcttgcgcacctacaatattcccgaaccggtcgccggtggtttgttggtcgccctgctactcatggcattgcgcggcctggctgatatcgaggtaagcttcgacccctctttgcaaacccccttgatgttggcgtttttcgccactatcggccttaacgcagacttcgccagcctgaagaagggcgggcgcatagtggccatattcctgctggtggtaaccgcgctgctggtgttgcaaaacgccatgggtatcgcactggccacggcgcttggcctggatccgctgatgggcttgctggccggctcggtgacattatccggcggacatggcactggcgcggcctggggcgcggtgttcagtgagcaatatggcgtagcttctgcatctgagttggcaattgcctcggcgacatttggcttggtactcggtggcctgattggcggccccgtggcgcgcttgctgatcaagcgggtcgaagtgccaggtgtcgggcaaccgcagccgcgcttgccaaagggcttcgaacagcccaaccaggagcgtctgatcacggcgttttcgtttatcgagaccctggcgttggtggcgatcagcctgaaggccggcaccttgctcaacagtgccatccaaggcactgccttcgaattgccgaccttcgtctgcgtattgttcgtcggtgtagtgctgcgcaatgggctgtcgatcctcggctggcaccaggtgttcgagcgcgaagtgtcggtgctgggcaatgtcagtttgtcgttgttcctggcgatcgcgctgatgtctctcaagctctgggacctggcggcactggccttgccgattgtcatccttttggctgcgcaggcgctgttgatggcgttgtttgcgattttcgtgacgtttcgggtaatgggccgaaattacgacgcggcggtattggcggccggtcattgcgggttcgggcttggcgccacccccactgcgattgccaatatgcaggccgtgacccagcgcttcgggccgtcacagattgcgttcctggtggtgccgatggtcggggcattcttcatcgatatcaccaatgctgtggtgatcaagctgtacttggcactgccgttcctgggggctgccgggtaagtcgcttcaccccttggccagcgctctcatcgcctgggccaagcgctgcgtggcttgcgcgatttcatcccggtccagggatgcaaagcccaggcgcagcgcattttccggacggtcgttgggtgaaaactgacgaccgctgcgcaccaccagcccatggtccagggcggtggttaccaagcgatccacgtctattccttcctcgaagcgtacccagagcgccaatccaccctcaggctcgcgcacctgtatgcgatcgccgaatgcctggtccaggcagtcgcgcagcacagttcggcgcgccaggtattctttcgagacgcggcgcagatgctttttcaactcaccgtcattgatcaagtccgccagcatggcctgggccaccccatcggcatcgcccaccatcaatgcggcgttgcgctgcaaaacctcaatcacttgggtgggcgccacgatgtagctgcaacgaaacgttgagcccagcaccttggataacgaaccgatgtagatcacatggcgctgggcgcggtcactggccagcggcaggtaagggcggccgctgaaatgatattcgtggtcgtagtcttcctctatcacgcaaaaatcatgttgcgcagccagtgccagcaagtgttgccggcgtgctgcatgcaagctcacggtggtggggaactggtggtggggtgtgaggtagatcatgcgcactttatgttcgcggcataagcgatcgatctggtcggtgcggcaaccttcatcatcgatgtcgaccgtgaccagttgtgcgccgagttttcggaaaatttcccacgccggcgggtaactcaaacgctctacaagcaccacgtcgccgggcttgagcagcaggcttgcgctcaggtacagcgacatctgggtgccctgggtcaggcagatattctcggcattcaccgtcaacccgcgattatttcgcagcatgtcggccagggcgcaacgcaaatggtagccggtgccctcactgccgtagcgcaaggtgttggaggcaaaactgttacgtaatgcatgacgatagtagcgatgcaaaacggcctggggcagcaaacggtgatcgctggtgccattgtcgaaaaacagcgcaccctgtcgatgctgtagagcgaccacttgggcgttgtgggtgaaatacggcaccaccgtctgctccagcagcggcggcgcgaaggacggttgcgcagcactgggcatgggcttgggcgtcaattgcgcattgacgaaggtgccacgacgcggctcgctgatcagccagcctttggtcatggcttcttcgtaggccaggatcacggtcttgcggttgacgttgagcaactgcgccatttcccgcgtgcccggcagcaaggttccaggcgcgaggcggccttcgaggatcgcgctgaccaggccctcggcaatcttgcggtaggacgcctggtgggtgtctgcgtcgagcctgagcaaggggcgccatttgcgcatctggaccatctgaattatccaaatctggaggttctaatgggcctagtctagcgcaacaatcaggtctcactcaccccgaggtccttatgaacacacgccatgtcatcgaactcgccccctcggggaaaacctttgaagccggtgatgaactgttgcttgatgcaatgcttgccagcgggttgaccgtgccgttttcgtgccggcgtggcgcgtgcgggtcgtgcaaggtggtagtggcggacggtgcatatcgtgccaagccactggacccgggcgccccggcaccgtcctatccactggcagccaatgaaatgctgctgtgccagagccatgcctgctccgacatgcgcctggagattcccggctggtcgctggacacacccgtgctcgtggtcgaggcaacggtgctgggcaagcgcgcgctcagccccgatgtcatcgagttgatcgtgatgccggacatgccgctggcggtgcgtgcgggacagtacgtcaagttccgcctggtcgatggtgactcgcgttgtttctcaatcgccaacctgccggctgagagtgatgggcgcctgatgtttcaagttcgtagagtgagcggtgggctgttttccgagaccttcctgggcgcccttgaagccggcgacctgttgcaactggaagggccttttggtgcctgcacctggcaggacgatgacgctgcgccggtcatgctgttcgccacgggcacgggttacgcgggtatcaagccgattctgctgaccgccttgaaacgcgatgtggaggtgacgctgtactggggcggtgcgcagccggcagatttttatgaccgtctgtttttggacaggatggtcatggaccacccacgttttcactggcatccggtactggcctcagagggccgggtgcaggaagttgcactgaatcatggtcatcactgggaggctgcccaggtctatgcctgcggcaacggtgcgatgatcagccagacgcgtgcggcttgtcttgaagcgggtttgcccagccatcggtttgtcgcggaagcctttgtgcccagtggccgttcgagtgcgggaacgctctccaagccattggacccggtctgggaaaaagtcggcccacgttactcgctggacggcatgctcgcggcacgtgagcagtccatccgtgccctggcggcgatcgccagccaattgaaggtgggtatgactaccggcgaagccctggatatggctgccgagcaactgcacgccatgggcgcgtcccacacctggcatccaacctacattcgctttggcgccgacacggtgcgcccaccccgtgaaggcattgaccgtcaacgcaggctgcgcgccacggacatcgccgtggttgacctgggcccggtgtgggatggctacgaaggcgactacggcgacacctttgtgttcggtgatttgccgttgcacctggcctgtagaaaagccctgcatgaagtatttgatgaaacccgtgaagcctggctgcgcgggctgaccgggcgtgagctctatgacttcgccgagcagagcgccgagtccaagggctggaggctggcgcgcaacctcgcagggcaccgccttgcggattttccccatgcgctgttcgaaagcaaggtgctggcggagctggaaatcccaccgagtgagatggcctgggtgctggaaatccagctatgccatcccacggagccggtcggtggtttttttgaggatatgctgatgctgcaagcctgacgagcccgccattgcggcgggctcccactgcgctcagagcttgggtagttggccaactcggcccatcatttcagtgacaatctgcaggtccagcaaaaactgctcgacggtcttgaactcaccgtcggtgtgcccggtgtacttctcttcaggtcgcgccaggccaaattgcacgccgttgggcaagtcatgcacggaggtcgcgccggccgaggtgccgaacttgtgcgccatgccgaggttttccgtggcgaccgccagcaaggccttgacccattcaccttcagggttgcggtacatcggcgtatccagcgagtaggtaaagtccaccttgacctgggtgcgtttgtcccaggcgctcaacttctcggcgatttcggctttgagtttttccggcgatttgcccttcggcgcacgcaggttgaccgccagcttgaaggctttgtcgtccaggccgacaaaggtcggcgaggtggtcagcggccccatgaagtcatcggcaaagcccacgcccaatttgccgcccaggtagtccaggccccagttgtccgccgcatagtgggcggcgtcggtgatgtggttgtgcttgagggcgatcttgccgtcgacgctgtggatcaactccagcatgcgtgccaccgggttgatcccggattcaggttcggaggagtgggcagatacgccagtgacggtgagcttgacgtccttgccgtcgaccttggcagtcacctggaaattgccgccattgcgcttggcataatcagcaccagcttgctgcaggctggctgccagttcggcaggtttatcactgaccagcgtggcgaccgataccgaaggaatctggttggtggccttgccgccagtcatcgcaatgatttctgcgccttggccttcgcccttgcgcaccgggaaggtggccatgacggtgcccgagcctttttcggcgatcacgaccggatagccgccatccagcgccaggttgtattgcggcacgggattgcgttcgaaatagtaaggaatggcgtcaccggaggtttcctcggtggtgtccaccagcagcttgaacgtgcgcgccagcggcaggttttcttccttgatcaccttcatggcgtacatcgccacgacgatgccgttcttgtcatcctcggtgccacggccatacatgcggtcgccgatcagcgtgaccttgaacgggtcgagcttggtgccgtcttgcagtacccaattttccggcgtcaccggcaccacatcggcgtgggcatgcacgccgacgacttcatcgccgctgccttccagggagatttcgtacacacggttatcgacgttacggaagttcaggttgaaggacttggccagggcctggatcttgtcggcaatcttgaggaattccgggtttttgtactgtggcagaccgtctacgttgaacgtcgggatctccaccagttcgcgcagggtttccagggccgccttgccgtacttcgcccgggtgtagatgccgagcaggcggttgatttcgttctgctgctcggcgctcagggtcttgttgtcgagaaaggtgctgatggccgggccgacgtcactgctcttgcccaggtcgcccttggccagggtgccgaggaaactgcggaaatcggtgaccgacgtgtcgctgaagctcttcaggatcgccgcgctttgttcggcgcttatgttggcgagcgcaggggtggtgacaactgaaaggctagcagcgaacagggtggcagctaccagttttttgagtgggaagtgcatggttgatggcattcctttgcaggtagtgagtaggaggtttctgacggatatgccagaaacatttccacacactaccattactcaggtgcccaaggtcaaggctggccaggatggggcgcagggtattcatcagtcacgttcaaggctctagcgtagggcccttcccacagttgcgcatgcaattgccctacgcgtttggccatcgcttcactgcgcatcaccacctccaggttgcgcgagttatccaggtaaccacccagccagttgctggtgccgatccacgccacttgcccgtcgatctccatggtcttgctgtggatcacccgcgcgtaggggataaagccttgcttggcctcgggcagcgtgacgatcttgatctcgacgttgggcagcaccgccaggctcttgaggtagggcaattccagcttgtcggtgttccagttggacaccatcagtttgattgacaccccgcgggcggctgcggcgcgcacggcgttgtcgatcaccgcgtagtacggccgggtccgatccgggccgtaggacagtggcgcatagtcaagcaattgcacgcggacttgtttttttgcttcgcccagcaggcgtggcagttccagctgtgagtcgcctacgccaggcgggttgtagcgttgcgggctggccaccaggtaattgccgacacgcgtaggttcctggccggtggccggcagcggcaccggttgcttatcggcgagggcagcctgggcttgccagtcctgatcgaagatcgcctgaacctggcccaccaccgcctcgtccgtaatccgcagcccggtttcgtggatatgttccagggagcgccagtcgaaattctggctaccgataaatgcctgcttgccatccaccacaaggtatttggcgtggatgatgccgccgctcagttgcccgtagggcagcacacggaaggtcagattgggaatcgcacgcagacgttccagggtggcggcttccgataacttgatgcctttttcttccagcagaaaacggattttcacaccgcgcttgccggcagcctcaaggtgctcgatgaccttgtccattaccgagcctggatgatcggcggcgtagaactggccgatatcaatgcggctttttgcgccgtcgaacaactcgatccataccgcgccggtctggcgcagatcggcagcgtccagggtggtgtccaccggcacggtatgcaccaattcaaaccctggaatggaaaagtccgcctgggccagcggactgaggagcaagccggcgaggcttgcaatacgcaacttcatcgaaagggacataagcgtctcatcggacaaaaagagggggcgggtgcatgacgcgcccgcccggcgggtcatgccgtgcggctgtgaagcggggtcggcacgcggtgtggtgcttcggcctgctcgcgggcgccgctggctgcgcggatcagcaggatcttcaactgatcattgatgcgttccaggctgtcctggaagaagttgtggaacaccacgcagaacagcgcgatggcgatgcccaggccggtggcgaacagggccgtgccgataccaccggaaatctgccctgggtcggaaacacccgccgtcgccaatgccttgaaggtgtcgatgatgcccagaatggtacccagcaggccgagcagcggggcggcagtggtgatggtttcgatgatccacaggctacgggccaagggcgcacgggtcttcaggtattgggtttcgatttcgtcgtcgaggtctttgcgcgagccattcgatgccttctgcgccagcaccggcaacaccatgttcagcgccaggctgtggcggcgggtcaggctgtccggcaactcgcgttcgctgtgcacctgagggcccagggcgtcggtgagggcgcgggcctggcggcgcacataggcgaagtagatgccgcgttcgatggcgatgaagatcgcgatggccatcgccgcatacatcacatagaaggtgacgtcgtggagcaggttcatatccatgatggtgttcctcttgggtcagtcttagaaattcgcttccagcgaaaccgttacggtgcggtccaggccgacgatgtacgccgggtcgccatcgcggaagccgctgtagctggccgcgttggtcttggtggtgtacacgccgtccaggtacttcttgtcgaacaggttgtcgacgttcaggcgcagggttgcgtccttgaccaccttcttgtccaccggcaggtagataccggcgccgaggttgaatacggtgcgtccggaaatggcttcgtcgttggtcaggtcgccgtagagcttgctggtgtacttgccgccgaaggtgccgtagaagcgcccgtcgtcataaccgatgttggccgccagcatgttcttgggcacattggcgaactgcttgccgctggtgggcaagacgatggctttgccggcgttgtagacggtcatgtcgtcttgctgctcggccttggtgtaggtgtaggaggtgtagtagttgaagtggtgaggcaactggccgctccattccagctccaaccctttgttggtgaccgcaccgacgttgatgtcggcagcgtcaccattgatgtctttggacgacacctggcggttcttgaagtccatgtagaaaagggtggcggccaggctcatgtcgtcgccgctgtagcgccagcccagttcatggttccagctggtttccggctcgaggttgatagagtcggcgcccttgtcgtagagcgcgtagttctgcggtacgcgcatgttgcgcgagaggctgtagaacaactggtcacgctcgtccagctggtatttgagaccgacgttgggcagcagtttgttataggtctggttacgtttttccggctgctcggtgaggctgccgtggttggtgccgtcacgctcgacgttcatgtacgcaaggccggcgatgaaggtccagtccgggttgatgtaccacgtgtcctgggcccagactttttgcgccggggtgatagtgaagcggtcgcgtccctggatctggttgccattggcatcgacgatggcactgttggagtcgggccaggtgtcgaccggcttgccgttgctcttgagcggaatgaacggctgggtctggctctggcgtgcgcgctcgtaccagtagccgaactgcaggctgtggtcgcccaggtcccaggtcagcttggtggtgatgcccggacgccaggtctgggtgcgcgaagggcggtagtacacgccgctgttcggcgtgccatcggcgttgtattgcgcggcggtgggcagtttgccgaggtcgaacactccgccctggttcgagccgcggttgagcgcataggcggacgagccgacgccgctgccgttgccccagtagtaatacgggatcaccgacagggccaggttgtcggccagtttgaactgggtgttgagcacggcggtaaaggtctggaacgggttctgcgccagggcgtagtagctgttgtacttgccgttgctgcccacgctcggcgtcgccgggtagggatcgtacttgcggccgttctgctggaactgcgccttggtcaactggctgtaactgttgttgtcctgctcgtggtacttgaggatcaggttggcagtgttgccgttgccggcgtcgaagaagctgttccactccaccttgtcagcgcgcaccgcgcctgagccacgccacatttccccttcggtatgggacaccgacagccagttgctcaggccattgatctcgccggtattgaggcgggcgaaggtcttgcgcgtggcgttgctgccgaccacctgtttgacgaacgcgccggtttccttggtcgggcgaatggtcacgatgccgatgttgccgccgctcgaaccgatgtgcgggccatcggcttccgatgcgccctgggtgacaaagatctggtcgatattctccgggtcgcccagcaggttggagtacagcgcgtagttaccggagtcgttgatcggcatgccatccaccgacatgcccacctggtcggagttcatgccgcgcatggtgaagcgaaaacccgagagaccggtgttgtcttcactggagatgttcaagcccggggtgtacttgagcttgtcgatggcgttgcccgtcgcggcctgcttgtccagggcttccttggtcaccgtggagcggcccttgatgctctcctccgggaccatatagccgccgccggcggtcgccttgccttttacgccaatggtgccgacgtcactgtcgctggtctctgccatgaccattccctgggtcatgctggtcgcggcaacgagtgccagatgaatacgggtgaacttcatcactgtcgtcctgggtcgggtgcttattgcacgctgtagttgaaggtggcggtgaagcgttgctcgttgcgccccccgaaggcttgctcggggaacggcttgacttgcttgatgcgacgtaagctgttggtggcggcccggttgagcagcatgcttgaggccgggctttgtacgccggagtcgagaacgcgaccctggcgatctaccagcaaccacaccaccacctcgccactcgggcgttcgagggacgcctggcgcccggtggggtattgcttgtaggtgtccagctcgttgcgcaagcctttgaggtaaccgccttccagggcctggccgtcaaccttcggcggcgcaggcggggcgggggccgccacgggtgctgccggggctggtacgggcggggtgggtttggcggcggcgactgggggcggcgtggacgctgtcttggccaccactggcttgggcacaggttttggcttgggcttgggttcaggtttggggagcggcttgggcggtggcggtggcggagcaggctcggcctcctgctcttcgatcaccggcggtggcggctcttgctccaccaccggttccgggacgacttccggctccggttcgaccaatgccaactcgaccgccgactcgtcatacaccggctcgaccttcaaggtctgggattggatacccagtgcaatcagcaccagggcgatcacggccggtacactgcccagcagctgacgtgcacgaaacagcatgtacatgatcaggacttacgcgtagcgatggaaacggaagtgaagccacccaggcgcagggtgtccatcacttccaccaggcgcgaaacctcaacgcctttgtcgctgttgacgatgatcgtcgacttggtatcgggcttttcggcggccttcagcgccggcaccaaggcatccaccgtcaggtccttgccgtcgagttgcaactggcctcccaggcccagggtgaggatgaatttgttttgcggtttgagctgctgtgaactgctggcactgggcaattgcgtcttcatgccgagcgcgggaatcacgttcaagctcaccagtacgaaaaacaccagcaggaacatcatcacgtcgatcatcgggatcagctcgatgtgcgccttgcgtttcttgggttcgtcccaggttctcattccgttaccccgtcagtgaattaggggcaagacgctaacaggcaaaaatgaccgaacggttaactttaattgacggtttaaaggctctaggacgcgtctttcagaaaacttaccggtcacttttgcgacgtaatgaaactgacatgcagggggtacatcctcgaggaatttatctcgggagccgccccgtatgcccactgcgttgcctcatttgtccaccccgcgcctacaattgcgcgccttggaagcgcaccaggccgaggtgcttttctcgctggtcaacgggccgaaaattgccgacaacacggccaatattccatcaccctataccctggaaacagcgcaggcgtttattgccggggtcggcgaaaaataccgcgccagtgggtgtctgaacctggggatgcatgtgcgtgactctggcgaattgatgggcatggtcagcctgcgtctgaacgctcgtcatcactacgggcacttgggtggctgggtggcagcgctctgccgtaaccaggggtatgccgccgaagccgcgagcgcggtgatggacttcggcttcgctgaactggggttgcagcgcataggcagccaatgctttggccgcaacaaggaatcggcgcgggtcatggagaagatcggcctgcgttatgaaggttgcctgcgccaggcatttctgaaaaatggtgtgtacgaggacctgctcgggtttgccatcgtgcgtgacgattgggagcaacgactatgagcggtgtcgtagaccacgaccggcgtcgggtactcagcggcctggcggtcgctacggcgttttccatcctcagcccgtttgcgcgcagtgccggggtggattatccgttcaccctcggtgtggcgtccggcgatccgttgccggatggttttgtgatctggacgcgcctggcaccttttttcaacgctgtggatgggcgcggtgggttgagtcgtccagtgccggtacgttggcgcgtcgccactgatgcggcgatgacgcagatcgtgaagcgaggcgaggtcatggcgaccgagcgttttggccattcgctgcacatcgaagtggcagggttggaggcgggcaggccgtactggtaccaatttgaagggctgggcgcgcagagccaggtgggccaggcgcgcaccacacctgcactgcatgccatggcctcggcccggctgggttttgtgtcctgctcgcactgggagcgcggttatttcagcgcctaccgtcacctggctgccgagcagcccgatctggtgtttttcctcggcgactatatctacgacagttcctacgcggcggattccggcaaggtttttcgctcccatggcagcggcaatgcgcagaccctgagtgactaccgcaaccgctacgcgctgtacaagaccgatccggacctgcaggccctgcacgctgccgcacccagtgtggcgacctgggacgaccatgaagtgcagaacgactatgccaaccgttggtcccaggaccccaaggtcggagtgacgcaatttctgcagcaacgggcggcggcttaccaggcgtattacgaacacatgcccctgcgcgccagcagcgtgccgaaaggcgcggacatgcgcatctaccggcgcctggactatggacggctcgcccgtttccatgtgctcgatggtcgccaataccgttccgggcagccctgtatccaggccaatggcagtcgccaagggcacattcagaccagcccttgccgtgacttgcgtgaccccgctcgcacgttgctcggctggcagcaagaggcctggctggaccaggggttcgcccagtcaaaggcgcagtggaatgtgatcgcccaggatctgctggtggcgccgctgatccagcgtgatctcaccaatcacaagccggggcgttggaccgatggctgggatggctacatggccaaccgttcgcggatgctggcgtccatcacccgccatcggctcaacaacccggtgttctggggtggtgacatacattcgttctgggccacggacctgcatgcagaggccgacaatccggactcggcggtggtcgccaccgagttcgtcggctcgtcggtgacgtcagacgggccgccctatgacgccttcatgaagatcatgccgctcaaccgccacgtgaagtttttcgacagccgccagcgcgggtacgtgtcggtggagttgacggcccagcggatgctgacgaactttcgcgcgatcagtgacccgcgcgacccggcggcgacggtgtcgacgttgaagtcgttcgtggtagagccggggagggcgggggcgattgccgtgtagcctatttctctgtggcgcatcggtcccctgtgggtgggggcttgctcacgatagcggtgggtcagtcactcatgctgtgattgaacctccgccatcgggagcaagccccctcccacattgatttcgtagcgcaccgacagggcgccttttttctccgacaatgccaaaatcgtcacctggcccagttcgctcaacgtttgcacatgggtgccaccgcaagcgtatgacggcaactcgccgaagccgacttcccggatgccttcttccagcctcatatgccgtgggtagtcggcggcgatccattggttgacctgcagttgaagcatttgggcatccatgtcctgtgcagcttcgccacggataaacgtgatcttgccttcacccggccaatggtgggccttgatcggcatccagcccaggcgttcgccggcattgccaatcaaatgccccgccgaatgcaggcgggtgtgcagcgcgcggcgctgtgcatcgacccgcgcaatgatcgggccgggttgcaacggctgatcaacgtaatgcaccacatgctcggcttcctgcatgacccgcagtacctggctgttgccgagccagccagtgtcgaacggctggccgccgccttggggatggaagatcgtcgactgcaggatcacggcaaattgctcttcgtgcgcagtgcaactgagcacttccagctcggctgtaaggtggtcgtgggtaaaaaacaggcgctcggtcatcatctacatccgcatcggggttctgcggacagtataaatagtgcgtggatgggtgataatctgctcaattatcaatggacctgtgcgtcatgagcatcaatcttcccttgtcgctgctgggcgaaatggcaattttcgtcagagtcgtggaaaccggcagcttctccgaagcggcgcggcaactgagcgtttcaccctcggctgtaagccgcagcatttcacgcctggagcaggccctggccacgcgcttgctgcaacgcaccacgcgcaagctgcgcctgagcgagggtggcgaagaggtgttcaagcgttgccaggagatggtcaacgcggcccgctcggtgatggaaatcagtggccagttcaaccatgaagccgagggcctggtgcgggtcagcgtgcccaaggcggtggggcgctttgtggtgcatccgcatatgcctgaatttctgcggcgctatcccaaggtggatgtgcagttgatcctcgaggataggcacgtggacctgatcgacgataatgtcgacctgagcattcgcatcactgacagcccgccgcctggcttggtcgggcgccagttattgcccatcgaacacttgctgtgcgcgacgccgcagtacctggccgagcatggcaccccgtgccatccccacgatttgctcgaacacagttgcatctacctgggggaaaccccgggcgactcgcgctggaaattccgccaggccggcaaggcggtgacggttggcgtacgcgggcgttatgcggcgaaccacactggggtgcggttggatgcggtattgcagcatgtggggattggcagcttgccgtatttcacggcgcggcatgcgttggcggtgggccagttgatgcaagtgttgccggcgtgggactttattgcgtcttaccatggccaggcgtggttgctgcactcgccgacgcggtacttgccgccgaagttgcgggtatttattgattatctggtggagtgcatggcgaaagagccaaagctaaatgtgggagggggcttgcccccgatagcggtctgtcagtcacctttgcattgattgacccactgctatcgggggcaagccccctcccacatttgaatctcagtgtttgaaaagtcagtgcttgctctggtcttggggcatggccagcagttgcttttcctggttccagtcgaacggttcgtcgttctgttcggcttcatagcgacgctcttccagggcctggtacaggtccagttcctcgtcgggcatgaagtgcaggcagtcaccgccaaagaaccacagcagatcgcgggggaccaaatgggcgatctgcgggtagcgcaggatgacctggctcatcaggtcctggcccaggtactggctttcgatcgggtcgattggcagcagggcgcgcagttcgtcaaaacgctccaggaacagcgagtggctttcctcgggcacctgttcggcttcgccgacggcaaccaggatgctgcgcaggtggtcgagcaagacgagatgatcggcaacgacgttggacacgagataaagtcctctaaagcaaaaacgggcgcgagagtatatgcctctcgcgcccgtatttatatgaccgcttgactcagcggactttaccttcggcctggatcagctcttccttgctgaaatcatccacgtcgatcaccttgcgccgcgccgcttcggcgtcgcgcagggtttgcgcttcggccggttgcagtacgccggcatgcagggctgcgtcgatggcagactcaccggccgtcggtttgacttgcccgcttttaagtgcggcatgcaattttttctgcaacggatggctggcgccgagcaggtcgtaggcatgctgcagcgcgcccactggatcttctgccgattgcgggcgataacagccggccagcaattcttccagggtcgggtcgcccttggcgcgaccgatcactgcggccacttcggcatccagcgcgtcggacggcccggtgtgacgacgcccgaacgggaacacgatcacccgcagcaggcagcccaacactttgttcgggaagttgctcagcagctcatccagtgcacgttccgattcacccaggctttcttccatggcccaggcaaacagcggttccaggtgatccggcgagtccaggtcgtgataacgcttgagcgccgccgatgccaggtacatatggctgagtacgtcacccagacgcgccgacaagcgttcgcggcgtttcagttcaccgcccagcagcatcatgctcaggtctgccagcagcgcaaacgccgccgcctggcggttcagggcgcggaagtagccctggctcaaacggttgccgggggccttctcgaaatgcccgaagcccaggttcagcaccagggtgctggccgcgttgctcacggcaaagccgatgtgttgcatcagcaggccatcgaattccttcaacgcctggtcatggtcttcgcgaccggccagggccatctccttgaggacgaacggatggcagcgaatcgcgccctggccgaagatcatcagattgcgcgaaaggatattcgcgccttccaccgtgatgaagatcggcgccccttgccagctacggcccagatagttgttcgggcccatgatgatgcccttgccgccgtgcacgtccatggcgtggctgatgcactcacggccacgctcggtcaggtgatacttgaggatcgccgacaacaccgagggcttctcgcccaaatccacggcattggcggtgagcatgcgggcgctgtccatcagccaggcattgccgccgatgcgcgccagggcttcctggataccttcgaaggccgacagcggtacgttgaactgttcgcgcacctgggcgtattgcccggtcaccaggctggtgaacttggccgcgccggtaccgaccgcaggcagggagatggagcggcccaccgacaggcagttcatcagcatcatccaacccttgccgagcatttcctggccaccgatcaggtattccagggggatgaacacgtccttgccggagttggggccgttcatgaacgcggcgcccaggggcagatgacgacggccgatttcaacgccaggggtgtccgtagggatcaatgcgagactgatgcccaggtcttcttcctcgcccagcagatggtccgggtcatgggccttgaaggccaggccgagcagggtcgcgaccgggccgagggtaatgtagcgcttttcccagttcaggcgcaggccgagggtttccttgccttcccattcgcctttgcagatcacgccggtgtcgggcatggcgcccgcatcagagccggctagcgggccggtgagggcgaagcatggaatgtcgtcgccacgggccaggcgcggcaggtagtggttgcgctgttcttcggtgccgtagtgcaacagcagctcggccgggccgagggagttgggcaccatcacggtcgaggcgaggtcaccgctgcgggtcgcgagtttcatcgcgacctgggagtgggcataggcagagaagcctttgccaccgtattccttgggaatgatcagggcgaaaaagccgtgggtcttgatgtgttcccaggcctccggcggcaggtccatggcctggccgatttcccagtcgctgaccatggcacagagttcttcggtagggccgtcgataaacgcctgttcttcttcggtcaattgcaccttggggtaggccagcaatttgtcccagtcggggcgcccgctgaacagttccccgtcccaccagacggtgccggcatcgatggcatcgcgttcggtctcggacatcggcggcaagactttctggaaccagctgaacagcggcttggtgaagtattggcggcgcaggtcgggcaacagcaatggcacggcgaccacggcgatcagcacccagaagatcagcagcagccaacccggtgcgtggctccaggcgcccatcgccagcaggtagacggcgaccacgcccagggcgggcaggggggcggtacggcggtgtgccaggtaggcaatgccgaccaccagcaccagtatccacaacaacagcatatgcaatcctccgtgaaaccaggggcgaaaccaccagggagcttagtcggcatccgatcaagccgggtgatcagggtgttacaagttgtactcgactacccatccgcaggcgccgacatttggccgaatcgtcgttatctcttgtggcaagcctgtcgttagactcgaggcttcctttggagatcaagcttatgaacgcatacttgagtcccagccgcttcatcgatagtgaccaccctgcagtggtggagttcgccgaaaaacatcgcggaacccatgcggatttaagtgaccaggcagtcagtctctactacgccgtgcgtgaggcgattcgctacaacccctacaccttcagccgtgaccccggcaccttgaacgccagcttcgccctggctgccggtgaaagctattgcgtgcccaaggccaccttgctcgctgcctgcgcccgccactgcggtatccctgcgcgaatcggcttggcggatgtgcgcaatcacctgtccaccccacgcctgctcgccctgctcaaaagtgacgtgttcgccatgcatggttataccgagctctgcctgaacggccgctgggtcaaggcgactcctgcgttcaaccagcaactgtgcgaggtgttcgacgtgccaccgctggaattcgatggccttcacgacagcgtctttcacgccttcaaccgccagggtcagcgctcgatggagtatctggtggaccacgggcaatttgccgatgtgcccgaggcatttttcttcgcccatatccagcagtgttacccgcacctgtttaccgacgatgcaccgatcctgatgggcgatatgcgcagcgattcaagccgcgcctgaaccggcgtatgctgctgccttcatcctgccaagttcatcaacaagaaggcgcggtcatgctgaaaatctggggtcgtaaaaattcgtcaaacgtcaggaaagcactgtggtgcgccgaggagctcggcctggactatgaggcaattgatgcgggcggggctttcggtgtggtcgacactccgcagtaccgggccctgaacccaaatggccgggtgccgatgatcgaggatggcgactttgtgttgtgggagtccaacaccatcgtgcgttatctgtgtgccaagcaggcttcgacatggtacccgagcgacctgaaggcccgcgccaacgcggaaaagtggatggactggaccacctccaccttcgccgaacccttcaagacggtgttctggggcgtgctgcgcaccccggcagagaagcagaattgggacaacatccatgccgggcgccaagcctgcatcgaggtgctcaagactgtcgaccaggcccttgccgagcaaccttacctgtcgggcaatgagatcggcatgggtgatatccccctgggcagctttatctacgcctggttcgagatgcctatcgaacgccctgcaatgcccaatctagaggcctggtaccaacgccttcaacagcggccggcctatcgcaaagcggtgatgaccgcgttgacttaatacacactattaatacgggtgactgtacttgtgcggcatgggcacgcaccatgctcgcactgcaccgccggttgaactaccggcggtgtgccctcatctattgtttctattcccttctttggtgcgtatcccgatatgagttccgctctgtccatccggcagctaaccaaaacctacggcaacggtttccaggccctgagtggtatcgatctggatgttgccgaaggtgatttcttcgccttgctcggccccaacggtgccggcaaatccaccaccatcggcatcctctcgaccctggtcaacaagaccagcggcacggtgaatatcttcgggcatgacttggataaatccccggcggcgctcaagcgttccattggcgtggtgccccaggaattcaacttcaaccagttcgaaaagaccttcgatattgtcgtgacccaggctggctactacggcatcccggcgaaaatcgccaaggagcgcgccgagcagtacctgacccaactgggcctgtgggacaagcgcgatgtaccttcacgttcgctgtccggtggtatgaagcgccgcctgatgattgcccgcgccctggtgcatgagccgcgcctgttgatcctcgacgaacctaccgcgggcgtggacattgaactgcgccgctcaatgtggaccttcctcaccgagctgaacgagaagggcatcaccatcatcctcaccacccactacctggaagaggctgagcagctgtgccgcaacatcggcatcatcgaccacggcaccattgtcgagaacaccagcatgcgcaacctgctgggtcagttgcatgtggaaaccttcctgctcgacctgaagaacaacctggcggtggcaccgcaactggtgggttatccaagccgcctggtcgacagccacaccctggaagtgcaggtggacaaggccatgggcatcaccgcgctgttcacccagttggcgaccctgaacatcgaagtgttgagcctgcgtaataaaaccaatcgccttgaggagttgttcgtgtccctggtggagaaaaatctggcgaaggtggcggtatgagttccgaactacaacccaacctcgtcgcgctgcaaaccattgtctatcgcgaagtgaagcgctttacccggatctggccgcagaccctgctgccgccggcaatcaccatggtcctgtactttgtgatcttcggtaacctgatcggccggcagatcggtgacatgggtgggtttacctacatggagtacatcgtgccgggcctgatcatgatgtcggtgatcaccaactcctacggcaacgtggtctccagtttcttcggcagcaagttccagcgctccatcgaggaactcatggtttcgccagtgtcgccccacacgatcctgatcggctacaccctgggcggcgtgctgcgtggcctgatggtgggtgtgatcgtgacgctgctgtcgctgttcttcacccacctgcaggtgcatcaccttggcgtcaccatcctggtggtagtgctcacggcgacgatcttctcgctgctggggtttatcaacgccgttttcgcacgcaacttcgatgatatctcgatcattccgaccttcgtgctgacgccgctgacctacctgggcggggtgttctactccattaccttgctgccgccgttctggcagaccgtgtccctggccaaccctgtgctgcatatggtcaacgcctttcgctacggcattctgggcgtgtcggacatcaagatcagcgtggcgatcaccttcatggtcgtggcgaccgtggtgctgtatgtcggctgtgcgcggttgctggtgagtgggcgtgggatgcgtacttaaatagcgattcaacgcggtaaaaaatgtgggagggggctcgctcccgatagcggtctgtcagacaccttgtactgactgatccacagctatcgggagcaagccccctcccacatttggtttggtgtatggccttcaggccttcagggccagttctatcagggcatgcagctcttcaaccgccaaaggctgcgccgaaaatagaatacggaacaccgtcggcgccgcgagcaggttgatcaagcggtccacactcggcgccgtctcttgcggataacgatcgacgatcgcctgcaattgcccgcccagaatgcttacgcaatacccaggcgtcacgctgctttgcacgtcgcgcatcatattgcgccctacgtccgtactcatttcatccaggtattgctcagcccaggcctgcagatcgccgcgcaggctgccggtgtttgccggctcgctgtccgggcgcaggcgcgccagggctacatcggcgagcaacacggaaaggtcgccccagcgccggtagatggtcgagggcgtaacgcctgcgtgcgccgcaatcatcggcacagtaatactggatcgctcatgggcttcgagcaattcgcgcactgccgaatgaacggattcttgtacccgggcactacggccccccgggcggaggccttctttaatcgccatgcttaaaaccttaacacaaagaatttgctttaagcgccgacgggtagcacactctgcaaaagcaaaatattagctttaacggagcgtgcccatgtccagcaacatttctcaccgttccagcctggcgttcctggtgatcaccgtgttgaccttcctcgccgcgtccagtgcgccgacaccgttgtatcaggtgtaccaggaaaacctgcatttttcggccgcaatgctcacggccattttcggcgtttatgccgtgagcctgttggcggcgttgctgaccgtggggtcgctctcggattacctggggcgcaagccggtgatcttcgccgcgctgctgctgaatatcatggcgatgctgctgtttatcaacgctgacagcaccgcctgcctgcttgccgctcgcgcattgcagggctttgcgaccgggactgccacagcggtgttgagcgcgacattgctcgacaccgaccgcgtgcgtggcccgatgctcaacagcctcgcgccgatgctcggcatggcctgtggtggcctgggcagcggcttgctggtggagtacgcgccgcgaccgacccaattggtctatttcaccctgctgggcttgatggtgctgcaggccctgtacctgtggcgtctgcctgaaaccgtcagccggataccgggggccttgaagtccctggcgccaaccctgcacgtgccgccccaagcgcgccgggccttgtggttggcgatgccgctgaatgtggcggtgtgggcgctgggtgggttcgtgtcctccctggcgccgtcgctggtgcgggctgcgacggggtcgagctcgcatttgatcggcggtggcctggtggcggtagtgaccctgagtggcgcggtgatgatctacagtctgcgcaaccgtgcggccgacaaggtcatgcgcctgtcggcgctgctgctggcggtgggtgtagggctgctgctggttgccgtgcagaccgccagcctgtggctgttctttgtcgccagtgtgattgccggcttcggtttcggcggcggcttcatgggcagtgtgcgcagtattgtcggcttggcgttgcctcatgagcgggccggcctgatgtcagcgttctatgtattgagctacctggcgttctgtgtgccggcgttgttggcgggtaacctgagtcgagtgtttggccttgtcgctactacggatggctacggtgtgatgcttatcctgctggccctcggcgcactcgccgggctgctgttgcaggatgcttcacgaggcagagccgccgcataaagcctatatctgcaaaatagataatagttagagatattacccgttatatagatattcgaacgggttctatcatggcttcaacctcatgcgaggaagaggattaacgccatgacctgctcgactatcaacagctacaaacctttaagtcacctggcccgtccccgggaagtgattcgccagttcactccgaactggttcgccgccaccatgggcaccggggtgctggcgctggcattggcccaactgcctgtcagcctgccaggcttgcacgctgtggcagagggtctttgggtgttcaccatcggactgttcatgctgttcagcgtgttgtatgccgcccgttgggtgatgttttttcacgaggcacggcggattttcgggcactccacagtctcgatgttcttcggcaccattcctatgggcctggcgaccattcttaacggtttgttgctgttcggcctgccgcgttggggtggtgatgtgatcccgttggctgaggccctgtggtggttggacgtcgccatgtccctggcctgtggcgtgctgatcccgttcatgatgttcactcgccaggagcacagcattgatcagatgaccgcggtctggttgttgcccgtggtggctgccgaagtagcggcggccagcggtggcttgctggccccgcacttggtcgacgcccatgcgcaactggtgatgctggtgaccagctacgtgctgtgggcgttctcgctgccagtggcgttcagcatcctgaccatcctgatgttgcgcatggccttgcataagttgcctcacgccaatatggcggcgtcgaactggctggccctgggccctatcggtacgggtgccctgggcatgttactgctcggtagcgatgcgccggcgatcttcgctgccaatggcctggcgagtgtcggtgaaatggcccatggcctgggcctgatcgcaggcgtcaccttgtggggcttcggcctgtggtggatgttgatcgcggtgctgatcaccctgcgttacctgcgcgccggtatcccgttcaacctgggttggtggggttttacctttccgctgggggtgtatgctctggccacgttgaaattggcgaacgtgctgcagctggggttcttcagcgtattgggcagtgtgctggtggcggcgctggcgctgatgtggatgatcgtggccaagcgcacggtgcagggcgcgtataaaggcgagctttttgtttcgccatgcattgcagggttagggaataagtaggcgggattaggtaaagtcgtggcctgatcaataacaggccacgcaggaacacggacgatgagccacccctcgcaattcaccttgctgcgcacacggcgtttcttgccgtttttcatcacccagctgctgggcgcgttcaacgacaacatcttcaagcaatcgctgatcctggcgattctctacaagctcagcatcgagggcgaccgctctatctgggtcaacctgtgcgctttattgttcatcctgccgttcttcctgttctcggcattggccgggcaatttggcgagaaattcaacaaggacgccttgatccgtgcgatcaaggtcggtgagatcgtgatcatggccgtgggcgcgacgggatttttgaccaatcatctggagctgatgctgctggcactgtttgccatgggcacccattcggcgctgttcgggccggtgaagtactcgatcatgccccaggccctgcacgacgatgagctggtgggcggcaacggcctggtggaaatgggcacgttcctggcgatcctggccggcaccattggcgccgggatcatgatgtcttccacccattacgccccggtagtggcggtggccatagtcggcgtggcggtgctgggctacctggccagccgcagcattccgcgggcggcggcttcgacgccgcaactgcgcctgaactggaatatcttcacccagtcctgggcgacgttgcgcatgggcctggggcagacgccagcggtgtcgcgctcgatcgtcggcaactcttggttctggtttgtcggcgcgatctacctcacgcagatcccggcctacgccaaggaatggttgtacggcgacgaaaccgtggtgaccttgatcctcaccgtgttctcagtgggcatcgccctggggtcgatgctctgcgaaaaactctccgggcgtaaggtggagatcggcctggtgccgttcggctccttcggcctgacggtgttcggcctgttgctgtggtggcactcggggggcttcccgcagaacgtccaggccaatgactggcttgcggtactcagttacggccaggcctggtgggtgttgttcgatatccttggcctcggcgtgttcggtggtttttatatcgtgccgctgtatgcgctgatccagtcgcgcaccgctgagaacgaacgggcgcgggtgatcgcggccaacaatatcctcaacgcgctgttcatggtggtctcggccatcgtctcgatcctgctgctgagcgtggccaagctgtcgatccccgagctgttcctggtggtgtcgttgctcaacatcgcggtcaacacctacatcttcaagatcgtccctgagttcaccatgcgcttcatgatctggctgctcagccactccatgtaccgcgtggagcatcgcaacctggagcaaattccagatgagggtgcggctctgctggtgtgcaaccacgtgtcgtttgtcgatgcgctgttgattggtggcgcggtgcgtcggccgattcgctttgtcatgtactacaagatctatcgtttgccggtgctcaactttatcttccgcaccgccggcgcgattccgattgccgggcggcatgaagatatccagatctatgaaaaggcgttttcgcggattgcccagtacctgcaggatggcgagttggtgtgcatcttcccggaaggcaagttgacggccgatggcgagatgaatgagtttcgcggtggcgtgacgcggattctggaggaaacaccggtgccggtgattccgatggcgttgcaggggctttggggaagttttttcagtcgcgatccgcacaagggctttttccatcggatttggtcgcgggtggtgttggtggcgggtgagccaattgccgtggaggtggcaacgcctgtgcagttgcaggcggcggtgggcggtttgcgggggagtgtcaggtagctatagattggtgggggcggccttatcgggggcaagccccctcccacattctgaatgtgttcacaaatcaaaaagtgggggcttgccctcgatggtggtagcggtctaagtgctgatcttgagcccaatgagcccgcagataatcaacgccacactggccaatcgaaacagcgccatggattcgccaaacaggataatcccggcgatcacggtacctaccgcacccacgccggtccagatcgcataggcagtgcccagcggcaactccttcatggccagccccaacagccccaggctgaccgccatggcggcaattgtcagggcggtgggcagtggcttgctgaaaccgtcggtgtacttcaaacccacggcccagccgacttcaaacaacccggcaaaaaacagaatgatccaggacatgataacctcgcttctacaaagtggggtcgtcccctgagtaagcgcttgatagcgtcgcgaggtcgtccccgcgaagcttggtagagtgccgaaatcggatcagacgatcaagttacggcgcgctttccagtgcgcggcggtcttccttttcgctcatgcggcggaagtaggtcgacagcagtgctccggaaatattgtgccagacactgaacaacgcacttggcactgccgccagcggcgaaaagtgcgcactggccaacgcggcacccagcccggagttctgcatgcccacttccagggccaacgacttgcgttgcgccaagggcaatttgaacaggcgcccggtgaaatagcccagcaggtaaccgaagctgttgtgcagcatcaccacggccatgatcagcaggcccgactcggcaatcttctgttggcttgcggcaaccaccgcggcaacgataatcacaatgctgaccaccgataccaggggcagcacgtccaccgcatgacgaacccgctcacccagtacgcgttgcgcgactacgccaagcacaatcggcaacagcactacttgcaggatcgaccagaacagctccatgaacgataccggcagccaggccgaggccagcagccagatcaatgccggggtgagcagcggggcgaggagggtggtgacagcggcaatggccaccgacaatgccaggtcgccccgggccagccacgtcatgacgttggacgaggtgccgcttgggcaacagcccaccaggatcacgccgacggcaatttccgccggcagatggaacatctggcacagcaaccatgccacgccgggcatgatcacaaaatgcgcgaccacgcccaaggccacgcgccacggatggcgcgcgacttcggcgaagtcttcgagtttcaaggtcaaccccatgccgaacatcaccaggcccagcagggggacgatggcgcctttgaggccgatgaaccaaccgggttccaggaaggccaatacggcaaatatcaacacccagtaggcgaaggtattgccgacgaagcggctcaaggcggcgagtgcacgcatgggggcatcctttttgttagtttttttagttggcaatgcgatcaaatgtgggagggggcttgctcccgatagcggtgggtcagctacacatctattggctgacataccgccatcgagagcaagccccctcccacattttgatcttcacatggcttagatgccctgtggggtttcctcaccacccaacgcttcaaccagcgccggcaggaactcaccgaaggtcagcatcatcaaggtaaagctggcatccagttggcccaaggcttcgtcgccgccgtcctgttccgcctggtcttgcagcaggtcttcgaatttcaggcgcttgacggtcatcttgtcgtcgagcatgaaggacagtttgtcctgccatgccagggacaattgagtcacgaccttgccggtggtcaggtgcagctggatctcttcgccggtcaggtcctggcgtttgcagcgcacgataccgccgtcttcgtgggtgtcgcgcagttcgcattcgtcgaggacaaagaagtcgtcggccggtttctgggtggtgacccagtcggtcatgatggcagtcggtgcggttttcactgtcagcggacggactggcagggtgccgatcacttcacgcagggtcgacagcaagtcttcggcgcgcttggggctggccgagttgaccaggatcaggccctgtttcggcgcgatggcggcgaaggtcgacgagcgacggataaaggcgcggggcaggaaggcctggatgatttcatccttgatctggtcgcgctccttcttatagaccttgcgcatctgctcggcttcgatctcttcgactttctctttgagtgcatcacgcaccacgctacccggcaggatgcgttcttccttgcgcgctgcgatcagcaggaagtcgccgctgacgtgaaccaggggagcatcttcacctttaccgaaaggtgcgacgaaaccataagtggtcaactcctggcttgcacaagggtgcgccagcttggtggccatggccgcttccaacgcctcggcatcaacaggcagatcttgggtcaggcgatagataagcaggttcttgaaccacatggggtgagtctctcctctatacaaaggggggcattattctcttgatcacgccccaggccaaccctgcctaagccattggaagggctgaaaaaaaagatttaagaaagtgcttgccagacttagggtcgctccgtagaatgcgcgccacaccgaaacgaagggtgattagctcagctgggagagcatctgccttacaagcagagggtcggcggttcgatcccgtcatcacccaccattcgcttcatgtgttacgcgcagcggtagttcagtcggttagaataccggcctgtcacgccgggggtcgcgggttcgagtcccgtccgctgcgccatattcagtaacctggaatgctgaacgccaggtttccacaaaaagcccgctcattgagcgggctttttgctgtctgggtttttgcaaatagccgggaacgccgccgccgatcattttcgatgatcggcggcttttttatgaggcgttagaaatcccagcgagtggtgaccatgaagttgcgaggctcgccataggcggcggagttatagaagccgatgttggtgtaatagtgcttgtcgaacaggttgttgacgttcagcgtcgccgacaggttcttgctgacctggtagcgtgtcatcacgtcgaccagccaataggcgtcctgggagaactcttcgtattgcttgtgggggtcgttgtagatgtcctgccagccgacgctctgccagcgcacgccaccgccaacggtcagcttgtccaggtggcccttgagtttgtaggtggtgtacagcttaacctggtcttcgggttcgaacgtggagatcttcacgtccttgtcgtcgcgcacgaccttgtgggtatagccagcctggagttgccagccgggggcaatctcgccggacatttccagctcataacctttggtgacggccttgctgcttttataggcgtagttgctcggggtcggcgtctggttgttgtactcgtcatccgagagtgcgcggttggattcatggatttcaaagtaggccgcgctggcgttgacacgcccgtcgaggaactcggcttttacgcccagttcccagttctggccctcatccggttcaagcagtttgttgtcgcgaccgcggttgtaattctcttgtggcatgaagatatcggtgtagctggcgtagaccgcgtaggtgtcgttcaagtcgtagaccgcgccgatgtagggcacgaaccgtccggactcgcggtagttggggttatagcctgtgacctggtagttgaccacgcgcccacccatcagcagcttgaggtcgtcggcgagattcaggcgtgtggtcacatacgcgccggtctgtcgcacggtgtcatcgatcaacaattgggccttgccccaatccggtatggctgcgtggccgtgccagttgttgaagtcgacgatattgggtgagaggttccagtagcctttgcctttccattctgaggcgctgatggagccgcccagtaccagttcgtgttcgcgcccgcccaagctgaacggaccgctcacgtacaggtcggcagaatcgctgacggtttccccggtgtacttgcccgaagtcagttgggcggtgccgtccgggttcgggtagttgccctggatcgagcccatcagggcgtggtagccgttgatcttgtggtccagttgcaatttgctgacccagccattacccagatcgtgctcgagcatggcaaatacggtgcgggtgtattgttcccagctgctccagtcggcggcgttattgaacgagcgcttgacgctgttacggtcgcctttggagttgatcagcgggaagctgcctgaccatgatgagccccgtggcaaggtgtcctgatagtcgccgcctacggtcagcagggtatcgggtgacaggtcgaactccatgatgccgtagtacgtcgggctttggcgtgagtagtggtccatgaatgagtgcttgtcctggtaggcggccactgcccgaccacgcacattgccgctctcggtcatcgggccgctgacatccagctcgctgcggtaattgtcccaggacccagcgccgagggtcgcgtgcccctgaaaatccgctgtaggtttcttgcgcaccaggttgatcgttgcacccaatgagcctgcgccagtgagcaggccggtggcacccttgagcacttcgacgcggtcgtagatcgccatgtcgctcaaggtgttgcccgccgagtacgcgacgttgcgcgcggtggacgggatgccatcgtactggaagttattgatcgaaaagccccgggcgtagtagttgctgcgctcgctgtcgaaggctgaaacggtgatgcctggcgtgtgccgcatcacatcgtcaacgttgttcaggccgaagtcgtccatgtgctggcgagtaaccactgataccgactgcggggtttgcttgggggtcagcaccagccgcgtggaagtcgcgatcgtgccgggcgtgtaggagccggtgccttcggtgacgttgccgagttggttggcgctgacttcggtggggctcagctccagtgtgtcgttgcccgcaacgggggcaggttgcagcgcatagccccgatcgccttttaccgcacgataaccactgcctcgcaacaacctgtcgaagccatcctgaaccccgtagtcgcctttcaggcctgggcccttgacaccttccagttcgtgggactggaacacgatagcgactccggcctgctgggcaaagcggttgagcgaactgcccagcggcccggcaggaatgtcataagcctgggcggcgatgctggctgcctccgcctggaccaggctggtattgagtgtgcaagtggtgagtatggccaaggatagcggtgcgcatttcaatagccgaaagcgtccacgcaggtgggagggggcgtacatggtgaaggcagtcctttatgggttcaattaccctccttgacgggcagcttcttaaaaaccggaagcaaatgcgaataattattcattggctcttgtctcgagggcttaccacgaccagccatggggtgaaggtctgtatccggatcggcagtgtttgcgccagcagtttcaaggcgtggtcgctgttatccagcgggatcacggcagatacgcgaagggattgcagcgcatggcgatcaaattgcacgcggccggcgcgatgcctggcaatttcatccagcacctcgggcaaggggcggttctcaactaccaattgatggcggcgccaggcttcattaatgctcgctggatcgatggggccggccaggcgcacctcgttcgagcgcattgtggcctgcgagcccgcgtcgacctccagtgtctgttggccgttcgcactatgtgcggctacccgggactcgagcatgctcagaacggtgacctcacccgcacgcttgaccacaaatcgcgtgcctagtgcgcgcagcgtaccttgaggggtttgcacgataaacggtcgagtgttgtcgtgggccacctgcaccaggatttcgccttgcagcagttcgacgcggcgctgtttgccatcgaaatacaggtttgccgcgctgataccgttgagagtcaaggttgagccgtcggccagttgcagggtttgccattggtccggaccgttgcgtatatcggccagccactgctgcggataagggctgacgagcattgccgtcgttggaatcgccaggccgcacaccaataacagtgcccgtagggtgtttttgccgcgtcgcttctcggatggggcgaaggctgcgttcaacgccgctcgggacggtgctttcttgtcgtgcagtgcctgcatatgggccacggcggcctccatgcgagcggcggttgcagcgtgatacgggctttgctgtttccagcgttcaaatgccagtcgctgggtgtcgttcagttcgccctcgtgcaggcgcagcagccagtcggcggcctgctcttcgattttttgttgtgggtcgggcatgttcaatcaggtgtccatactgtggctgcaatgcatgagcgccttgatcaggtatttgcgcacagtacgctctgacaatttgagctgccgggcgatttgctgttgggtcaattcttcgaggtaatacagcacaaaagcttggcgtgaatattcgtgcatgccttccaggataaacgcaatctgctcgagcgcctcgagcgtcgtgtggatttgctccggggattgaacaccttcgagcgcgtccaccgtgagggccaactcctgcaggtacgcctgttcaatctgtctgcgtcgcgcctggtcgataagcaggcgcctggcggtggtgctcaagtacgcccggggttcgcgaatgctggccacggtttcacgcgcgttcaagatgcgtgcaaaggtatcctgcgccaagtcggcggcgttctgccggcaacccagcttgcgccgcagccaggtgagcagccagccatgatgctcgctgtagagctgggtaatttcccgttggaatggcggttcacccacaggcataggcgtggctcgggcgttattgagaatggtttttaattgtgcagccaagcgctgggtaaacgcaatagactcgcgtttacatgagcagaagcctgtttttattcgggttaaccttgggtcaagaaaatatttaaaataaagtgcatttaaatcaagacattgcgaatttttggtgtatgatgccgcccacaccgaaacgaagggtgattagctcagctgggagagcatctgccttacaagcagagggtcggcggttcgatcccgtcatcacccaccattcgcttcaagtgttacgcgcagcggtagttcagtcggttagaataccggcctgtcacgccgggggtcgcgggttcgagtcccgtccgctgcgccatattcagcaacctggagcactgaacgccaggtcgccacagaaagcccgctcattgagcgggttttttttcgtctgtgatttgtttattcagcttttttcttgcgctgcgggcgccttgccaggtgctcgaagcagaaggatgccgtgccaaacacggcgattatggtcagtacgatcatgccgagggttgagctttccacggtggcttcctacacaatggtgggataggtcatcacggtagagacgggctgaaggccgctcaatagagctgacgcaatgcttacggcgcccggctggttgttacgcattctttatgtgtggcggccgctgctgcaggttgcctgccaagaaaaagataaacgattacggcagtgatcaaggtgaacgccgccaatagctgcaataaagtattgaatcccgaagcgtaggctgtgcgcaattgcgcgagtgggatctggcctacatgttgcagatcgcctatcaccaggtgttgcgcgatgttcgaggcagcgctggccgtggtgcccgcgctcaagtggcgggccaccagtgcacttaacaccgccatggtaatggcgagcgccacgccctcactggcaacgcgtgtagtgttgaaaacccccgccgccatgccggctcgctcctttggtgccacgcttatcgccatgccatccatcaagccccaagggattgcagtacccgtacctgtcagtagcatggcggcgatgagctgcccatgggtgttgacgttgctcatccaggcaaggcctaccgctgccattacaaagccgagggcgcacagtgagccggcgtgcagccagcgggtcagcgacgcggcaataagcggcacaatcagcatcggcgcagtcagtgccagcattgttatccccgcttggaacgggctggcgccctcaacgccaatcagacgaattggcagcaacacgatcagcacgatgtagcagtaacaggtaccaatcggcaggatctgcacgcccacgaagcgtgggagccgaaacattcgcagttccaacatgggctgttgcgtgcgcgtttccacgaggataaacgccatggcacacacgattgatacgcccagcagtgtgtgtatcgtccaattgtcccagccataccccggggccaggatcactgccgttgtgaaagcgatcagcaaaccggaaaacgtcattacccccagcgtatccagccgttgggcttgggggttgcggctttcacgcatgtttggcacggcgaacaccaatgagacgaccgccagcaggccagtgaaaagaaagatcccgcgccagcccagcgtctctatcagcagtcctgacaagagcgggccgaatgccaggccaacgccgaacgtggtgcccagcaagctgaacgcctgggtgcgggcatggccttcgaattcttgtgcgagtgccgccgaaccgctggccaacgccgcagccgcggcgataccttgcacgccgcgaagcaggtccagccaaacgaggtcgggcgctccagccagcagtagggaggcgcctgcaaaaacgctcatgccactgataaacaaacgcttgcgtccgtataggtcagcgaatgtgcccgctgccatcaacaggctgccgaaactgagcatgaaggcgttggtgacccaggccagttgcgtgggtgtggctgcaaatgcccggccaatggatggcgtagccactgctccgccggtgaagcttaagggcagcaccagcgctgcgaggcaaatcgcggcgagggtcacccgcgctggtcgtatagaggtgatcatgtctgttgtccttggaaaggtaacagtcactctattgaggatgtaatcatgaataaacaggcttatattccgatgataatggataaaaaggatgcaattggcctgtggacagccttagcggtgttatttcgttcgtaaaaacggccgaagcgctcagcttcattggggcggcccgtggccttggtatttccgcgtcggcagtcggcaaaaatgtcgccaagcttgaggcttcgctgaatgtacggttgctgcaccgcagcacgcgcaaagtcagccttactgccgaaggacagttgttctatgagcgctgtcgcaaaattctcgacgatctgcaagacgctcgcgccatgctcagtgacagcgtgcagcaacctcgtggccgcttgcgtgtgagcctgccgaccattggctatcgcttcctcatgccgcacatgcaggcgtttcgcgacgcctatccagacatcgaattggagttggatttcaatgatctgttggtggatgtgatcgaggagggctttgacgtggtgattcgcagtggcgccctggccgactcgacattgatgtcgcgcaggctggggcccttcaggttcttgctgtgtgcgtcgccgggttatttccagcgcaagggtaggccgcaggtggtggctgatcttgagcagcacgaatgcctgctgtatcgatttgccaccaccggtaaactcatggactggaccttatctgccaaccctgcgtttacccaattgcgcctgcctggcgtaatgaccttgaacaacatggaagccatactttcggccgcgattgatggccacggcatcgcctttgttccggacttcctggcgcgcgaggccttggcccaaggacggctggaaagtgagctggacgaccagtgcagcgaccaggggcaattctgggcgctgtggccgtcaagccggcatttgtcaccaaaaatccgcgtgttcgtggactttgtcgccgggcgtctatttcctgctttccccggttgatctatggcgcgttgcggctgtgccggtaatcgctgaccgcttcatacaccgccttgcgcaaccggttgatgccgccaatagggcggtgtgcttctagaccgaaccacggattgaacgactggttgtcgcaggccaggttctgcgcgggcgtgtcgaagtcctgggcggggattctgaccttcgccacggtttcataggctgcgtcactttccttccattcgatgctggtgtcttcgatgggcatgaacttttgcgggttctgccgctggatctgcaggacgaagcacgccgctacacggtcggtggacagttgttgtgtgagggcgctgcgcaggaagttcggcagggcctgattctgtttgggcagcacatagtccgggcagctttgcgggtctggcgcgacgcggaacttggcgttggccgcaccgaacttgtagggcgaaacggagaagtaggtggtctgcgtcgggctggcgggtgcgggcgccagggtggccagggcaataaacaggtggcgcacttgccagctgcgcgggtcgagcttggggaagaatgccaggaccttcttgccgtccgcctgcgcgccgatgttctgcgcatattccgctacatcgctgacaaagaaattcggatgactgaacatcacgaaatcctgctccgtgcgtgtttgctggtcggccatcagctgtttgccgggcacatccagcagcttgatcgccatgccgcgggcgtcgcggatgctgtcgaactgcgggtaggcgttgccgttggacaggcgcatggtcgcctcccaagtcttgcccggttcggcgaacactccctggcgcaatgctgggtcgagatcggccagcacactgacttcggctttcacgcagccatgggccttggcgtgggcatcgcgcaggtatcgggtgccttcgcgatgctggtcgacgatgcggactgcggtctggatgatgccttgggtcatggccgcttcacccggtgggatctgctcatccggtgacaccgggccgctgtggcgccaggcgaaccagagggtcgccagtagccaccccagcaagcccaggcccagcagccacagcagggttttgccgagaaaggcgccaaggcgcagccacaaacgagcgagcatggaacggtccttgttttgcgatcggataatcatggcagttgatgctccagcgggccgcccagcactttgaggtattcgagcagcgcccagcgttcctgcggcaacaagccacgaccgatgacgccattgccgcgcgcacctgcacggaattcgtggccgctgttgtggttaccggtgatccgggtatcgaacaggaaggcattcttgaaggcggcgctttcaaagcccaggtggcgagggtcgtaattgaaggtgcccttgtagaaggtggtgctgcgttcgtcctggggcgacagtagttggtagatcgtcggcaccgagccgttgtgcaggaacggcggggtggcccatacgcctgccagcggccgcgctttgtaggcacgtaattcacgtacgccgatgggcaggccgaatccgtccagttgtgggcgctccgttggggtcacgccggcagcgcggtaggcatgttcttcgacaaaggcagtgacgtaggccaggccctgggccacggacatgtttttcaggtccagcggcgcggtaggcgtggggtgcaattggacatccagctgggccagttcggccgggtcccattgcagggcactgaggtcgtagcgctggtcggcaatgttgctggcggtgccggggtcggtgccgatgtagtccacaggcagcattttcaattgctgtactgggcgcccgttttcctcggtaacagtcggtacgtggcagccagcgcaattttcggcgaagagtgcacggccctgggcggcgaggggtttgtcgatggcgccgaacaagtcttccggccaggttggcggcttgagccgttgcagggtttcttcgatcaggtgcaagtcgcgcacccgcacgctcgacgggtagcgggcatcgccctggagcggttggccagcactgtcgaagaatgccagggtcgcaccgacgccaagggcttcaccgatattgcgcgccatgggttgctgggccgagccgttccattgcacccagtcgaaggtccagatatcccacaactgcgggtagtccacaggcgcgtcggcgatgcggtaattgcctggggaaatggcgtcgccaaagcttgcattggcgatgcgcccaaaggcgtcagtgcggccgggaccttcttcggtggggtagaggccgcgatgggtgtcattccaggcgaccttgaggaactggtccagcgattgcttgaagtccttgcgcagttggtcgtgctgggcatcgtaccggtcacccaagactttgcgggcgaagcgctcgaacttccacgggttgtaataggtagcggcaaggctggcgaccagcgcctggccgaaactgccgccgcgcaaggtagggacgctggagggtaatacatgttgcgcagagccaccgtcgatgcgcagggcctggcctttgaagtgcagttcgccggtgtggcaggcggcgcaggtgatgtccaggtactgaaccttgctgtcggcgttctggtgtcgggcgaaacccactggcaggttgcctgggttctgtgtggtgggaagctgcttggggtcgaccaggaagccgaagcgcgccaggtactgcggcgcggcaaagcgttgctcggagaacggcaactccagtgcggtgaaccagtcgtagtgcaggccttttacctgggtgccctggggcgtgaagtaatagacctggcggtcagcggcactccattgatcctgatagtgcacctgctgcactggcacgtagtccggcagcttggggttaatggtgtaatagagcaccacggccaggatcaggccgagggcgatgagtatcaggagtaaaacacgggaaaaaatgcgcaagataactatccttgtcgagttgtcgcattgttatgccactacaccacaggtgcggcaagtagccagtagtctggttgcaggcgcccccacgatccgtcgcggtgctccataatgaatgaaaatgcttttaaacacgtgaacttatcggaagtttcctgctcacatgccggtagccattggtcgtggccgcctgataagctcgcgactttattcaaatgcccttttggcgcatgaacaaggaaatagcatgaaacagcatcggttggcggcggcggtggccctggttagcctggtacttgcgggttgtgattcgcagaccagcgtagagctgaaaaccccggcgcagaaagcttcctatggcatcggcctgaacatgggcaagagccttgcccaggaaggcatggacgacctggactccaaggctgtggcccagggcattgaagatgccgtcggcaagaaagaacagaagctcaaggatgacgaattggtcgaggcgtttgccgcactgcaaaagcgtgctgaagaacgcatgaccaagatgagcgaagagtcggcagccgccggcaagaaattcctcgaagacaacgccaagaaagacggcgtcgtcaccaccgcttccggcctgcagtacaagatcgtcaagaaggccgatggcgcccagcccaagccaaccgacgtagtgactgtgcactacaccggcaagctcaccaacggcaccacctttgacagctccgtggatcgcggtagcccgattgacctgccggtcagcggcgtgatcccgggttgggtcgaaggcctgcaactgatgcacgttggcgagaaggtcgagctgtacatcccgtctgacctggcttacggcgcccagagcccgagcccggcaattccagccaattccgtgctggtattcgacctggaactgctggccatcaaggacccagccaaggcagacgctgctgaagcacctgctgcaccagccgccaaaaagtaatcggcgcctgaacagacaacgccccgtctcgacggggcgttgttgtttctgccggttcagttttgttgccgcagagctaagtgtggcgggcaagcttgccctacagttaaatccgatagaacccacggcagcggaaacagtctgatataagactcgagcacgggtagccgcacgcgcatgccaagtcaatgaaatcttgggttttttttatgtgcgcaaaaaacgcccgatctgactgcaagccttgtagagcgtggctttcagccgataaaacaggctctgttcacaaggttatccacaatttgtgtggataaccttttatatcgcctggaactggagtgaccgatgaaaccacccttcaatttcacccgtttcctgcctatggcggctcgtctgcttggtcgggggcgcttaccgaccctgctgtttgccgtcgccgccaaaggctcaagccaaggcaaccggctgggccagctcaaggatgatctcaaattgctccaggccctgtgcctggcttactggcgcggcgaataccgggcgatcagccccaaggcgctgatctcggtggtggcggggctgatgtacttcctcagcccgattgatgcgatcccggattttatccccatgttcggcatgctcgacgacatcgccgtgctggcatgggtcatgaagaccctgagcggcgaactgagcgcctttcgcgcctggcgcgacgggcagcgtccggaaaaactggcggtggttgagcgcctgcctgcaacgcctgaactgctggcccaggaaaaaccgcaaaaaaactaatgatgctgggtatcccctacgacctttgtggctgttaggattacacttctaaggaaagaacttacttagtaagtgtttttatcctacggggcagtcatggatatccagatcatttcacgcaatggcgaacccgagtatgcggtgttgccatgggaccagtaccaggcgctgctaaaagctgccggtcagcagcaacctacactcgctccttcacctgtcgcccccatcgtcaccgatcaggacctgcgcccgcttgcagacctgcgcggcctgcgtgaagccaagggcctggcgatcgaggccttggcacgcacggtggggatcagcccctcgtatcttggattgattgaaagtggtgaacgccagccggatgccgccattcgccgcagcctggcctgggaattgggcgttgcaggttggagggatgagtcttgagcctacgtatcagccgtcagcactgggatgggttactcaatgaactggaccaggcacgtcgccagcgccatttgctgacgtaccgtgcgctgctggagcgcctgcagttcccgacgccagccatgcagaccctggccgccgccctggaacatctggcggcgctggatgccaaggccgagcagccgctgcgcagttcactggtgataagccagggtgccagccgcctgccgcgcaccggtttctttgagtgtgtggagcggctggggcgtttcagcgggccgtccgatggcgtggccgctgcgtcctggcatgcttcggaagtggtgcgggtgttcgagtacgagtacccggaatctgccgaggcctaaagcgcctgggggactctgtccatgctgtcgatcacatggatgctgtagcccgccacatccttggcatggtgttttgcttgtgaggccaactccgccagctggctggcatctagccgctcacaggcttgtgggtacagatgcaccacgccaatggacagcgacagcagggcgaactcctggcgcacgccctggcggttgagtgcgacaaagcagccagcatcaacgtgctcggggcggtaaaagcgtcgacattgggtgtggaagtcatccagcaactggttaagccgcttgcgccagtcttgcgggcccagcaccaggagaaaatcatccccaccgatatgcccgacaaagtcgcggctggggtcaacccggtcgttcaggcactgcgccagacatagcagcacttcatctccacgcccgtagccgtaaatgtcattgaacggcttgaaactgtcgatatccacatagcagatcaccgactcgcgctgttgctgcaacagtcgcgtcaggcactgctggatcggcacgttgccgggtagcaaggtcagtgggttggcgtaacgtgcctgctggattttcagttcggtgatcaacttgagcacatcgatgacccgtcccaagcccaggtaatcgccgttcaaggtgatgatgaaatcttcttcgatgcgctgtcgcgcgcgactggtcagcaatcgactgacctgttgcaaggactggctcaactccaccgccaggaagtcactgctcatcaagcggctgatgggtttgcgcgcgaatagatccgttgcgaacggcttgagcagcgcgtccgacaacgaatgccgatgcacaataccgaccgggcgaccgcagccatccagcaccgccagcgaattgaggttagcctggcgacggaacgattcgagtacttgggccgtggcagtctcttgatccaccgctggttgctcattgagcagggcactgaggtcactgccttcgtcattgagggcagtggcggcattatcgagtttgggcagcatcaggcgcgcttcctgaggcggatgctcctgcgggcggcagagcaggtaaccttgaatcaagtcgacacccatctcggtcaacactgccagttcctccggtcgttcgatcccctcggcaatcacttgggcgcgggatgccctggcgatctgcagaatcgagccgacaaattcgcgcttgagtgcgtcctggtgaatgccgtcgataaagtgccggtcgatcttcacgtagtccggacgtagctccgaccacaatcgcaggctggaataaccggcacccaggtcatcaagggctatggcaaagcccatgtcgcggtaatggtgcagggcggtttgcagcagggcgaaatcatcggtgggcgtctgctcggtgagttcgatcaccacctgactgggcgcaataccgaagtcgcgcagcagttgcagggtgcgccccggctgatgcgcagtctccatcaaggattccggcgagacattgagaaacagcttgcccggcagtttctgatcactgaaacgccggcatgcactctcccgacacgccatttccagctcgctcaggcgcccggcctggcgggccacgcagaatagcgcgacgggggagtgcagggggctattggacgggccgcggctgagggcttcgtaaccgagaattcgccgctgcgacaagcaaatgatcggttggaacaggctgtgcagactgcgttgagccaggattgagcccaatgcattcagctgttcgttcatggtcatagcgatctcgatcgaaaaaaaaggaccgcaggcataaagcctgcggtcctttcatttcacgacagaatgatgtctatatgatgacactccatggagcgctcacattaaattgccatcatttactgcttggccacctgcttagtgattttcaggtaatcgagcaggatccggccggtttcggccaagtaggcgtcatcttccggcttggttttatcggcttcggccggcagtgcgtcttcatcttctttcttcagctctttgagcggatcttcacctttggccttgcggcgggtgttttccagcaccagttgctggttctcgatgctggagtgctgtgcacgacgatccgcttcgttgaggctgacggttttctcttccatcagcttcttggccagggccagcttgtcacggataaacacgaactcggcatccttggcggagcgggtgtcgtggtcagccttcaactgcgccaggaacggcttgaaagggtccgacgccggcttgatcgcagggcggatggtgtcccacggcatggcttcaggcagggcgctttcgccgatttccttggtgtcgatgatcgacgggaaatcgatatccggcagcacgccctggtgctgggtgctctgcccggatacgcggtagaacttggccagggtcagtttgagctcgccatggttcagcggctggatggtctgcacggtgcctttgccgaaggtctggccgccgatgatcaacgcacggtgatagtcctgcatggcgccggcgaaaatctccgaggccgaggccgagagacggttgaccagcaacgccatcggccccttgtagaaggcgcccgggttctcgtcttccagcacgtcgacgcggccgtcagcgttgcgcaccaacacggtcgggcccttgtcgataaacaggctggtcagctcggtggcctcctgcagggagccgccgccgttgttgcgcaggtcgatgaccacgccgtcgactttgtctttctgcagttccgtgaggattttcttcacgtcgcgggtggtggacttgtaatccggatcacctgcacggaaggccttgaagtccaggtagaaggccgggatttcaatcacgcccagcttgtagtccttgccatcctgcttgaggttgaggactttcttctgcacggcctggtcttcgagcttcaccgcttcacgggtgatggacacgatcttgctggtctggtcgttcggtgcattggtgtgcggaataacttccaggcgcactacgctgcctttcggtccacggatcagcttgaccacttcgtccaggcgccagccgaccacatcgaccatctctttgtcagcctgggccacgccgatgatcttgtctgccggggcgacctgtttggttttgtccgccggacctgccggcaccagacgtacgatcttgacctggtcgttgtcgctttgcaggacggcaccgatgccttccagggacagactcatgttgatatcgaaattttccgcgttatctggcgacagataattggtgtgcgggtcgtaggacatcgcaaaggtgttgatgtaagcctggaagatatcttcggcacgggtctggtccaggcgcgccaactgattcttgtagcgcttggtcaacagctcctgaatggccttgggctctttgccggcgatcttcaggcgcagcacttcgtccttgacgcgtttgcgccaaaggtcgtcgagggctgcggtgctggtcagccacggagcgtccttgcgatccaccagtagggtttccttctgggtgaagtcgagcttgtcgatgcctttgtccagctcacccaaggcgaagtccagacgcgccttgacgcggtccaggtaacgcttgtagatggtgaaaccgggctgcaggtcgccactcttgaggaagtcgtcgaattgcgtcttccatttgtcgaactcagcgatatcgctggccaggaagtagctgcgcgacggatccagcagcttgaggtagctgtcgtagatgatcaccgagcgagcgtcgtccagcggcggcttgctgtagtggtggcgcttgagcaactcgacgacgttgaggctggcaatcacctcatcgcgatcaggctgaagattgtcccagctgttggctgcgaacgtattggtcgacatcgacgcgaagccgagaccaatgaaaaaagctaaggcggtgctggggaacagatgcttcatgctgattcgacgcgggggcaattgataacgcatattaggccgtctttgagggagccggttccatatggtccggtcgcataatgcaaaaagcccggcactactgctacgggctcagtccagactcactatggaggcacagtgagagcattgcaaggcgttgaggggcatgtcgagtggtgtaagagcttggtcctacatgcaatgtagggcgagttcgtgttgacgtgatggccgcgggtactcatcgcgctgaatattcccgagttgtcatgcgacccatgtgggagggagcaagccccctcccacatgtatatatcgaacagttcagacccaatgatggatcggccagccggcctgttcggcgtgggtgcgcaacaccgggtccgggttcaccacctgcgggtggtcgaccttgagcaaaagcggcaggtcattgcgcgaatccgagtagaaatacgcgccctccagggtttccccttcctgctccagccattccagcaagcgcgtgatcttgccttcgcggtaagtcagtacacccacggtacggccgctgtacacgccgtggccgacgtccaggttaatccccagcacttcgtcaataccgatgcgcgccgcaatcggcgtgaccaagtgagtgcccgatgcggaaatcaccaggatccggtcaccattcgcacggtggcgggcgatggtcttggtggcgtcgctgtagatcagcggctcaatcacgtcttcgacccagggctccaccagatgatcgatctcttccggggtgcggccgatcatcggctccaggctgaagtccatgaagtcttccatgcgcaactcgccacggctgtaggcgtccatcaattcgttgttcctgcgcatgaacgactcagggtcgacccagcccaggcggcccatctgttcgctccacagggtggcgcagtcgccgtggatcagggtgtcgtccagatcaaaaattaccaatgccatccgtcatgttctctctcaataggtcgctgcctgtcaggctacttcacacagggcgctggggtcgatggaaagtgccaggcgctggccgtccgggtgcaggtcgtcggccgagcggttgagcacgtccaccaccagctctacaccgcgggcttcgatgcggtagcggatcacgttgcccaacaggctgtggctacgcaccagcgcatccagttcgccattgcggctcagctcgatggcttccgggcgaatggcaatacggctgttgatcgggcgttgcagcagttgagtggccttgtcggcgtccagcaggttgtagttgccgataaaaccggcggcgaatgcatccaccggcgcagtgtagagcgtctcggcatcgccgctctgcacaatcttgccctggttcatcaggaagatgcggtcagacatggtcagggcttcttcctgatcatgggtcacgaagatcgtggtcagccccagctcgcgctggatctggcggatctgttcgcgcaagtgcttgcgaatccgtgcatccaacgccgacagtggctcatccagcaacagcaggcgcgggcgggtcaccagggagcgggcgagggccacacgctggcattggccgccagacatctggtgcggatagcgaccggccaggtccttgagctccaccagttgcagcacttgctgcacacgcttgtggctgtcgtcggcgttgaccttttgcatgcgcaggccaaaggcgacgttctgttccacggtcatattggggaacagcgcgtaactttggaacaccatgccgatatgacgtttctgcgggctcaggggcacgatgtcctggccatccaataggatcttaccgctgtccaccgaggtcagcccggcaatgcagcgcagcagcgtggacttgccgcaaccggacgggccgagcagggtgacgaactcgcccttggcgatttcgcagttgatatcactgaacaccggggtaccggagtagcctttttgcagatgttggacgctgacgaagctcattggcttttgtccttgttcaagatattggcggcccaggtcagcaccagcacgaagaaaaaataggaaatcaccacggcgctggtgaagtggccgctgctgttgcgcatgttgttgaggtacacctgcaaggtctcgtagcgggtgccgacaaggatgttggcgaatacgaactcgccgaacaggaacgagaacgataacagcagcgccaccatcaggcccttgcgcaggttgggcagcaccaccaggatcgcggcttgccaggtgctggcgccgagcagttgcgaggcgtccatcaggtcgcgcaggttaatggcctgcaggttattggtgatcgcgcggtacatgaacggcagcgccacggtgaagtagcagccgatcaggatccatggcgtgcccaccatcgctaatggcccggagccatatagttgtagcaggcccaccgacgacaccaccggcggcaccgcaaagggcagcaggatcaggatgttcatcagcgcgtcgagcctggggaagtggtaatgcaccacgaacagcagcggcaggatcagcaccactgagagaatcagcgcgcccacgcacactagcaatgattgcccgaatgccatcaggaagcgcgggtcgctccacagctgtacataccatttcaccgtgaaaccggcaggcaggatggtggctgaccaactgctggcaatggaatacacaaaggtgccaatcagcggcagcaccaggatcaggaacaacaggtacaccactacccgatggtagagggtggccgggccggcatcagcgcgtgacatggtagctcctcttgagcagcagttgatggaccacggtgaccaccgtcatcagcgctaccagcaccaccgccagggcgctggccatgttcgggtccagcgacacatcgccggagaccaggccggcaatgcggatcggcagcacgttgaagtttcctgtggtcagggcatacaccgtggcgtaggcgcccagggcattggccagcaggatcacgaaggtgcccagcagtgccggcgtcagcaccggcaacccgatatgccgccagaactgccagccattggcgccgagcagggcagccgactcacgccagtcttcgcgcaatgcgtcaaaggctgggtagagcaagagcacgccccccggcctgcttgagcatgatggtgatgctgccgttgaaccccagcaggatgatgaacgcgaaggccaggggcacgccggagaagttgctggtcatgttggcgaacgcggtgacgaagttgcgcagtggcgaatccacccggcgcagggagtagctgcccagggtggcgatgatgatgccgaagatgctggagtagaaactgatctccaggctgaactggatcgcctgccggtagaacttcgaagtaaagatgcgggtgaaattttccaggccccagccggactcttcggtctgcaggctgttgatcagcacccacaccagcggcgcaatctcgaacacgataaagaacagtgcgaagggcaccaggcagagcagggccagccatttgccgcgggtcattgaattcacttgagcagctcccggcacacaggtttgtcgtgtagtacgccgagcagttcacacaccgtgccgcacaactcggtctgtttgggcgcggcattgctgtccaggctgaatccgtcgccgagtacaaacagtggtacttcgcgctcttctggcaataggccattgtgggagcgatcgttgttcatgccgtggtcggcggtaaccatcacctggtagccggcgtcgagccaggcttgcagatagtcggccaggatgatgtcgaccgagcgtgcgctgttgcggtattgcgcggagtcgaggccgtgcttgtggccggcgtcgtcggtgttcatcgggtgcacgagcagcaggttcggggcgtgcttgagccgcaggctttcggcatcggcgaacaggtgggaatccgggtaatggtcgtgccagtagaaatgcccatgctggatagccagcgctttgtcgtcggtgtggcgatctcgggcggcgagaaagggcgtgcggttatacagctcactgacccaatggtaagccgccgctgccgtagtcaagcctgcatctgtggcgtaatggaagacgctgcgctggttggacaggcgcgagacgttgttgtgaacgatgccgctgtcgatcggcggcacgccggtaaggatgcattcatacagcgggcgggacagggcgggcagttcacattccagtgtgtagagggctgcgcgtcctgcgccgacataggcctgcaagtgccccatggcgtgcctggcgacctcgaagttcaggccgtcgagcaccacaaggatgatattgtgcttcatgggggagagcgctccgcagcaatagactcggctaaattcccctggaggaacgaggtcaaaaatgtgggagggggcttgctcccgatagcagtcgatcaggcaatgaattgtttgaatgacacaccgctatcgggagcaagtcgaatcgtcgcaccgcccctcccacaaaagccccattccacatggggctgcaaagtgggctggtggcttatttcatttctacgatgacctgctcgttccacagctgcggcagcttcttggaggtcgcttcccaggcatcggcatccttgatcggttgcggattggccttggtgtattgctcgcccgggatcaggttcttggcgatgtcggccggcagtttcaggtcggtttcagcgcggataggacgggcattgcccttcgccaggttaagttggcctgcatcgctgaagatgtactcgcgggtcagcttcgcggcgttcgggtgcttggcgtatttgttgatgatggtggtgtagccggatttcaccgagccatccgaggggatcaacaccacgtagtcatccgggttggccatcttggccttgtagctcaggccgttgaagtcccagacgatacccacttcgacttcgcctttttccatggtggcgatggtcgggttggacagcgagaggcgaccttgctgggcgatcttggtgaagaattgcaggcccggggcaatgttcttctcgtcgcccttgttggcgatggcggcggcgagtaccgcgttggacgcctgggcggcggtgctcacgtcacctaccgacaccttgtacttgccggtctgcaggtcagcccaactggtcggaacctcggagccgtgcagcagcttcttgttgacgataaaggcaatggtgcctgtgtaggccagggcccagtgaccgtctttgtctttggcccagtccggcacctgtgcccaggtagaaggcttgtacggctgggtgacttcctgtttcaccgcgatggggccaaaggccgcgccaacgtcgccgatatcggcactggcgttgtctttttcggctttgaacttggcgatttcctgggccgaactcatgtcggtgtcgatgtgcttgaggccataggtgttggccaggtctgcccaggtacctttccagttggcccagtcatcgggcatgccgacgctgttgatggcgccttccgctttcgcggcggcttcgagcgttttcaaatcggtatcagcggccatggcggcggtgcacatggcaatggtcgagcctaacagtgatgccaggaaaagctgtttcatccgaagctcctttgggcgttttcaacgcggcgttttatatgaacgttagcggtggtttggtctaggtcagcaatacctgagccaatctaggcccgatggatgacagtttcatgtcgatgtcgttttcaaagcgctgatgtcgctcagcgcaaacttagcgtagaccatgcccaagtgcccgcaggccctggacttggccgatgtattgcagggtgtggtaggaaaggctacgcccgctgtcatctgtcggtcatctgtaatgcctaggctggcacgcaacagcaaaagcccagatagcgcacgttctgtgcacccgaacggtgctggtctagtccaaataggtaacgttgatgcgtgatgaggcaatcaaggcggtaacctccattggcctggcgctgcaagagcagatcgaccatggcctgttgccgccagccagcaagttgcccgccgaacgcaagctcagcgagttgtttggtaccactcggattaccgtgcgggaagccttgttacagctggaggctcaagggcagatctatcgcgaagagcgtcgtggctggttcgtctcgccgccgcgactggcctataacctgatgcaacgcagccactttcacgcgatggtcagcgaccaagggcgtgtggcctccactgaagtgatttcagcgcggctgcaaccggcgtcggcggcagtgtgtgcatggttgcaattgccggcgctgtccagcgtgatccagatttgccgcagccgcaggatcgacgggcgtctggtgctgtacgtggagcactacctgaacccccggtattttccggggatcctggcgtgtgatttgaatcagtcgatgaccgagctgtatgcgcgcaagtacgacttgcactatggacgggtgcgctttgaaatcgtgccgacttccctgccagtggaggccgccgccgcgttgcgcgtgtcggtgggcagcccgggcttgcgcatcgcccgggtcaactatgaccagcaccagcgcctgatcgattgtgacctggagttctggcgtcatgatgcgattcatgtgggggtggatgtcatggcgtcagcgtcttgatcacctgatccgcattggtttccaactcggtcacagggtcggcaccgtccacattcaacaccagcagcgtggagccgccggcagtgacagccgctttcaccgtctcacttggttgacggtggtgcagcactatcaccacatcgttgtccttcaagtcggtactgagtttttgcagcgcctcaggcgtccaatcgccatcgggtcgcgcatcggtgctgaccagttccaggttcaagctgctgaccaagtaggcaaagtgatcgctcaagctgaccacgctcaggttgtcagcttttgccagtcgcgcctcgctgtcggcgttgagcttgagcagacgttgcttgagggcggccaggttggcgtcgatcttcggtttggcgcccggtgccaggcggctcaggtcggcggccatcacatcggccatgcgccccatattgttgctcgattgccagggttgactgttcaaaccatcggcgccgccgggttgcacggcgatccctggcaagccgccgtctaccgggcgtgcggcatccacttccacgatacggatattgctgcgacgcgccaccgggtacagcgggtcatcggcccacagggaacgcaggccgatggcggcgtcggcgtcctgtgccaaggtattgagtgccgcagcaccgcggccggtgaaataggacacctgccgcgagcctggcaggttggcgggggccgcacgttcaagctgcacgtcggtgcctttgagcagcacttcggccaagccgtaggtgatgggcagcgaggccaggaccttgaccggttttatcgacttggccttggtcagcgcggcatggccgaggccgtggttggccttgaattcctttggatcgaaaccatcaacggcggccagcgccgaagtactgatcaagcaagcgatggccagggccattgggcgaaagacagggcgcattatccaagattccctttgaggctgggcacggtgccgcgggcaatggcggcgaaggcaaaggcgataccggcaaccaggatgattgcggcgccggacgggatcggcaggtcgaagatgatcggcagcaggatcccgcacagggtgctgacggtggcgatgacgaccgacacccagaagaaccccttgagcgactggctcaacaggcgtgccgcggcggccggaatcaccagcagcgcaccgaccaggatcgcgccgatgaccttgaccgccgcgacggtgatcagtgtcaccagaatcacgaacagataatccagggttttcaccgcgacaccacgcaccgccgccaactgcgggttgaaactggcaagcatgatgcggttgtacagcggcaacgccagggccatcaccagcgaaccgacgattgccaataccaataagtcgttgccattgaccgtcagcaccgagccaaacagcacgttctccagaatatgcacattgatcttgccggccaggatcagcagcaggctggcgcccagtgccagggacaccgacaggaacacgccgatcagggtatccggcgccaggccggtacggttgcgcaggtagttcagcaggatgccgaacagcaggcagtagccgaacaggctgccatagggcccggtgtagggttcgccgagcaggatacccacggccacgccggtcagtgcggcatggccgaccgcttcggagaaaaacgcaaagcgcttgaccaccaccagcgtacccaagccgcccagtaccgggccgatcagcaaaccggcgagcagggcgttgaccacaaacccgtaggccagggcttctggcaggtaaccggaagaggcccagccctggaccatcaggcgaaaggcttcataactcattgcgccgcgctccgagggtgagtggagaacagggtcagcaggcggtccggggtcagcgcttctttaggcgtggcgtcgaacagcacacggcggttcaggccagtgacatggtcggccaggcggccgacggcttccaggtcgtgctcgatccacagcacggtgatcccggccaggcgccagtcattgagcaagcgttcgaagacctggatgccggcttcgtcgagggccgacatcggctcatccaacaccagcaattgcggcgccgggatcaggccctgggccagtaggacgcgctggcgttcgccaccggacaacgcgcccatgcggcgcttgcgcttgtcgtgcatgcctacccgttcgagcgcttcgccaatggcggcggcgtaatgcttggacaggcccaggaacgccgggcggcgctggcacatggcggccatgaaatcatccacggtcatcggcaagccacggtcaaactccagtgcctggggcacataaccgatggtgccgggcgtggtcggccactccaggctcaatcggccctggtggggcgtctgccccagcagggtcttgatcagcgagcttttgccgccgccgttgggacctaccagtgcgtggatgctgcccggctgtacctggaaacttacgctgtcgaggatcacggtgcggccgagggtcagcgatacctggtcgaagtccagggtcggaccgacgctgactacgttcagttgctctgccgccgtcatgcccccgactcctggatcgcacggaccacggtgttgaggttgccggtcatttccacttcgtacttttcagcgctgtattcgccataggaaatatgcgacagcgggtacagcttgactccggattcacgctggatggtgtcaacgtaggtggacgggaaatccatctccgagaagatcaccttcacatccagggcgcgcagctcatcgatggttttcttcaactggctggggctcggttcgataccgtgggccggctcgactacggcggtgacttccaggccgaattcgcgcagcaggtagtcgtaggcggcatgcaccgttgctacgcgcaggtccgggttgggggcgctggtcagcttggccagggcgtcggcgcgcatctggcgcaggcgcttgccgtaggcgcgggcgttctgggtgtaggccttggcgttgtccgggtcgagcttgcccaactcgcgggcgatgttattgacctgggctatcgaggcactgatcgacaggaaggtgtgcgggttgaccaccttgcctgcgccgcgtgcggcattgccggtcgcggccagcagcggcacgttggcgttggcttcgatcaccgggatgtccgggcgctcgctggtggcaatcatgcggtcggcaaagtcgtcatggccgacgccgttgagcacgatcacatccagcgtgccgatgcgcttgatgtcttcggcgcgtggctcgtaggcatgggggttgaagccggccgggatcagcggcaccacctcggctttgtcgccgacgatattggccacatagctgtaataagggtgcagggtgatgccgatacgcaggcgctttgccgcatcggcattcgccagcggggcgagtatcaggctgagaaagctgaccagcaacaggcgcaacaggggcgatgaaatagacatgggcaatcggtcttctcgttcagtgacggtgctggcgagtgacgccggcatcgaattgcgcgaccacttgctgccagccggccgcaatcagcgcctggtcagtgaggtcggagggggcggcgaggttggcgctgcggttgagccagatatccggctcgttgccctgcacgcgcatcagcagcgaaccgctggtggcgggtgcctggctcaagccgaggtaggcggccggggccaacagctgccagcgatggtcgccacggctgaccgaactggcatcctgggcaaagggcgcgaagccttcctcggccagttgctcaggtgtcggtagggcattttgctcctgttgcaacaggtggatttcatccagcgtcacccgcaggtcggcatagataccttgttcggcggcgctcaggtcgcggcgggcgtccagctggtggcttggcactgccgcgactgcctgggtttcaccgtgcagcgccaccaccgtacccgccaccgccaggatgatcaggcacaacagcagcacgtagagggtttcatgacctgcaccggcggggcgtacaacctgtgtggtagtcattgcgcctggatatccgcttggtcgatttccacgacgtggccggggccggcatcaaacagcacatagaactcggcagcaggcttcttgaacgtcagggttgaatcctctccgagcttgcccggcaccaggatggtctcgtcgtagccgatcacatccagggtcacaccgggggcgccgctgccgtcggaaaagccgcccttgcactggatctgctcgccggggatttccttgcattcgcacatcgggttgtgggcaaaggcggtggtactgaaagcggcgcacagcaacagtgcggcgcggctcaggcgcttgaaggtcatggtttgactccttgcttgttcagccaggcaatggtggcaggcgaggcctggctcagcgggatggaaccctggtgcatgctgccgtcccaaccttccatggtcacccacacttcggcgtctaccggtgtgcgttccggcaccggaagggcggcgcccatgcggtacggcgtaccaaagaagatcaccccggcggcgcgcaggctgcgcggcttgccgatgcgcaggtaggtggccttgacctgattggtgcaggtgtcacacagggcggcattgaataatttcatcggtccggcagggtctggccgtgggccttcattgcgcagctcggcgagggtcaggctccacgggccgacttgcacttgcccagccacgcgctcgccgataccggtatctccgcgaaacagcgcggcatcggcgaagtacttgggcatgaaccccagtggcacgagcaacagcaggatgttgatgtggaaacgccatttcagccagaaggcgcgcaggggggatggcggtacagtcgcgaccttgctcatcgctgggcctccgaggtttcagcctgcatggccgggatgggcgcgggttgccgctgggtcttggcttcgcgcttgagggcgttgagggtggccagggcggtgcgcttggtccagatcagcaagccgctcagcaccatcatgctcagcaccaggccgaagaatgcccagatcaacttgatccacaagccgccaaagtcaccagtgtgcagcgggcgcatggattcggtgacgaactccagcgcggtacggtcggacagcaggttcgtgacggcgatttcaccgtcataggggttcagttgtgcggtctggaacatcagtgggtaccagccccggccgccaatctgcaaatgactgtaggcgttgaacggcaggaccaaaaaggaggcttccagcccgggaatgcgttggctcgcaatcttgattgcgtcgtccagcgcaatcatcggcgcgggtacgccaggtgcagaggttggtactttctcgcgggcgatcaccggcacgaccggctcgctggagatggaaatctggttgtcacccaggatcgcctggatcaggaaccaggtgccggtgatggaaatgaccgcgataaaccagatcgaccagataccgctgaggcggtggaagtccccccagaaaatacgcgcaccatggcgaaaacgcagggttggcttgaagaagcctttccagaaacgcttgtacaccaccaggccggtaaccagcgaggccagcagcggcaagccaagcaatgacaccaggtaccagccccagctgtagccgttggtgaacggcaccagccaccagccatgcagggcacgggtgaattgctggaagttgaacgacgggctgatgccctgtatcgctccggtataggggttggcgtagacctccacggagcgtccatccgggtagctgaggtcgacactcagggcgaagtgcgattcatccgggcggctgatggattgcacgatagcctggggttcatcgcgattgatggcggtgatcacctggccaaagctcagcggctgggcgtcatctgacggcttgctcgcacggatatccgggttggccagccagacgatttcctggctgaccaccgccagggtgccggtaacgcagacgatcagtacaaagaaccagatgggcaatgccagccagctatgcacgagaaaccagagtttggagcgtgacttcttcgacatgattaatgagggtcttgatcggagggggcaatggaggcccggaaaaggccagtcgtagcttttgctgacgcgacgggctgtatctaaattaagacggatgagaatgagaaatccctaaggcatatatgaaagtaaatgtttcaggttcacattcaggtggtatggaatcgttgatcgaacacgaaacatgtttcatgcgatcacccagtcgccattgatggggcagggcggctggctaggatgggcggaccccgtcgagcgagcccgcaataaaatgactgccagaaccctctacgacaaacacatcgattcccatacggtgtgcgccctggatgaccaaggccatgtcctgctttatatagaccgccaggtaatcaacgaatacaccagcccccaggcgttcagcggcttgcgcgaggccgggcgcacggtgtggcgccccggcacggcgctggcggtggttgaccatgtgaaccccaccactcccacgcgggtcgcgaccatgccggatgccggcgcggcgcgacaggtggcctatcttgcagaaaactgccgggatttcggcatcgaactgctggatgtcctcgacaagcatcaaggcatcgaacacgtgatcgcgccggagcaggggtttatcctgcccggtatggtgattgccgccggtgacagccacaccaccacttacggtgccttgggcgcattcggctttggcatcggcacctcggaaatcgagcatctgctggcatcccagaccctggtctataaacgcttgaagaccttgcgggtcagcgtcgacggtgagctggcgccgggcttgacctccaaagacgtgatcatggcgctgatcggccagatcggtgcttccggcgccaccggctacgccatcgagttccgtggctccaccattgatgccctgagtgtcgaagcgcgcatgaccatctgcaatatggccgtggaggccggcgcccgcggcgcgttcatggcgccggatgacaaggtgttcacctacctcaagggcaagcctcgcgcaccccggggggcgctgtgggaacaagccctgcgtcaatggcgcacgctgcgcagtgacgagggcgcggtgtttgaccgcgaagtccaactggatgccgccaccctggaacccatggtcacctggggcaccagccccgaccaggccgcgtccattggcgcccgcgtgcccgacccgcagcacgtcagcgatctgatcctgcgccagggcatgcgtcgcgccctcgattacatgggcctggaacccggcgtgccgctgagcgatatcgccatcagccatgcatttatcggttcctgcaccaacgcgcgcatcgaagacctgcgcgacgccgcccgcgtggtgcgcggtaaacaggtggccgatcatgtacgcgcgatgatcgtaccgggctccacgcaagtcagggaccaggccgaagccgaagggctggccgcgatctttatcgccgctggtttcgaatggcgtcagtcgggctgctcgatgtgcctggcgatgaacgacgacgtattggcccccggcgaccgctgtgcctccagcaccaaccgcaatttcgaaggccgccagggcgcgggtgcccgcactcacttgatgagcccggcgatggtcgccgctgccgccatcaccggccggctcaccgatatccgtgaccttggagagcgcccatgagcctgcaacccttcaccctggtcactggcaaagccgcaccgatgctggcggccaatatcgataccgatgtgatcatgcccaagcagtttctcaagggcatcgaccgcgatggcctggaccgtggactgttttttgacctgcgttttttgccgtccggtgcaccaaatctcgagttcgtgctcaatcaaccggcctggcaaggcgcgaactttatggtagtggggccgaacttcggctgtggctccagccgcgagcatgcggtgtggggcctgaagcaaatgggcattcgcgccttgatcggcagcagcttcgccggaatttttcatgacaactgccagcgcaacgggctgttattgatcactctggaacaggcggtgttgcaccggcttgcgcaaaccatcagtcaagcagaccaggcgcagatcagtattgaccttgaggcccagcagattcgtctagcggatggccagttgatcccgttccagatcgacaccttgcgcaaaacggcactgttattcggcctggatgcaattggcagcaccttgcagcgcagcgagcagatcaaggcatttgagcgccagcacctgacgacgaagccctggctcggttgacaccgggtgcttcgtcgacttaagtgggaccgacatgggcgtcggctcactcaaggaaagttcgtaacatggatgtgctgaacgttgatcttcaatcgaccctgtcgacccgcaacgcacgcctgatcatctttgcccgcggcgtgtcggatttcggggcgttcctcaacatggtggcattgtccacttatgtgtattggctcagtcagagcgtggtgtttgtcagcatcttcctcgcctgccgggtcaccggcggcattgttgccagcctgtttggcattccgttttttcgtcggtttgccgggcgcggcacattggcggggctggatttggcgcgggcattattgctgacgccgctgctggtgttgttaccggcccatcaactcacgctgttgccctttatcgcctttggcctcggcctgtgtaattcgctgttcgccattggcctcaacagtcaattgcccacctgggtcgcccttgaacagcgggtaaataccaacgcatggatcacctcggcggctgccaccggcgcggtctttggcagtttgctcgcaggcttgctgatcgctacaggtggatttgaagcggtgtttgccgtcaatatcggcacctatgtgattgctgcttgcctggtcttgcccctgtgtgccttgtatagcgtggccgttgcggcccatcgcgggctcgccgccgaatggcaggcgctgaccaaggggctgcgtggcgcgccggtgctggccgtcatgttgctgatcagcatgctcgatacccttggcagcgcagcacataacgtcggctggcccgtgctgtcgcagtatatttccccggacacggccaagacggtcatgggctatctgctggccgtgtgggcctgtggcaagtttattggcgcgcgcatcgccagcgcggtgttgaaaggctgtggaacccaaggcatggagcgtttgttcatgctcggtgtggcgttgatgtccagtggctttatcctgactttccaacagaccgaactgtggctggcattgttactggtggtgtgggcggggctgggcgacggattgtccgaggtggcattgatctcacgcgcgcaaagcgagcccgatagcttgcgcttgccgctgttcagcctcttgaccctgatccagatggcgggctttggcgtgggcatgctggtggtcgggccgttctatgtgacgtggacgccggcccaggtgatcgtgttgtttcatgggttgccattgaccgcgttggtggtcatgacgatatggctgggctgcgctgcctaccggagtgtcagatcgacaaacccttgaagtgctcctgtagaaactccacacaagccctcagtttgccggagtaggccaggcgcgtcgggtacaccgcccacacgttggcgctctgggtgtagtcgtgcagcacctgcaccagctggccttgctccagcagcggcttcacgtcccacatcgagcgcagcagtacaccgcgcccgtccagtgcccactgcaacacgatctcgccgttgttggatgacagcggcccgcgaacgcgcacgctgtgcgctgtgccatcgcgctccaggttccagatgccgaaggcattatcgcgctccttgatcaccaggcagtcatggtgctccaagtcgctcaattgccgcggcgtgccccggcgttgcaagtaggacggtgcggcgcacagcactcgacggttgctcaccaggcgccgtccgatgtgctggccggggatgtcatcgcccacccgaatctccaggtcgaagccttcgctgacgatatccaccacgcggtcgaacaggtccaggcggatgtccagtcctgggtatctttctgccagcattgacagggccggggccacatggttgcgaccgaagccgaagctgctgcacaagtgcaggtgtccacgggggctgtcatgggcgtcggacagttcatccgagagttgctgaaagtcttcgaggatgcgcacagcccaacgctgcacccgttcgccgtcttcggtcagggcgatgcgtcggctggtgcggtgcagcaggcgcgtggccagtgtggtttcgaggatctggatacgcttgctgacataggctggggacaagcccagttcgtcggcggctgcggcaaagccggctttgcggataacggtgaggaatacccgcaggtcttcgggcaggggcacggtggcttttttgttcgtcatcgcaggcaggtgtgggagggtgagtcgccaggatagcatcggttggggaggccgctgtgctcgggtagcggccacgacgggagtccacagcttatttggctgcgagaaggaagggcagggcttcaaccagcaataactccggggcctcttctgctatgtagtgcccggccggcaacgccttgccacgtacgttggtggcgactttctgccattctccgagtgggtcgaaacagcggccgacggtgccgtcggcgccccatatcactaatagaggcagattcaaatgatggccggcgtcgatgtcagcctggtcatgttccaggtcgatgctcgcggcggcgcgatagtcctcgcagataccggtggcggtgccgggcaatgtcaggcagcgcaggtactcggcgaaggcttcgtcggtgaatggcttaagcccggcgctgcggctgcccatgacgctgcgcaggtacaactcggggttggcttcgatcagggcttccggcaacggcgccggacggatcaggaagaaccagtgccagtaggcgcgggcgaaggcttcatcggtctgggcgtacatcgccagggttggcgcgatatccagcagcacaatgcgttttacaaccttgggttgatccagggccaggcgatgggcgacgcgggcgccacggtcgtgggccagcaccgagaacgtgtcgaagcccagggcctgcatcagttcgacaccgtcccgggccatttgccgtttcgaataatgggtgtggtgttcgttggccgcaggtttgctgctgtcgccatagccgcgcaggtcggcagccaccacgctgaagtgttcggccaattgctcggcgactttatgccagatgacatgggtttgcgggtgcccgtggagcagaagcaggccggggcctgtaccgcctatgcggtagtttatgtctacgccattgacgtggcactggtctttctcgaagccggcaaacatggaatgactccttgtgatgatgacctgcatcctggaatcacacggcggttggggcaaggggaaaagtgtgggggggatgttcatgaagtgtgtagaagcccggcgcttcaaacagaggagatccaatgtgggagggggctccctcccacctcgaatgcactacggtttgaacatctccatggcacgctggcggatctgctcttcggtcaggtcttctttatgtgtagccaggaaccacaggtgcccgtacggatctttcacactcgcggagcggtcgccatagaactggtcctgtggggcagacacttcgatggcgcctgcctcaatggcttgtttgaactgtgcatccacatcgttgacatacaggtgcaaaccgacactggggtgtgtatccgggttgcgcagggccgtttcatcgcagggggtgcccagcatgatcatcgcttcgccaatacgcagctccgcgtggccgaccctgccgtcgggcatgtccaggcgcatggacacggtggcgtcgaaggccttctgatagaactcgatcgcctttgcggcctcgttgatccccagatagggggtaatgccgtgataaccgtcgggaataggtttaacgctcataacgttctcctttattgtggttatggagtgacagccttttcactataggtcacgccgcaccaccccaccattgattgggcctacaggtcggaatcaagggtgggctccaacagctgggcaccggggccgcgctcacccagctggtcatcctggttgcgcagcgggcacgcctgcatcgacagacatccacaaccgatgcagccattgagcttgtcccgcagcagcatcagcttgttgatgcgctcatccaggtcttcacgccacaacgccgacagacgttcccagtcgcgagcgttaggtgtgcgcccatcgggcagcgtctgcaatgcttcgccaatggtcgccagtggaatgcccaagcgctgggcgatcttgatcaccaccacccgccgcagtacgtcccgtggataacgccgttggttaccggcattgcgattactcttgatcagccccttggcttcgtagaaatgcagggcagtgaccgccaccccgctgcgggccgccaactgaccgacgctgagttccttgttgagcatgcaaaactcccaagcagtgcttgacctcgacttaactagaggttttaccctgcgtggcatcgaatcgcaagattctgcctacaaagaaaggggtgtgttcatgcaggtatcagagaaaaatcgcagcttcacccaattgatcgaatttcacatcgaaccccgtcagcaatccgccctggtggcagccttgaccacccagagcgagcgcctggccgaaggccatggcggctttttgagcgccagcgtacaggtcagcgatgatggtcggcgggtgctcaattacctgcaatggcaatcccgcgaggccggtgaggcggccttcaagtgctttgagcagggcgatgcggatttctggacgctgatccgtgctcaccaggccacggccgtgacctttggttcgttccaggtgctgcgcagttttgagcgcagccaggatgacgcgttgcactgcaggctaaatggatagatgcagcattcgctcgccttgcaggttttcccctggccgacgcttgttcaccgccaactcgccgatcttgatcaggcgcgtgcgcgtcacattgcggctcaagcccagcaggttggcggtgtgcacctggttgtaatggctgaagcggtaagcggcgcgtaataatgcgtcctcgaccttttcgtgcagggcgccggcctgctcctcgaagagcttttgaaacgcccgtgccagcagggcttctgcgctgttatcgaggccatgccggctgtcgtcctggcgctcgatacgcaggttcgacaggcgcaggtcgtcgcgctcgatcacaccgttgcggcaggtcagcagggtgtggtgaatcacgttttccagctcgcgaatattgcccggccagctgtagctacggagcttgtgctcggcttcgcggctgatggtgaccaggccgtagcccaggcgccggctataggtttcgataaagtgccgggtcaacggcaggatatcgccggggcgctcgcgcagtgggctgagcttcaggctgaccacgtcgaggcggtagtagaggtcttcgcggaagtgcccggcgttgatggccttttccagttgcacgttggtggcggccaggacccgcacatcgattggaatactcttgcgcgaacccaggcgcaccacttcacgctcctgcaacacccgcagcaacttgacctggatagccatcggcaagtcaccgatttcatcgagaaacaaagtgccgccgtccgcttcttcgaaccagcctgccttggcgcagagggctccggtaaacgcgcctttctcgtggccgaacagctcggcctccaccagggattcagagaaggctccgcagttcaccgccacgaactgccggttgcgccgtgcgctgaggttgtggatatgccgcgccaccagctccttgccggtgccggtctcgccgatgatcagtacgctggcttcgctcggcgccacttgccggatatgctcgagcaacgcctgggatttcgggtcttcgaaaacctgggccgtggcgcggatcgacgtcgcgagggcgggcgagggcgggagggtcaaaagctgcatgggcacctctgtttgaaatggagcgtcggaatcggcatggactggttcatggggtaggtatagaagaatacggttattccgtaaacgtgcgtatttctatatttataggtcttaagtgaataagcagaagatgctatctggtatgccgtgacggttgatagcgactatcacggacggtgatttttcaccgcgaaggggcgggagtagcctgtgttcattgacttgaaaccaccttcgcagggcctccgccatgaaccgtttgctcgctgtttcttttttacttgtcacctctgtccttgccggttgtgcgactcagccgtcaccggagctacggccttataccgcggaagaaaccaggcaattggccctggaggccctgggccgccgtggtttgtcgtttgacgactatcaacgccagcgcgccgcgttgcttggccagccacaacaacccttcggctttgatcaccagggtgaaatgaacgccgagcgcagcgtcgtcctgcatggtcgtcccagttgagcccgcttcctgcggcaaaaagcccgaggcgtcccataaggaacctcgggctttttgtttgccatggggctacctcagcctgttaagctgaatttcaggagcgttcctacgcacatttaaacaaagtggtccttctttaatggcactcgatcggttaaacctgacgacctctgttctggtcgatgccgcctgagacgctgctctcgggaatacgctctgcgagtttttaacgtcatgaataaacgtccgttgtatttcgactacgccgccactactccggtggatgagcgggttatccaggtgatggtcgagtgtctgggcttcaatgccaacttcggtaaccctgcgtccagttcccatgcgtttggccaggcggctcggcatacggttgaacaggcgcgtcgccaggtcgccgaattggtcggcgcccagcctgagcagatcgtctggacctccggtgctacagaatccaacaacctggcgctcaagggcgtggcccaggcccgtggtgtggcgggtgggcatatcatcaccagccagattgagcacaaggccacactggataccgcgcggcaattgcaggacgccggcgtggcggtgacttacctggtgccggatgcccacggcttgatcagcgtcgacgccgtcagcgaagccctgcgcgaggacaccttcctggtctcgctgatgctggtcaataacgagctgggcaccctgaacgacatcccggccatcggcgcccgcgtgcgtgagcatggcgcgttgttccatgtggatgcggcgcagggggcgggtaaggtggccattgatctggcccagtggccggtggacttgatgtcgttctctgcgcacaaactgtacgggcccaagggtatcggcgcgttgtacgtcgggcctcgggcacagcagaaggtactggcacagattcatggcggtggtcacgaagggggcttgcgttccggcaccctggcgacccatcagattgcgggtatgggcacagcattcgccttggcggcggcgtccttcgctgatgagaaggccacgattgttgcgctgcgccagcgcctgctggatcaactggcgtcagtcgccggcctgcgtctcaatggcagccccacccagcgtattccacataccctcagcctgacgttcagcgaaggcgaattcaattccgccgcactgagcgcgggcattgccttttccgcgacttccgcgtgcaattcggcaagcaatgcgccgtcccatgtgctcctggccttggggcatgatgctcgcagcgccggacgcactatccgcttgagcctgggccggtttaccaccgaacaggatatcgacgaagcggcccggctgatcaaggccgcactggccagcgcgccggcgttctgggcggtctgatttatcatttgcagtacataacaattattagtggttagcaggagacacaatgagtacgcagcctttgacccatggaacggttccccagcgcctggcgcatacccgtgaactgatgcgtcgcgagggcatccatgccctgctggtgccatcggccgacccgcacttgtccgagtacttgccgggttactggcaagggcgccaatggttgtcagggtttcatggttcggtggggacactgatcgtcacggcggattttgccggggtctgggctgatagccgctactgggaacaggcgaccaaggaactcaagggcagcggcatcgagctggtcaaactgcaaccgggccaacctgggccgctggagtggctggccgagcaaaccccagaaggcggcgtggtggccgtggatggtgcggtcatggccgtggcctcggcacgtacgctgggtagcaagctggccgagcgcggtgcccgtttgcgtaccgatatcgacctgctcaacgaggtctggcaagaccgcccggcgctgccgaaccagccgatctaccagcatctgccgccccaagccaccgtcagccgtggcgagaaacttgccgcattgcgcgccagcttgaaagacaagggcgccgactggcatttcatcgcgacgctggatgacatcgcctggttattcaacctgcgcggcggtgatgtgtcgttcaatccggtgttcgtgtcctttgcgttgatcaatcaacagcaggccaccttgtttgtggcgctgggcaaggtcgatgccgaactgagggccgtgcttgagcaggatggcgtgaccttgcgcgactacagcgatgtggccgatgcgctgcgtgccgtgccgtcgggtgcaagcttgcaggtggaccccgcacgcgtgacggctggcttgctggaaaacctcgacactggcgtcaagctggtggaaggtctgaacccgaccacgcttgccaaatcccgcaagagcctggcggacgcggaacatatccgccaggcgatggagcaggatggcgcggcattgtgcgaatttttcgcctggctcgacagtgctttgggccgtgagcgcatcactgaactgactatcgacgaacacctgaccgctgcgcgtacccgtcgccccggttatgtgtcgcttagcttcaacaccattgccgcgttcaacgccaatggcgcgatgccgcactaccacgctaccgaagaagagcacgcgctgatcgaaggggatggcttgctgttgatcgactcgggtggccaatacctgggcgggaccaccgacatcactcgcatggtgcccatcggtacgccgagtgaagagcagaaacgcgattgcacacgggtgctcaagggagtgattgccctgtcccgtgcgcacttccccaaaggcatcctgtcaccgttgctggacgccattgcccgtgcgccgatctgggccgaaggggtggactacggccatggtacaggccatggcgtaggttatttcctcaatgtgcatgaggggccgcaggtcattgcctaccaggctgctgctgcgccacaaacggcgatgcagccggggatgattacttcgattgaaccaggtacttatcgtcccggtcgttggggcgtacgcattgaaaacctggtacttaaccgtgaagcgggcaagaccgagtttggcgaattcctcaagttcgaaaccctgaccttgtgcccgattgatacccgttgcctggagccgtcgttgctgacggcggatgagcgcgagtggttcaacgcgtaccacgccgaagtgcgtgagcgcttgagcccgttgctcagtggtgcggcgctcgagtggctgcaggtgcgcaccgcggccatttgatttgttgcagccggcccgcgccggctgcaagctaaatctagctgagggcttcgcgcacaaagtccagacggtcctggccaaagagcagctgatcgcccacaaaaaagctgggggcaccgaacacgccgcgtttaacggcttgttcggtgttgtccttgagggtgttcttgacggcttcgtcattggacagggccagtacttgctctggatcgaacccatgatcgctgaggacgctggccacgacctcgggatcgcccaggtgacggccttctacccagagcgcacggaacaggcaatcgataaagtcgaggaagcgctcaggctgatggatttgcatgccggtgattgcgcgcatcagtaccagggtattgatggggaagtgcgggttaaatctgagcggtacattgtagcgtttggcgtaacgcgccaagtcatccagcatgtagcgccccttggccggtaccatgatcggtgaggcattgccagtggccttgaatacgccgcccaacagcatcggctgatacaccagctgtgcgctggtttcggcgcagagagccggcatctgggtgtaggccaggtaagtggcggggctgcccagatcgaagaaaaactccaggattttactcatggtcgatactcgctgcttattgttataggggcgtgttaccagggttcgctccagggccgcagatccagttcgaacgtccatgcgtcccgtggctggctatgcaggtaccagtagttgtcggcaatgtggtctgggttgaggatgctgtcctggtccttgagggcatatttttgcgggaagttctcgcgaatgaagtcggtatcgatggccccgtcgatcaccacatgggcgacgtggatgcccagcgggcctaattcccgcgccatgctctgggcgagggcgcggataccgtgctttgcaccggcgaacgcggcgaaccctgcggctccgcgcaagcccgcagtcgcgccggtgaacaggagggtgccgcggttacgggtgaccatgcgcttggcaacttcacgtgcgttcaagaaaccggaaaaacacgccatttcccagatcttgaaatatttgcgtgcggtttcttccagaatgctgcaaggcacgttggcgccgatgttgaagacaaacgcttcaataggccccagttcggtctcgattttctcgaccattgcgataacgtcttcttctttacgtgcgtcacaggcaaaaccgtgggcttcaccgcctgccgattggatgctgtctaccagggattgcagtctgtcggcgctgcgacgggtaacgcatgcaatgtagccttcgcgggcaaagcgcttggcgatggcaccaccggttgcgtcacctgcaccgactaccaatacgattttcttgttgtgcgtcatgggaactccattggctcgatgatcgagcaggagtttagccgccgtgtcgcaaaaggcatttggaatgtggtgggaatttgagacgagcagccaagagaggctgctcggcagctatttacaaatgacgatcatactgcggctggtatagccggcaggattgaggccgaacggatagtccccaggctcctcggagttgtcgccggacttggcaatcacccgataacccttggcaccgcatgaattggctgcactggtgtagcactggtcccaggaggaggacaggccagaacagttgatgtgcagcccttttttgccccgtttcacttctgttttggtggttgcagcacagccaacgatgcccacaaccaacaacagtatcaaaattcgtttcattcccatccttaatagccgctctgcagaagaacagagccgcttactcgctttcgagcgtagcgttcatgctgtccgtgtcgaaattctccatgaatgacattcggttacggcttaaacatggcctaaatgagcggcaaataccagagcttgtgttaaagaggtcagtcggcgggcaccagcggttttgattcgttgcgcatcgtcaaagtggcgcccacggaagccaggataatgcaggtaatcgccagccactgggcgagggataggtgctcattcaggaagaacaggccggagagggcgccgaacgccggttcaatactcatcagcgtaccgaacgtgcgtgcggggagacgagtcagtgcgaccatctccaacgtatagggcaaggccgtcgacagaatcgcaacgccaatggcgatagggatcagggcgggcgtcagcaatgcggtgccggcatgcacgatgccgatcggcgcaacgaacagggctgcaatcattacgccgagggcggcggtctggacaccgttgtcattccccgccttttggccaaacaggatatagagcgcccagcatacccctgcgcccagcgcgtaagctgctccaacccaatcgataccgctgctggcctcgctcattgggatcagcaggagcaggccgataattgctagcgcaatccagaggaagtcgactgctcgccgcgacgcgtagatagcgacggcgagcgggcctgtgaattccagtgctacagcaattcccaagggcacggtgcgcagggacatatagaagaggaagttcatgccacccagcgccatcccgtagatgatcactgtgcgcagggactttgccgtcagcttggcgcgccatgggcgtaatagaagcagcatgatcacactggcgaagatcaagcgcagagtagttgtgccttgcgcgccgacaataggaaacatgctcttggccagtgaggtaccggattggatggaggccatagcgatcaacagcaggccgacgggaaacagtgcgcaggccaggccgcggggaggggaggtcattggaggtgttcttccgaagtcatagtcgatgagcagatgtcgctatgatgcttaactgttgagtaatgagcaatatattgctcaatttgccgtttaagtctttctatatagaaggatcatggagtttgcagccgtattgatagaaaacctgaattaagccttgacggcagattctggaagcctataattcgccccacttccggcgcagtcgaaacggaaaactccttggtaaacaatgagttatgaagttttcggcagcaagttgcttcagttcatcgaagccagaaggaagttgaaaaagaggtgttgacagcagcgtgtaacgctgtagaattcgcctcccgctaacgagagatcgaaagcgcaagtggttgaagttgttgaagaaatcttcgaaaacttctgaaaataaccacttgacagcaaatgaggctgctgtagaatgcgcgcctcggttgagacgaaagatcttaaccaaccgctctttaacaactgaatcaagcaattcgtgtgggtgcttgtggagtcagactgatagtcaacaagattatcagcatcacaagttactccgcgagaaatcaaagatgtaaccaacgattgctgagccaagtttagggtttcttaaaaacccaaagatgtttgaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaaggattgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcgacgacatcagctgctccataagttcccacacgaattgcttgattcattgaagaagacgataaagaagcagcccgaaattgggtctgtagctcagttggttagagcgcacccctgataagggtgaggtcggcagttcgaatctgcccagacccaccaattttgtgtgggaaacgcctgtagaaatacggggccatagctcagctgggagagcgcctgccttgcacgcaggaggtcaacggttcgatcccgtttggctccaccactactgcttctgtttgtataaagcttagaaatgagcattccatcgttgtgatggtgaatgttgatttctagtctttgattagatcgttctttaaaaatttgggtatgtgatagaaagatagactgaacgttactttcactggtaacggatcaggctaaggtaaaatttgtgagttctcttaactgagaaattcgaattttcggcgaatgtcgtcttcacagtataaccagattgcttggggttatatggtcaagtgaagaagcgcatacggtggatgccttggcagtcagaggcgatgaaagacgtggtagcctgcgaaaagcttcggggagtcggcaaacagactttgatccggagatgtctgaatgggggaacccagccatcataagatggttatcttgtactgaatacataggtgcaagaggcgaaccaggggaactgaaacatctaagtaccctgaggaaaagaaatcaaccgagattcccttagtagtggcgagcgaacggggactagcccttaagtggctttgagattagcggaacgctctggaaagtgcggccatagtgggtgatagccctgtacgcgaaaatctcttagtcatgaaatcgagtaggacggagcacgagaaactttgtctgaatatggggggaccatcctccaaggctaaatactactgactgaccgatagtgaactagtaccgtgagggaaaggcgaaaagaaccccggagaggggagtgaaatagatcctgaaaccgtatgcgtacaagcagtgggagcccactttgttgggtgactgcgtaccttttgtataatgggtcagcgacttattttcagtggcgagcttaaccgaataggggaggcgtagcgaaagcgagtcttaatagggcgtctagtcgctgggaatagacccgaaaccgggcgatctatccatgggcaggttgaaggttgggtaacactaactggaggaccgaaccgactaccgttgaaaagttagcggatgacctgtggatcggagtgaaaggctaatcaagctcggagatagctggttctcctcgaaagctatttaggtagcgcctcatgtatcactgtagggggtagagcactgtttcggctagggggtcatcccgacttaccaaaccgatgcaaactccgaatacctacaagtgccgagcatgggagacacacggcgggtgctaacgtccgtcgtgaaaagggaaacaacccagaccgtcagctaaggtcccaaagttatggttaagtgggaaacgatgtgggaaggcttagacagctaggaggttggcttagaagcagccaccctttaaagaaagcgtaatagctcactagtcgagtcggcctgcgcggaagatgtaacggggctcaaaccatacaccgaagctacgggtatcacgtaagtgatgcggtagaggagcgttctgtaagcctgtgaaggtgagttgagaagcttgctggaggtatcagaagtgcgaatgctgacatgagtaacgacaatgggtgtgaaaaacacccacgccgaaagaccaaggtttcctgcgcaacgttaatcgacgcagggttagtcggtccctaaggcgaggctgaaaagcgtagtcgatggaaaacaggttaatattcctgtacttctggttattgcgatggagggacggagaaggctaggccagcttggcgttggttgtccaagtttaaggtggtaggctgagatcttaggtaaatccgggatcttaaggccgagagctgatgacgagtcatcttttagatgacgaagtggttgatgccatgcttccaagaaaagcttctaagcttcaggtaaccaggaaccgtaccccaaaccgacacaggtggttgggtagagaataccaaggcgcttgagagaactcgggtgaaggaactaggcaaaatggcaccgtaacttcgggagaaggtgcgccggtgagggtgaaggacttgctccgtaagctcatgccggtcgaagataccaggccgctgcgactgtttattaaaaacacagcactctgcaaacacgaaagtggacgtatagggtgtgacgcctgcccggtgccggaaggttaattgatggggttagctaacgcgaagctcttgatcgaagccccggtaaacggcggccgtaactataacggtcctaaggtagcgaaattccttgtcgggtaagttccgacctgcacgaatggcgtaacgatggcggcgctgtctccacccgagactcagtgaaattgaaatcgctgtgaagatgcagtgtatccgcggctagacggaaagaccccgtgaacctttactatagctttgcactggactttgaatttgcttgtgtaggataggtgggaggctttgaagcgtggacgccagtctgcgtggagccaaccttgaaataccaccctggcaactttgaggttctaactcaggtccgttatccggatcgaggacagtgtatggtgggtagtttgactggggcggtctcctcctaaagagtaacggaggagtacgaaggtgcgctcagaccggtcggaaatcggtcgtagagtataaaggcaaaagcgcgcttgactgcgagacagacacgtcgagcaggtacgaaagtaggtcttagtgatccggtggttctgtatggaagggccatcgctcaacggataaaaggtactccggggataacaggctgataccgcccaagagttcatatcgacggcggtgtttggcacctcgatgtcggctcatcacatcctggggctgaagccggtcccaagggtatggctgttcgccatttaaagtggtacgcgagctgggtttagaacgtcgtgagacagttcggtccctatctgccgtggacgtttgagatttgagaggggctgctcctagtacgagaggaccggagtggacgaacctctggtgttccggttgtcacgccagtggcattgccgggtagctatgttcggaatagataaccgctgaaagcatctaagcgggaaactagcctcaagatgagatctcactgggaccttgagtcccctgaagggccgtcgaagactacgacgttgataggttgggtgtgtaagcgctgtgaggcgttgagctaaccaatactaattgcccgtgaggcttgaccatataacacccaagcaatttgactactctaacgagcatcagattgcggtgtgtgaagacgaaaatgaaccgaaagttcgacgctcacaaagcaccgaccgctgtcacatacccaatttgctgaagcgagagccaagctggccacgactcagtacccgaatttcttgacgaccatagagcattggaaccacctgatcccatcccgaactcagtagtgaaacgatgcatcgccgatggtagtgtggggtttccccatgtgagagtaggtcatcgtcaagattaaattccgaaaccccaattgcgaaagcagttggggttttgttttgggcgcgagaaaatgccctcagctcctggtcctcccccccattaaataacctgccgttgagggaaatcgatgcaaagtgtttctgcatttttggtatggtgcagcacattttcacaaggattgatctttatccgcaggaggcggcgtcgacctttttcaacgagatgctgtagaaatgcctgaaccgatacctatcaaagatcacgaaaaagaaaatcgcctggtcaacaaacgcttgctcgcctgtgcgctgttggtgatcggcatcacctgtgccctggtagggcgcatgtatttcctgcaggtggtgcagtacgactatcactccacgatttccgaaaacaaccgggtccacgtactgcccatcacgccgactcgcggcttgatctatgaccgcaatggcgtagtgctggccgacaaccgtccgagttacaacctgactatcacccgcgagcgcaccgccgatctcaagggcgagctggacgcaatcgtcaatctgctgcacctgcctgccgaagaccgtgcggtgttcgataaggcgctcaagcaggctcgtcacccgtttgttcccgtcaccttgttctatgagttgaccgaagaacaaatcgccgtgttggccgtcaacgagttccgtctacctggcgtggacgtcgagccccaattcgtccgccactacccactgggtgcgcactttgcgcactcgattggctacgtcggtcgcattaacgaaaaagaatccaagaccctcgattccgtggagtatcgaggtacccaatccatcggcaagaccgggatcgagcgtttctacgagtccgaactgcacggccacgtcggttacgaagaggtcgagaccaatgcccagggacgcgtattgcgggtgctcaagcacactgacccaatccctggtaaaaacatcgtccttagcctcgacgtcaagctacaggaagccgccgaagaggccttgggcgaccgtcgtggttcggtggtggccctggatccgcaaaccggtgaagtactggcgatggtcagcaagccgagtttcgaccctaacctgttcgtcactggcatcagcttcaaagaatacgctgcgttgcacgattccatcgaccgcccactgttcaaccgcgtactgcgtgggctctatgcgccgggttccaccatcaagccggaagtggccatcgccggcctcgacagtggcgttgtcaccccgcaaacccgggtgttcgatcccggttactaccagctgccggatttcgatcacaaataccgcaactggaatcacagcggcgatggctgggtggacatggacgcggccatcatgcgttccaatgacacttacttctatgacttggcccacaagctgggcatcgaccgcctacacgactatctcgccgagttcggcctcggtcagaaagtatccttggacatgttcgaagagtctgccggcctgatgccgtcccaggcctggaagcgtgccacccgtcgccagccatggttcccaggcgaaaccgtgatcctcggtatcggccagggctatatgcaggtgacgccgctgcaactggcccaggccaccgcattgatcgccaacaagggtgtttggaaccggccacatctggccaagaccatcaatggcgtcccccccgtggatgaaaacccgatgcccaacgtggtcctcaaggatccgcgtgattgggagcaggtcaaccacggcatgcaattggtgatgcacgatccacgcggcatcgcccgggccgcagctcaaggcgcgcaataccggattgccggcaagagtggtaccgcccaggtggtggcgatcaagcagggtgagcgctacaaccgcaacaagacgttggagcgccatcgcgataacgccttgttcgtcggcttcgcgccggccgaacatccaaaaatcgtgatttcagtcatgatcgaaaacggtgaggccggcggccgtgtggccgggcccgtggtgcgacagatcatggacgcttggctgctcgaccaggaaggtcatctcaaaccgcaatatgcgacacccgccaaggcgccaggcgatccacgcgtctgactcaggccttccattcgtcccagcgctcaacgccgtcataagcaagccagggtacctcatgggacgtccagatatgcgcggtgggccgggtgcctgggtcatcatccagcgtcgccacccgcacaatcacgtgaggctgatgcccacgttcggcgatcagatgtgagccgcagcgtgagcagaaatgccggcgtttgcccggtgaagactcaaaggacgacagcagctgttcaccgtcggtccagcgaaagtgttcgcgcattaccccggccgtggcgacaaacgcggacgcgtgcgccttgcgacagctttggcaatggcagtggctgatgggcatgtccaggctgtccacctggtagcgcaccgctttgcacaagcaacttccattcaatgggtcagtcataacctatggccaggtcaaggatggggtcatcatcatcgcgcacaactgaaggttgcgcattggtcgatgtcgcctactgttcaatggaggaggtgacgcatgcacgtattagatcgcatcgaacgaaaagtcctgctcaacgcatcacgcaagcaggtttgggaggcactgacgcaggccgagcaatttggtgattggttcggtatcgcgctcaagggcaaaacctttgttgccggggaaaccctcgaagcgccgattacctatccaggctacgaacatgtggtgtggaaggtcaggatcgaacgcatcctgccgcaaacgctgttttctttctggtggcacccttacgcggtagaagcgggcgtcgattacgatgaggagacaccgactcttgttgagttcaccattgaggatcgtgcgccgggtatcctgctgcgggtcgttgaatctggttttgacaaagtgcccgaggcccggcgccagaaagcgttcaagatgaactcccgtggttgggatgagcagatgggcaatatcgaagcctatctgggcaaaaaaccagccaagtgatgagatgcaagggggaagttcagcccccatattttcaagcgtttagaaatcaatcgtcgccgacaacttcgccactcgcggatcaccctggctcaggaacccaccctgggccgactcccagtacttctggttggcgacgttctccaccgttgcgcccactgtcacctcgcgctcatccagggtgaaggtgtagcgcgcacccacgtcgaagcggttccaggccggcaggctcaggttgttggctgcatcggcgtactggccgccggtgcgtagcatgcggccgctgagggtcacgccttgcaggccgggtacatcccaatccacaccggcgttgagctggaatgaaggaacgccgatggcacggttgccgtcattggcgccgttgagggtgcccttgagttcggtcttcatcagcgtcaccccgcccagcaaacgcaggccgctgaccggttcgccgaagacgttcagctcgacgcccttgttgatctgctcaccttcacgcacatagcgcgccgtggtggcgtcgatggcctcggcataacctgcgccgggctgctcgatacggtagacgcccagtgtcgcgccataggtacccatgtccaccttgacgcctgcttcgatctgcttggagcgagcgggcgcataggcttgcccgccgccgatgaccgtcagttcgcctgatttgagcggcgatgtcgggccctgtgccaggccttcgatgcggttggcgtacaacgacacatgctcccatggcttgaacacgatgccgtacaccggcgtggtgatcgattcgtcatagttggctgtacggctgccgctcatgtagttgtaactctgtaccaccatctgttggcggcgtgcgcccagggtcaccagcaggcggtcatcgaagaaacccagggtgtcggagactgctgcgctgcgcacgaaagtcttgccggtgatggttggatcgctgaaatcggtgcccggcgtgttacgcgggctgttcaacgtcggcggcgcgccggtcacagggttgtagatattggttggggtagacgttgctgcggcgttgaacacataggcattgcgcgcttctgtccaaataccggccaggccgaagttgagtcggtgactgatggccccggtctggaatttgccgttcaggccgcccattgcgctgcgattgttctcttcatgggcgatggtcgagcggctcgccagggcattaccgaaattgtcgctcaaggtcaccgacgagtagcgccccatttcgcggctgtgcttggcgccggctgctgcataggcggtccagttctcgttcaggtcgtactcggcgcgcagcatccccaaggtatcttcaaggttggtactgctccagttcggcgcatagttggtatctgccgagggcgcatccggcacgtgggtgatcttgccgaggaataccgagttgcgtccgccgttgatacgttgcttctgatacacaaaatcacccgacaggcgcagcgcatcgccgcggtaatcaaggccgacggcaaacagcttcgaacgctggttttcatcgtcaatgccggtatcgccttcgcgctgggacaggttgacccgtgcgccaaactggttgtcttcaccgaaacgctggccgatatccaagtgctcgccaatccggccatcgctgctgatgtcggtgctgaaccgccgcagcggtacatcatcggcgcgcttgggttgcaggttgacaccgccgccgatccccgagccagtgggggtgacaccgttgataaaggcgttggggcccttgaacacttctacgcgctccagggcgccggtggagatgatctggcgcggcaggatgccatacaaaccgttataggaaatgtcgtcgccattcaacggcaggccacggatcatgaaagtctgtgactggttcgcataccccgaggcctgacgcacggaagagtcattgagcaacacgtcgccgacggtttccgcctgctggtcgcgaatcagtttctcggtgtaggaggacatgctgaagggcacgtccatgatgtcctggttgcccagtacacccaattggccaccgcgtgccacctggccacctgcaaactcgggtggcaatgcggtgggcgcgggcgcttcggcattaatgctggtagcgcctagctccagtgcgttatccgcacccgctggcgatgccgcctgtgcagcaaaactcagggaacagcaaagggcgagcagggtagggcgaaacggcacagcgggagcgttacagatgggcatgatcgatcctgacggcgaaccgtcaacggtgagggagtggacaacgatgttgcgcttcctcactgcgcgaatacgactccggcgcagatgatagtaattactattaacagcctgcaacaaatttgtgagattgcggtctgcgtgcgcgttaacctgccgcgtttgcacggatgccgagtagaatctcgcccttaacgcaattcctgaggtgcggtacggtggatttacagcagggttttgttttgacccggcattggcgcgacaccccggcgggcacggaggtcagtttctggctggccaccgaccatgggcctcgctgcattcgcctgcccgcgcagacctcggtggtgttcatccccgaggcgtaccgcaagccgctcgattggctgctcaagggcgagcgcgatcttgagctgcgcccgctgcaactgtgcgacttccaccatcgcccggtcttgggcctttatgcccgccagcaccgccaattgatggacatcgaaaagcgcctgcgcactgcaggggtcgatgtctacgaaggtgacgtacgcccacccgagcgttacatgatggagcgctttatcactgcccccgtgtggttcggcggcacgcccgacgcgaacggcgccttgctcgacgcgcagatgaagcccgctcccgactaccgtccgcaattgaagctggtgtccctggacatcgagaccaccgcccagggcgatctgtattccatcgccctcgagggttgcggcgagcgccaggtatacatgctcggcccgccgaacaaacccgacgcggtggacttcaagctcgactattgcgacacccgtgcccaactgcttgaacgcctcaatcaatggctgctcaccttcgaccccgacgcgatcatcggctggaatgtggtgcagttcgacctgcgcgtgctccacgaacacgcccagcgcctgaacgtgcccttgctgctggggcgtggcggtgagcccatgacctggcgcgaacacggcagtcgcaaccattacttcgccgcggcggcgggacggctgatcatcgacggcatcgaagccttgcgttcggccacctggagcttcgaatccttcagcctggaaaacgtcgcgcaaaccctgctcggcgaaggcaaagacatctccacgccctaccagcgcatggacgaaatcaaccgcatgttcgccgaggacaagccggccctggcgcgctacaacctcaaggactgcgagctggtcacgcggattttcgcgaagaccgagctgctcaagttcctgctggagcgggccagtgtcaccggattgcctgctgaccgcagcggcggttcggtggccgcgttcacccacctgtacatgccgttgatgcaccgccagggcttcgtcgcgccgaacctgggtgacaaaccgccccaagccagccccggcgggtttgtcatggactcacgcccgggcctctacgagtcggtgttggtgctggactataaaagtctctatccgtcgatcatccgcagcttcctgatcgaccccgtgggcttgatcgaaggcctcaagtaccccgacgacagtgagtcggtggaaggttttcgcggcgcgcgtttttcccgcacccgtcattgtttgccgtcgatcgtcacccgcgtttccgagggccgcgaagtggctaagcgcgaacataacgcgccgctgtcccaagccctgaagatcatcatgaacgctttctatggcgtgctcggctccagcggctgtcggttcttcgacacgcggctggcatcctcgatcaccctgcgtgggcaccagatcatgcgccagacccgcgagctggtggaggcccagggttacgaagtgatctacggcgacaccgactccaccttcgtctggctcggcggcgcccattcaccgcaggacgccaatcgcatcggcctggcgctggtgcagcacgtcaacgactggtggcgcacccacctgagcaacgaatacggcctgcaaagcgccttggagctgcaatacgaaacccacttcagccgcttccttatgccgaccatccgtggcgcggaggagggcagcaaaaagcgctacgccggtttggtcgtgcgcgacgatggcagcgaagagatggtgtacaagggcctggaaaccgtgcgcagcgactggtcgcccctggcccggcaatttcagcaggagctataccagcgcatcttccatcgcctgccccatcaggattacatccgcgactacgtgcggcgtacgttgagcggcgaattcgatgagctgctgatctaccgcaagcgcctgcgccggcctttgcacgactacgagcgcaacgtcccgccccatgtacgagccgcgcgcctggccgacgagtacaacgaccgcctggggcgcccgcgccagtaccagcgcggtggctggatcagctatgtgatcagcgtcaacggcccggagccgctggaagtacggcaggcacctatcgattatgaccactacgtcacccgtcaattgcagccagtggccgatgcgatcctgccgtttgtgaatgacgatttcggcaccctggtgggcgggcagatgggcttgttctaaactcgattcgggatggccgctagccaggcctggctagcaccaatcaaaatgctgcgataaggagcaaaggcccatgtacacactctacggcaccgacgagtccggttcctgcatgatcgaaattgccctgcagcgttgcgcggtgccgtggcatcgcgtggacgccagttcctggcaggaaggcgagggcagcgacgcgctcgcgcgcatcaatccgctgaaacagatccccaccctggtcactcccgacggccaggtgctgaccgaaagcgccgctatcctgatccacctgggcctggaatatcccgaagccgagctgctggccggcaatcgcacgcagatcttgcgcggcctgctgtacatcgccgccaattgctattcggcaatcggcatcatcgactacccgcaacgctggttgggcaacgcggatgaggcgctgcaagcacaattgattgcgggtactcggcgctatctgcatcaggcgtgggtggtgttcgtcgagcagtttgccgaccagttgttcacgcccaccggtgtgccgaatgcactgggtatcatggcggcggcagtgtcacgttgggatgaggcgcgtgaggagctcgcaagactggcgccgggatttgcgcagaccctggaacgagtggacgccgaccctgttgtcgcgcccgtttttgcccggcattggccgcagtggaaggtctcgtaaccagaagaaacaatggccctggtcagcccccaacccttgcgtagcgggtgtcctgacctacgcttctcatggtggtgtaggaatcatccttgaatttggctgtcgcagacatgaaactcaagaaccctgcatggaattcaaaggaggtgcgcatgctcatccggtcgctgaccctggctaccttgatggcttttacggggccgttgctggccgctgatgatatcgatccgctcaagcaggacctgggcaaggcccggccgctggtggtggtggagctggattccggcaacgacaccttggcgactatcaggaaacagctggacgaacctgccaccaagcagtcctttgaagagcgcaacatggtgttctataccgtgaagttcggcagcatcggcgccgaaggtgagaagttcgccaaggaagccaaggacaacaagaaactcacgccaccggaaaccaacgcactgatccgcgccctcaagctgggtgccggcagtggcaccaaggtgatcctgatcggcaaggacggtgagaagaaactcgagaagaccgtgccgccggacaccctcgacctcaaggagtttttcagcgctatcgaccagatgccaatggccgagaaagaagcggctgcgccgaccgcgccagctgcgccagaacctgcacctggcaagaacgctcccaaaacgggtaaggcagccaagcaggctgctcctcaacagctggatgactgagtccgcgcaggagctggctttccagctcctgcgcaggcagttgcagcggtggttctacttcacgctttccatggtttgaaccacccagccaatccccctaataccagtgcactcgtcaaggtactcaggcccagttgccagccgtcattgtgcagcgggtgcaatatgaccgctgcaaagcccaataacactgcactcagcccccattgcagcggccagcccagttgcccaagcaattgctggcgttgcatcaacagcagatcggtgacgacaaccccgcccaacgccgccagtgcaatacccggcaggccaaaaaagtacggcaacagcagcaggagtatggcgttgatcacactgcccagcagttcgcaccgcaacggtagacgcgtgtcgccgccggcataggcgtagcgggcaagcatggcgttccaggcgccgaacaccaatggcgtcgcgaaccaggccagcagcgccggcagtgggccgtcggcgctttgggcgggcatcagcagatgaatcagcacggggctggcgccgatcaggccgagggcggcgggcaggctgagcagggttgctgcatcaaggccccggcgcagtagagccaggcgctgctggccttgttcgccgctcatcatgcccagcagtacctggttgaggctcatcagggcgatcaagggcagattgatcagtttgcgcgccaggttgacccaagtgacggcgccttcccccaggtaactggcgatcaatcgctcgagcaatgccaggccctggctggcgacattgctggccagcaatggcccgatgcgccccagcaattcgcggcctgccagggcttctccagtgacctgccacggccgccagccgaaggaccagaccggcgccagcaatggcaggcacatcaatacactgccggcaaaaaagcacatggccagttcggcgctgtcgctggcgctgccacggataaacaggtacagcaccggcggcaggttaaacaataacgagcccagccctggcaggacaaaacgttggcgtgcctgcaacggaatactgaacaaggcatgcatcatcaggcccggcgcacaggcggccagccagcgcaagttggcggcggcttcggcgtgggccgcagcgtccaggccgggaccgatcaggcgcacccacagcggcgcgcccagcgccagcacggcaaacaggcccaggcccacgcccagcaggcgtggagacaggctggccagccaggcttgctggcgttgtgggtcgcgttgttgataaaggggcagggctgccgctgcgagcaagccggcggccagggtcatgcgcagcgcttcgggcaaaaacaccgccaccagaaacccgtcgctgcgactaccggcgccccaagccgccaccagcagccattcgcgggcaaaaccggccaccagcccggcgagggtcgccagggtcagccagagggtgctgccgaacatcaatggaacagggtgaacaggcccttgccacccaccttatagttcagatcatggcaacgttcacccatgattttggcaccagtaccgccaatgattttgtagggggccacggctttggccactacggtgttggcgcttatcaccgaaccatggcccagatgggtgccgaaaccgatcaaggcacggctgccgatccacacgtagtcgtcgatgtagattgacccggaaatcgaccagaactccggcgcctgcaaatcatgactgccagcgatgatcagcacgtgagaggcaatcgccacgtggttgccgatcaccagcccggcgcgtgcgtccacctggcaatgccagccgatcaccgaatcgtcaccaactaccagattgtggatgcccagcacttcggtgttacgccataggcttgagcccttgccgatcttcgcaccccccaggcgcagccaggcaatgcgcacatggtggctggggattttgttgatcaagatgttgtaggccatgtcccaggcgttgcgccagcgatccttgatagttgcccagtttttgccgtagcgcggcagcagctggcacggcaggtcctgtttcagacggtggaacaggcggcgggcaaccgggtgctcaagggcgggttccaggtcgatggagctgatccagaagcgcttgttctcgccttcgccgtcttcaaacaccacgtcgttggccaggcaccaatccagcgcttcttccaggtcgggcaggcttacgccgagttcaccggccagcatagggaggcggtcgcgcaaatcggtagagtgaattatccggtgcttcatggttggtcatcctttggcgcaataacaggaacagcgctggtaacggtggggcgcaggcgcacctgttgcaggctcatgcccatcaacagccagaacagtgcgatcaatacaaaggtgaagctgaaatagtggtcgaaaagccccgtcagcagcgctgccaacacgccacaaatgcatcccagccacagggcgttgtcggcggtgaccttgcgcacctggcccaggggccgcacttcccgccaccacagcacagtgacggtgataaacaacaacattcctggaataccgaccttgtagatgaagttcagccacaggttggagatccccaacaggttgctgccgggtacgggcgggtcgatcttgaagccgatccccagggggaatttcgacatggcgtcggggaacctggcgtattcgtcgaagcggatttcggtactggcgttggtggtcgagaagatggtcatcaagcgctcctgcagcggcggatagaacatcaccagcgcgatgccaaacgccaacccgataccgatgatgcgcccgctgttaggcacgcgcttgtaggtcagccagatcaagaccagcgccagggccacgatggcgccacgggaaatgctcagcagcaggccggcgcaacccagcaccgccaccgccaggcccagcgcccgacgccagccgctgcgggtccagccatagaacagcgccaggggaataaacagcaccagcacgccgccggtcaggttggggtgcacccagggcgaggccatgcgcgtgtagttggcggagaaaatatccttcaccgcttccgggtgggcatacttgaggtcggtgaggatatcgatcatcgacatcgcgttgcgtgtcttcagaaacatgaaaatcgacagcaaaagcatcgccaggttacccagcagcagggcgaccacgaccttgtcgcggtcggcgtcggtgcgtagcagcaacggcacgataaacagcaacgacaggttcatcagccagcgcacccagttcaccggtccattgccttcggcatggatgataaccatgccccagataaacggaatggtgctgaacagcatcagccacatcagcgcgcgctcggtcggacgccacagtatcaagccacgggtcttgccgataaacgactgccagaacaccccgacccaggtcagccccagcaccgcttcactcacggtggtgcggatccccagttccaaagtggtgtagggaatgctggtggccaacacggcgaagatcagcaagccccacaggggaaagcggatcagggtcaaggccacgcccatgccggccacgaccagcaggacctttatcggcgaaagggccaacagcaagccgccgaagaccaggcccaggagcagactaacgaattttcctggcagcattagcggtccaattccttaagcaaagtgtccagacgcgagcgataggcgggctcggcaaattgccgcgcccagtcgatttgcggttgcgggtttaccgttgcctcgggggctgccagttgtcgcatgacgttttgcagttgcccggcgtcatgcgggtcgaagcgcggtgcgctgggcggcgcgacttcgtcgagggcggagccgcgtgctaccgccacctgcgtaccgacactcaaggcttccaccaccggcaggccaaagccctcggcataggaaggctgccataggcatgcggcatgccggtaaagtgcttgcagttggccgtccgataaaccgctgcaccaatgcaggcccggcagttcgccgaggtccgccggtacatcgctggcgtggcccaccagcaccatgtccggcacgtcagggttcaccgcacgacaggcctgccactggcgcaggaaaaacaccatgttcttgcgcggctcccgggtgcccaccaccaaccagtaacgcgccggcaggcttaccggcagcggctctggcgctgcattcaattcgggtaccaggttgctcagcacccggaacttcgcccgggcccaggggaacacccgggcggcttcgttgcaggaaaactgcgaagggcaccacacccggtcagcctgccacaccgaccaggcaatcgaggcgccgtcaatcaagcgataggccagggccttgagcctggagcgatgaaagttacggtgggtcagctgaaacaggtcatgcagcaccagcacatagcgggtgccggcgggtttgcgacatagcggcaagcccatattggccgtggcgatgtagaggtcgacctgctgcgcgtgcaaggccttgggcaagaacctgcgctcgaaacccaggcgcacttgtgggcgctgcaggccgtccagcgggctggcccaggtcgggcaaacggcgatctggcgttgcgggtgatccaggggagcttcgctgaacagcaacacttcggtattggcccgtgcgcgcagggcgtgctccagggccaggacctggcgggcaatgcccgacgacggtgcaaccgtggcggggcgatagtccagggctacgcgcatggttgaggctccttggaggtgggcaaggtgcggtagatgtgctccagttcgttaccggccaccgcccagtcgtgatagcgacgtgcgtaatcgcgtgacgcatcagccagttgccgggccagcgacggttcatccagcaagcgtacgatggcgtcggccaatgcctcggcgctttcgcccgacaggtaatgggtctgtggctgtactgccaagccggagacgccctgtgcagtgctgaccagcggcaagccggcggccatcgcttccaacaccttgagcttggagccgccgccgtggcgcaacgcggcgacaaacccggcacagcggcgttgcaaggtgcacaggtcgggaacgaatcccagccactcgatacgctcatctggccagcggttgcgccagtgttcgggcaagccgtaaccggccaccgccaggcgcgcgttcgggcactgccgccagaccctggggaaaatctcctcaagcagccactgcacggcgtccaggtttggcgcgtattcgtagttgccgacaaacaacaagcgctggctttgtgcgtcggcactgacctcggcaaaggcgcggctgtcgaccccattgaccaccacgctcaccggcgtcgaggatagcggtcgcatggcctgggcatccgcctcggtcaccgcgatcacatgggcggcggcatcgaacgccttgcgctcccactgtcggcagcgccattggtcgtaccgcacgaacggcccggcccacttagggaagcggtcgtaagtggcgccgccgaggcttgattccaggttgtgctcggtcagcacaaacgcgcgccgacgctgctgcaaggtacgcatgaacggctgcaggctgtagctgtgttccatctgaatcacgtcccagtgttcgttcaacagttgtgcaaattgcgcctgcaacggtgcggacagaccgttgaccgtggtcaacagcggccacggcgcgaacacgccagcgagcagggtcagcgggtgtttcagtggccggcgcggcaccactatcaagcgctcgagcaacggctcaagggcggcatgcgccgcgtcatcggccggcgtcttcgattgcgccagcagcgtgatgcgatgcccgcgctcactcaaggtgcgcagcaaatggtactgccgggtcttgccgccgctggtggtcggccacggcagatagggcacaacccataggattctcatgtgtcgctctccatgcccggcactaccacaccagtatctgcaaactcggcttcaccacggggcgaatgccattgtcgtcactcagggtctgtcgggctccggtcaacgggtccagcagttcagcgcgtttgatcccaggcaggctgatgctgctgccttcggcactccagtacatcagcaggtgcttgccgtcaggccgagtccaggccacgctgtagaaactgtccggtacttccttgagctgcggcgtggcgccgggttgaagagtggggccggtgatctcgaggaagcgggcgagggcggtgtacaccggtttcggctcgccgttgaggtccagcaggccgtaatgctggtcccgcggcgaggcacgttcatcgaggtcggagagggcgaacaggaaaatcttctggtagtcctgggacgccatcaaggccaggcggcgcaaagtgtagtcggcttgcccgtcgataccgatcaggtcctgcatctccttgggcccggcatagctggaccagccccattcagtggcccatacctgcttgatcccggcgccatgcagcattgcattgagttgatcgccgcgcagcagcacttcgttcttgcccggctcatcggtttccggggtcatcgaataggggtgataggccgcgaccatgcccagggtttgcacccccaatgcgccgagcgcttcaaacatcaggcttttgccacggggcggcatctggctgtagtacgccatgccgcccatgacctgcagcttgccaggcgcggcaatattcaaggcctggtgactggccaataacaattgcccgtactccttggcgttgactttggggcgccagttgttcggcaggttctgttcgttccacacctgccaggcatcaatattcgggtagcgtttggccaggagcgccaggcgctttgcatagacgtcggcgtcccgtggtcgatattgatcctggaacggcgcgcccttgggggcggtggtgataaagggcgccgagcccaccaggtaaaacaccgagcggattttttcggcgctcagggtgcgctccagttcatcgaaagtgctgagctgataaccctcttccttgggctccaggcgatcccagtgcaggtcgacccgcacccattgcaatcccagcttcttatattggctgatctgctcgcggtactgttcgggcttgaaccacagaaagtgcgcattcacgccaagaaagtccttccatgtcacgctgcgctccggggccaggttcaccggttgtgcatcgactttttcactcgacagcagggcgccaccgacggcgattgacagcaccagcggcagataacgccacatcgggcgaacggatgaaatcttcatcgcaacggctcctcacaagcatcccgaaagagttcggcaaaacgttgggccgtgttggcccactggcgctggcggccgatttccccggcctgggcggcccattgccgggcctgttgcgggtcgaggatcaagcggttcaaggcgttgctcaaggaagcgatatcgccctgctgataggtgatgccattgccgccggccacctcttcggcaaaggcacgggcgttggaggtgatcaccccgcgcccgcaggcattggcccacgacagcgcgccgctggtgccacgcatctgtcccaggaaaccgagttttttcgattcgcggtagggcagcaccatcacatggtgcgcctggatcgtagcggcgatctgcgctgatggcaggtccagttgccagtccaccacatcttccaggtgcagcgtgctgatctgttggcgcaggccctcgaggtagttaccggctgggtcaaaggtcatttccggggcggtgccgccggccagggtcaggcgtacctgacctcggcattgaggatgggcggccagtgactgggccagggcctgaagcaggtcctcaatgcccttgccgcgatagataaaaccgaaatacaacagacgcaacggcgcaagtggcggcaagtcctggggcgcgatgggcaggttgccgtgggcaatcaccgccacttgctgcgggcgcagacccatgcgctggcgcaggcagtcgccgccgaggcgggtgagggtgatcaggcggcgcatgcctttagccaggcgccgttcttcgtgcaaggtcagcgggtcggccagcagtgctgctgcctggggcagcgggtggggcaggcgctcgagcaggctcaaggggaaaaacagcttggcccgacgccagatcaggcgctccgggtcatgcaccgtggcggtcaaaggcaggtgcggttgcgcccggcgcagatagtccagcgcctggaactcaccgaagcgcccaccccccagctcggcatggaccaggtccacgccgctccagtcaaaggcctgcagacgccgcaattgttcaggcaggtcctggcagcccgcgaggggggtcaccacctcaagacccagttcgatcagcgcgctacgcaagtgcgcggcgtaatcggcgatcccggtctgctccggtggcagcggtgccagcagcgcgatacgcatcaggccgcaccgcgccagctgttgattcgtgccaggaccttggccggcacttcaaagcggcggcggttgaggatcatgccgtcgactttgccgaatgcggtggtcagcagtgacacagcattttcgatggtcggcactgtgctggtgcgggcttcgatcaccagcacgatctggtcggcgcggcgcaggatcaggaaggcctgggggttggacgacaaggccgaggcatccagcaacagcacttcacccggcgtgggcgcgtttgccccattgaccgagacgcggtggccacgctcttccaacaggcgcttgagctgctcgacgataaacgtcacgccctcgccatgccgcgccgaggtcaggcccagggcaaagccttcactggcgatgcgctccaggggcagcaggctgtagaggcgatagaggctggcggtgacggctgccggcgttgcgtcttgcacgtcggggatgctgctccacagcggcacatggaacatctcctgcaaccgggtgccgtcgtggatgcgttggtccagcaggtacagcacatagatggtcaagaagcccacggccacgccggcgggaatggcgaacaacagaatcagcaggctcttgggaaacacgcgtgacgggttcagggtggcatgttcgatcagggcgatgttgctgatctggctgttgtccagttcgtggtcgattcgcgcctgttcaagattgtccgagtacaaggcgtagcttttttcggcggcgcgcagttgttggctcagcttgttgagttccggctcatcggtcatcgccttgtcacgctggtcgcgcagctcggcgagggtcttgtcgtagttgtcgatttcgccggccagtttgcgctcttgcaattgggcgtcgatcacttgctgcttgatgttgatcaccaggctgttgggcgcggtgttttgcgagcgctccaggcgtgtggcttcctgggcgctgagagcctccatgtcgcggatgttctgctcgatctgattgacctgcggcgtgcccggcaggtaggtgcgcagcaggcgtgctcgctccacttgcagcgcattgagctggcgcttgaggtccagttgggtggggttgaggctggtttcgcgcatcgtcaccacgtccgccggctggctcttgatctgctggctggcgttggccaggaggctgcgaatcccggagatctggttttgtgcgctgaccttggcgtcggtgacgcggtcgatctggctggtcaggttcttcaggcgcgcatcgacactgatcgaatcgatctgcttcagacggccttgcagttggtccttcaggctttggatattttccgccaccttggcgcgctcggtttcatagaaggtatgcaggcttttgcgcccgaggatccgcgcacgttcctcaaggtaggcattgacccattcctcgacgattttttgcgccaccgccgggtcgtcccaggtgaaggaaatctcgatcaccgaagagcccggctcgtgaccggctttgaagttcttctccagcgaggtcgccaggcgttcaagcgggctttgtttctcggcaaggcctacgaactgcagcacgctgcgcacggcattgatgacttcgccaacgccttttttgacgtagaacttggtgaccttccagaagccttgtggcggttcggtggtcatcgccatatagcgctcggcaacgatatgcacaatgggccggcccgtgagcattttttcttcgtcgacaatcgggtcgtgctgggtgctcggggcaatcagcgtctggcggttggcggcttcgatcggcaacgtggtgttgtcccgccctggcttgaccagcaagcgcgcgtcggactcgtagcgagccggcagcaggaaggcacccagcaccgcgacgacaatcgtggtgatcactgccagtttgaattcgcggcggtagatgaaaaacagccgcagcaggtcgcgaagagagcggatttcgatcacaggatcactccatcgaatatggggtttacgaaagacggggacagttggttcgagtgatacgaagcccgcttcataatccttggcctgcgttaatggttgggttgttgtagatggtgttgccgctgttttttacgtcgctcttgttcaggtcgtaattcaagccaataccaatccccttgttgatcggaaacagcttggtgaagtacatatccacggcctccaccgttgcgccgatgcccgactgcggcacaaagatcaagtcgccgcgctgcaacgccacccgtgggtgattggcgttggtcaacatgctttccaggctgatgaaatacgtcctgtacttgccatccgggccggtgcgcatcaaggccacgttggaggcatccgccgagggcaatacaccaccggaactgagcagcgcctgctcgacgctgacgttgccggccaggtcaaaaaacgccgggttgggcaccgcaccgccgataaacaccttgttgctcggtgcgctggcgatgtttaccgtcaccgccggttcacggtagatgcgcttgtacttctcggtgatttccttgcccaggtcttcgggcgtgcgcaaggcggccttgacccggccaatattgggcacagagatcacgccgtcggggcgcaccacgaacagggtcatgtcatcggccgccgccggctcctgggcatcacgcacgatccgcagcgagtcgccgctctggatcagcacctgcggcggtggcaggtcggccagggtcagcgccgcttgatggccggccttgagcgtatcgttgtcaggaagcggcacccgcgcgggggtcgaacaacccgccagccagattgaggcgctcaagaggctgaacagggtaagacgggaacgtcggttgatagtcttcatgacggctcaagtccagtaggtggaaaacatgcccaggcgccgtttaagcgagttgggcaagtagcgttcaaggtggccgaggcgataacccagcaatttaaaggcactgcgcaccaccacttcgggcgcgcggtgcagcgcattggcctcgcgcaatgcgcgcagttcggccagtacataacgtttgccttcaccgccggcgtcgccaaacgcctggcgaatccacggctcgcggccgtagaacacaccgatatcgaagtagcggcgaaactcttccagcaagcggtaatcgtgggagtgatacaccagcgcgctggcggcgtagcgcacctggtagccggccagcaacatgcgtgcggcgacgtaggcgtcttcgctgccgatcacatcctgggggaagccgcccaccgcctgcagcgcgctgcgccggtacaccgaaaacgagtcggagctgaagcaggtcttgatccccaggtgcggtgcatcggccaggcttttgctgcggctgctcgctgggtaattgaagtgccgcgactgggcgcccagcacacctgcaccggggtgcggcagttgcctgccataggccacgccattgagcggctccagttgcagctcggcgatcaggttggcgaaggtctcggcggtggcggggattgcgtcctgggtcatgacgatcaacgcgtcgccacccacctgctcgctggcccagcgccgggtgccaccgtgattgaaatcaccggcatcgatcacttccacgcgcgcgccgaattcgcgcaagcgcgccacggtgtcatcgctggaggcgctgtcgaccaccagcatctcgtccggttgcaaggtctgcatgcgcagggcaggcagcaagcggtccagatggctggccgcattgcgggtggggatgatcagggaggtacgcatcagggtttcacttcaaccggcgcacggccgtagatgtcgtcatagcgcacgatgtcgtcttcacccaggtactcaccgctctgtacctcgatcatcaccaggtcgatgatgccggggttggtcaggcggtgtttgtgcccggcaggaatgtaggtggactcgttcatgttgagcaggatttcccgctcgccattggtgatcatcgctgcgccgctgaccaccacccaatgctcgctgcggtgatggtgcatttgcagggacagcgagcctttgggcttgaccacgatgcgcttgatcttgaaccgcgtgctttcttccagcaccgtgtaggtgccccaggggcgggtgacagtgcgatgcaggctgaacgccgggtgattctggcgcttgagttcggcgacgatataccgcacatcctggctgcggtgggcgtcagcgatcagcagtgcgtccggggtgtcgacgatgatcaggtcgcgcacgcccactgcaccgagtacgcgcttgggcgaatcgatatagcagttatgcacgtcgtgcaggaccgcctcgccattgatctggttgccattgtcgtcactgggcgtgagttcgcgcagggcttcccaggagccgatatcgctccagccaatgttgcagggcaccaccgcgacctgagtggatttttccataagggccacgtcgatggagatatccggtgcggtgccaaaaccttccgggctcagttcgcgctggcgactgctgctgttttgcaggctctggctgtgctccagtgcggccttggctgcgtccaggacctgcggtgcgtggcgggtcaattcgtccagcacagtgccagccttgaagcagaacattccggcattccacaggtgcctgccgccgtccaggtagccttgggcggtggcctggtcgggcttttcgacaaagcgctggacctggaacccaacacccagcggcgccccttgttctatatagccaaagccggtttccgcacggtcaggctggatgccaaaggtcaccagataaccggcctcggccagtgcgcgggctttttccactgcttgggcaaaagcgctttcatcgaggatcaggtggtcggcgggcatcaccagcagctgcgcgtcagcgccgaaatgttcctgcacatgcaaggcggccacggcgatggcggcggcggtgttacggccaaagggctccaacagcaggtcgagggccaatcgctgggtgttcaccgcgcggtagtcgtcaagggtgcgaaacagcaggtcgcggttggttaccgtcaggatgctgtccacccccggcaagtgactggcgcgcaggaaggtcttctgcaacaggctctggtcgtcacgcatgcgcatgaagggcttgggcatgttctgccgcgaaaccggccacagccgcgtgcccgaaccaccggagatgatgcagggaatcaagccgttaagtgggttcatcaatagacttccttggtggaaagaacggcaggaatcgtcatgaaaacgatgtacagatccagccacaccgaccatttggcgatgtattccaggtcgtattcgacccgcttctggatcttgaacagggtgtcggtctcgccgcggtagccgttgatctgcgcccagccggtgatgcccggcttgacccgatggcgcgagctgtattcgctgaccgcttgctcgaacggaataccggcggccttggtggccgtggcgtgggggcgtgggccgaccatcgacatattgcccagcagcacgttgaacagttgtggcagctcatcgatgctggtcttgcgaatgatcctgcctacccgggtgatgcgtgggtccaggcgcgtggtctggttctcggcgttgaggtcggtctgctcgacatacatcgagcggaacttgaacacgcgaatcaggttgtcgttgtagccaaagcgcttctggcgaaacagcaccgggcccttggagtcgagtttgatcgcgatagcggtcactagcatcagcggtgacaacagcaacaggcccatgctggccagcagcaggtcttcgcaacgcttgataaagggcgaccagccgcgcagtggcaactgtgacgtgttgaacatcaggatgccgcccacatcggtgatgcggttatggccatagcgcaaggcggccatgtctggcaccagcatgacgttcaccgacatctgccgcaggcgcttgaccaagccattgatgcgctgttcggcggcccagggcagggtgatcatgacctggttgacctgttcggagcggatcagcttttccaggtcgcgggtattgcccagcaagggcaggcggctcaattccttgggaatgcgctcggtacggtcgtcgataaagccgatcaggccggaacggatatcgctgttgcgcgacaggtgttcagccacatgcaccgctgtttcggtaaaacccaggatcaccgtgcgctgcaagaacttgccgttcttcatcaaatggcgatacaggcgcagcatcaatatccgctccacgccaaacagcaccaggctcatggagaaccaggccgccaggttgcgtgggctcaactgtgggaacaggagcaggatctggtacatgaacagcaggatgcaaaacgccgagacccaggccaccagcatcacgcgaaaacgcaggcgattgctgaacagatcctcggagtacacccccagggcctggaacagaatgatggtcagcagcgcaaagaacaccagcaggcccaggtagtggttgcgcatgtgctcggcgacaggttccggatagaacaacaggataattgccggcaccacagcagtgaggccgtggatcagttttacaaagacgacaaaaaactcaacgaaaccggggcgagtcaaaaacaggctatcgaccgacgatttaccgcgcatagatcagatcctcaatacaccaccagaacgttcctgttcgtttgctcatccataaggcaggtgtgctttacaagtggtgcaaatcgaacgactgctgtcgctgggtaatacgtaatgcctgttcgtgcgcaggaatttacggggtgatggctaaatagtggcttccttgaggttccgtgtcaatgatttggcttttttcgccgttgccgtcaatggctctcataaggcccccatgatatgacgctttattgacattggtgggggtctttcagaataatcgagaattgatgctggctttttggagtgtaggaacaaacatggggatttgcccgacggcgaaaaaaagctttctgacgttgtaggaggggaagggcaaggctttttagtaggagcgagcttgctcgcgaaaacgtcaacgataacgcgtgtttcctggataaacgcggcgtctgtgaggttttcgcgagcaagttcgctcctacaggagggaatgtgcagtgcttagaagttgcctttgaggctcagcgtcaggttgcgcggctctccgtagagattgccccaaccggctgtgcctacggtctggtagtagtttttatcaaacaggttgttgccgttgagcgccacggtccaggtgtcgtctacctgatacgccaggcgcgcattccacaacgcatatccggcttgttcaagcttgatggtttgcagccggtagttgctgctttgggcgttaacccctgcaccgactgtccatttcgacagcgcaccgtccaactgatagtcgccccacaacctgagcatatgccgtggcacgtaggtgttggataccgcgccttcggctgtgctatcgatgttcttaaggttcttggtctgcgtgtaggtatagccgccgaacacttgcaggcgttcgagcaattcaccactgagctcggcctccaccccttgggcgcgaactttgcctgtgtcggtgtagcagtagccgtcggaggagctgccgcaacgggtctcgaagtcggtttgggcggcattcttttcgattgcgcggaacactgccagggaactgttcaagcgcccgtcaaaccactcacccttgatgccaagctcgtagttctcgcccatttttggcttgagggccgaaccgctgacggtggcgtaggagctttgtggctggaaaatatcggcgtagctggcgtataccgagagattgtcattgaggtcatagatcaacgcgccaaacggcgttaccacgccggtttccttggtgcgtgcgtcttgatcggcccactcgccccacgccaggttcagggatttgcggcggttttcgtaccaactgacgcgactgccgaggaccagcatcaggggctcggccaggcgcaggcgcaaggtggcgtaggcgccgtattgcgtggcggtctcgttgacggtgccgcctcggtacatgttgggccagaaggtgtcgtcggcaggttccgggaagtggtgattggggttgaaaacgctttggcgctggggcaggttgcggatcgcgtagacatcgtcctgggtgccgcgactaccgttggcgccgaggatcaattcatgttgcaggccaaacgcctcgaattgaccgtcgatataggcatccaggccgtagtccttgtgatcgtagtccagcagtgcggcgtaactggtgagcgtaggggccgggttgccatagtccacggtgctttcgctggcggcgtatttgatgtcttgcaggttgcggctatgcacggcgctgactttgagtttccagtcgtcgttgaagtgatgggtcagatcggcgaacagcgtggtgcgctggctttgccaatcgttccaggcctggcccaggcaggtggagcggctcaggccgaggcttttgccgtcgcggtagcgcggcaggccgctccagcacggcgtggcgtcgacatcctcatggctggcaccgaagcccagggtggtgtcagggctgacatccatgtccagggccgtgtaaaacgcctggtcctggcgcttggcaaggtccatgtaggagccacgattctgctggctgaccgacgcacggccgcgcaccgtgccgctgtcgttcaacgggccgccggtgtcgagttcggcgtggtagttatcccaggtgcccgccgacagcccgaggctggtggtcggggtggcttggggccgcttgcgcacgaagttcactgcaccgctggcggtgccggcgcccttgagcataccggcggcgccttttagcacctccacccggtcataaatcgccatgttcgcgctgaaactgtcggcctgtatgtagtccttgccgatgtccagcggcacaccatcgaactggtactgaccgagcatcttgaagccccgggagtaaaaatacttgccgcccatgggcgactcgtagctggtgatccctggcgtgcgctccagcaattggtcgatagtggtgatgttctggtcatccatcagcttgcgggtcatcacgctcaccgattgcggggtgtgtcgcaggctttgttcacccttgccgatggtcaccgcaccggtggtgtaggagccgctgccttcggtggtggcgcccaggcgatcgcctgtgatggtggtggcgcccaggttcagcgccgagctgtcttgctgctgaggcaacagcaaccaagcgttctggccctggctttgagcctgcaacccctggccctgaagcaaccggctcagggccgattgtgggtccagggtgccgttcagccccaggctgtttttgccggccacgctgcccgcgtcatatgacaggctgataccggcctgccgcgcaaattgatcaagggcgccggccagagggccaggggcaatatcccaggcgcgggccgggcgctcgttgccgggctcttgggcacttgcggtatagggcagggcgctggccgccacgctcgcgccgaggaggagggcgttgacggcgtgtctgagaggtgaacgtttggaggggaacgcttgcatgaccgcgggatgctcctgaggaaagtggacaaaaccggcctgttgatcggcctttccttacaggtcgagcggcaatgagaattcacctcatttattttcagtcggttaaacccgagcggagacggtcacccaataacggctgcggtaggtcacagcgaccggcaacgattgggccaccagtttgagtacctggtcagtgtcatccagttggtaggtgcccgagacccgcagcccggccaccgcttcgccgcaacgcaccagcccgttgcggtaacggcccaattcgtccaggaagtcatccaggcgcatattgtgagcgctgatcacgccgtcactccaggcccaggggtccaggccgttagcaggtgaagggcgaatgccgccgcggttgaacagcacctgttcgccgggcttgatcacccggcgcgcagtggtgtcatggctgccggaaaataccgccaccgcgccttgttgcacggccaataacgtgcctgctgactcttcgcgcaccagcaagcgcgtgccgagggcgcgcaggtaaccgtcgcgggtgtgtacccagaacgggcgattgtcggcgccggtatcgatcagcagttcaccctgatgcaggttcaccagccggctttcggcgctcagcgcgatatcgaaggcgctggcgctgttgagctggactttgctgccatcgcccaatgccacccagcgccgctcaccggtggcagtgcggtagtcggccataagcgcgggcaggggggtgtagtcgcgacccagccaggcgaggccggaggcgccggcaaacaaccccagcaccttcaagccttcacgccgactgatgcgttggcgcgcgccatcgagtgcatggcgactgacatgcgccggtagttgcttgaaatcgtcatccatggccgctacccgctgccaggcctgctgatgtgatgcgctgcgctgcaaccactgctcaaaggccgcggtgctggcgtcgtcggcgacgttgaaacgcagcttgatcatccactggatggcttggtccaccaggcgcgggtcagagttcggcatagcgcaaccgataacaggcgtgcagcgccttggacaggtcacgttccaccgtggccctggatacgcccaggcgcagggcgatttgcgggcaggtcaggccgtccagttgcgccaacaggaacgcctcgcgcacccgcggcttgagctgatcgagcaaacggtcgatgcgctccaggctgtcgaggatcagcaagcgggtttcttcgctcggcacctcgacttgggggaagtgcgccaggctttccagataggcgcgttccagctcgcgacgccggtattggtcgatcatcaagctgcgtgcaatgctacttaaataggcccgcggctgctgcaaggtctggtgcttgcgtgcgttgagcaggcgcacaaaggtttcctgcgccagatcggcggcgtgttcacggcagccggtgcgccggctcaaccaaccgcgcagccaggaatggtgggcctggtaaagctggccgatggcggcagggtccagagggtgatcgctcgacatggtcatcccggcgcagcaaacttaattgataatgtttcgcattctagacgttgatcgtggcattcagcaatcacctggttttctgcgcaagcaatgtatccagcacaattttttgtgtgccctgtactcgccgattaatctgggcttttcccggcggacggttcacccatgatcagcctcgtcactcttgcggttttttccggcgctgttttgctgttgctgctatcaccggggccaaatatggcgtttgtgatcagccatggtgtgacccatggctggcgcggaggctgtgcgtcggccctgggcatcgctgtggcagacctgttgctgacggcgttgaccgtcatgggggtgacggcgttggtcgccagttggccgccagcgtttgacttgattcgttacgccggtgtgatctacctgttgtggctggtgttcaagaccttgcagacgcgctccgggccggacactgcgcacgtcgaccgcgtggccctgggccgggtatttctacaggccatgctcaacagtttgttcaaccccaaggcgctgttgtttttcatggtgttcctgccacagtttgtgcaaccggaggctgggcccatcgccgttcaattaatggtgctgggtggcgtgctgacgctgattgcaggcgtgtttcacgcgctgctggggatgtttggcggtgcgctcagtcgcttcttcgccaagcgctcaaaaagcgcctggctgcagaagtggggtttggcggcagtgttgatggcgttggctgtgcgtttggcggtgatgtctcgtcctgcctgaagacacgctggacgccaagcaagcttttttgtggcgagggagcttgctccctcgccacggatgaacattcaacccaaccgcgcagccgctcgggccacaatctccccacgcactctgcgtgactctaccgtgcgcttgttggcttcctccagcacatgcctgggcgcagtctccgggctgcctgagtcgaacggcggcgccggcgcatattcgatctgcaactgcaccagttgcgccgccgcttcgctatacaactcggccgccagggtcaacgcaaagtcgattcccgccgtgatccctccgcccgtaaacaggttgccgtcacgcaccacacgttcctgcacggggatggctccgagcggcgcgagcaggtcgtggtaagcccagtgggtggtggccttgcgaccgcgcagcaaacccgccgcccccaataccagcgagccggtgcataccgaggttatgtaacgtgcggtctgcgcctgtgtgttcaggaagtccagggtttgcgggtcttccatcaacgcgcccacgcctgcaccgccgggcacgcacaccacgtccagcgtcgggcagtcggcataggtcatggtcggcgtgaataccaggccggtacttgaggtgatcggcgtcaggtctttccacaccaggtgcagcttcacgtcgggtagtgaacccaacacgtcataggggccggtaaggtccagttgctggataccggggaataacagaaagccgatgtgcaaagtcattaatcaagctccgataaaggggtggacgacctcactgtaggagcctaggctttggcgcatacgccattgagcccactaatcacgccaatcatgcccagaatcattcatgtactcgccttcgagaatgtccaggtgctggatgtgaccggacccctgcaggtgttcgcgtccgccaatgacctggcacgccagcgtggctcgccgttgccctacgcggtgagtgtgatcgccgcccaggctgaaccggtaatgacctctgccggtctggcgctgctggccgaaccgctgcccgccaacgacacgccttgcgacaccctggtgattgccggtggctggggcgtgtatggcgctgccgaagacccagcgctggtgcaatgggtgcgggaaaaggcccgccacacacggcgcatggcttcggtgtgcaccggagcttttctgctggcagccagtggcttgctcgacggttgccgggtggccacgcactggacgcgctgtgaagaactggcgcgtaagtttcccgcgctgacggtggaggccaatccgattttcatccagcaaggcgcagtgtggacgtcggccggtgtgaccgccgggatcgacctgtgcctggccctgttggaagaggacctggggcgtgcctttgccctggaagtagcgcgtcacctggtggtgttcctcaagcgcccgggcgggcaggcgcaattcagcgtgacgctggccctgcaaaagagcgacagccgctttgccgaattgcacgcctggatcgccgagcacctgacactggatctgaacatcgccaccctggcggcgcaggccggcatgagtgagcgtagttttgtgcgtcactaccgagccgaaaccggccaaaccccggcgcgcgctgttgagctgatccgtatcgaaagcgcacgccgacagttggcagacagcaccacctcgatcaaacgcattgccctgcaatgcggctttggctgtgaagagacattgcgccgcagcttcctgcgcgccctgtcggtgacgccccaggcttatcgggagcgtttttcagcgctgcagtaattccagcaaggcatccagcgtgaccttgggcgcttcctggaaaacattgtggcccacgccgggcaatacgtgccgtcgataaaaaccgctgaattgctccacatcctcatcctcttgagagggcgggcccacgccatcgtcggcaccgcacaatgagatgctcggcaccgagatcgccggttgcggcaccaatgcctgctcgatgaattccagcgcggggtcacccggtgcatacatgaatcgatggcgataggagtgaatcaccaccgcgacaaagtccgggttatcaaacgatggcgcggtgttggcgtacaggcttggcccttcacgccaggtcggtgaccagagccgccataacaactcgcagagttcacggcggttggcggtcaaaccgtccaccccgcgctgggtgtgaaagtaatactggtaccacaaacgatgctcagtttccgcagcccgaggcgtgagcgacttggcgatgtcctggatgttgtagccatcgccggtcaccagcccgcgcacccgttgcggccacagcgccgcgacaatacacgcggcgcgcccaccccagtcaaaccctgcgagagtagcctggggtattgccagggcatccatgaaatccagcaggtccttggccagcgccgcctgttggccggagcgcatcacttgatcattgataaatcgcgtcgggccataaccgcgtagatacggcaccaacacccgataaccacgctcggccagcgttggcgcgatctcatcgtagccgcgtgggtcgtaggggaagccatgtagcaggatcaccggctctcctgcgatggggccatgggtctcgtaagctacatccaacacggaggtgcgcacatagagcaatggggcaggggcactcagggttgccatacggtcttctccccgctgagcttgcggtccagaaacgtcgccgcactgatcaacgccaaatggcttagagcttggggcgtattgcccaggtgccgggcctggctgtcgaattcttcggcgtataaccccagggggttggcgtaacgcagcaactgttcaaattccagatgggctttttccacttggccggcgcgggccaggcattcgacgtaccagaatgagcaagcggcaaacgcgccctcggtgccttgcagcccatcgatctggctgtcgtcgttgcgataacggtagaccatgccgtcgcgcaccaggcttttctggatcgcttccagtgtcgacagccagcgcgggtcggtcgccgctacaaagcgcaccagcggcatcaacagcatcgaaccgtccagcgcggtgctgccggtatgttgcacaaaatgcccgcgctcctcgttccagaagttgctccagatgtcggcgtagatcgcctggcgcgtctgatcccagcgggcgaacggtgccggcagtgaacgtttggacgccaggcgaatggcgcgatccacggccacccaacacatcaggcgcgaatgcaggaagtggtgctgctcgccgcgcatttcccagatgcccacgtctttgcggttccagatctcacacacttggtcgaccacttccaccgtgtgtttccagccttcgtgggagatggcttcgccgtatttgttgaccagatacaccgcgtccatcagttcgccgtaaatatccagttggatctggtcaaacgcttcattgcccacgcgcaccggttgggcgccgccatggccgctcagatggtcaagtgtggtttccggcagttcctggcgaccgtcgatgccgtagaggatgttgatcttggtcggctgcccgcagcaggcgctgacccggcctttgagccaacgcatgtaggcattggcctcttcgacaaaacccaggcgcatgaacgcgtagacggtgaacgaggcgtcgcggatccaggtgtagcggtaatcccaattgcgttcgccgccgggggtttccggcaggccgaaggtagcggcggcgatgattgcgccgtgcttgcgcgaggtcaaaagcttcaacgccaaggccgagcggttgaccatttcacgccagcgcccacggtaattggactgggagatccagccacgccagtacttcagggtacgctccaggtacaggtcggtgcagtcattgaccacacgcggatcgtcctggccaccgagcacgaattcggcgccttcgtcctgggccagagtgaaactggtgacggctgcatgttcttcgagggtcagcgggtggctgcccaccaggcgcaggccgggctgatcgtcggcgctgaacagcacgccgctatcgtcggctgtggcgcgagtcttggcacgcgcgtagtcgtggcgcacggcgcagcgcaggtgcagggtggcttggccgctgaccacccgtacccggcgaatcagcaaaggcagctcgtcgacctcttcgctgaccgccagcaggtcggtgacttctaccaccgccgcgtcgctgagccagcgggtttgcagcacgttggtgtcgggcaggtagatctgttcgcggcgggcgttgggcaagtccggggtgagctggaacgttccggcctcgggcgtatcgagcagcgcgcagaagatcgacgggctgtcgaattcgggccaacagaaaaagtcgatggtgccccggtcgttcaccagtgctgcgctacgcatgtcgccgatgatgccgtgagcgtcgatggcgctttggggttcgcttttcaaatcaaccattgccattaaactccggataaagactcatgccaccatcgataaacagcgtactgccgacgacataatcagacgcgtcgctggccagccataccaccgcattggccacgtcttgcacatcaccgacacggccataagggatcaatttgagtaactctttctccgcagcgccttcggtggcggcacggttgatcgccgtacgaatagcgccgggcgcaataccattgatgcggatacgttgctcgctgacttcctgggcgagggtgcgcatcagcatctccacaccgcccttggacgcagcataattcacatgcccggcccaggggatgagttgatgcaccgagctcatatggatgattttaccggcggcgcgggacacgccttcgcgaataccttgacgattgaaaatacgcacggccgcacgggcacaaaggaattgcccggtgaggttgacgccgatcacggtgttccagtcctcaagggtcatgtcgaccaggttggcgtctttttgcaagccggagttggccaccaggatatccaggtggccgaaggcgtcgagcgtctgggcgaacaggcgttcgacgtcagcttccttggacacatcgccaccgatggcaagcgcccggccaccggcggcattgatctgtgcggcgagggcctcggccggtgccgcctgggaattgtagttgagcaccaccgccgcacccgctgcggccagggctttggcggcaccggcgccaatgccggagctggcgccggtgaccagggccacttgttgctgcaaggaaatctgcatcgcccacccactgtgattatgagagtcctttcagctgactgacgacgagcagtggaagttcaccgtttggctcatatgcccagtccatgggcaacaacggtatgcgcgccgatacatacccgtcggctgaccctggcagcgctgtcaaaccgggacaggtgctggaacaggggatcggccaggtaggcatcaatggccgagtccggagcatgggggctgggaggaggcccttcgcgggcggcggccggccgatgaatgatttgcccgtcgaccatgccgatttcgaccgcagccctaccggccaccaggttcacaaacgtgtgcatgtcatagagcaggatgccgttttgaagtgaccacatgtccatgctgccgacattgtgcaagcctaccgggatgatgcgctcgcattcggccggtgtgagcccgttgccgatcagcaccgcccgagccttctcatcgttgcgggcaaccagcaccaggttttccaactgtcggaccaggttacccaacccacttgccggctcccggagcaggctgagccatcccagtagaccgctatgggagcgcttcttgaggtgtttgagctgaacgccataaacctggccgtgcaggttgtcccggatgaaaaaatcgacatccacttccacggcactgtcttttgtatggtgttgcagcagttcgaaatcgagcacttcaatatgggcgcaacgtttgagccggttcaacaggtaggccttctgtgcatcagaggtggccttgccgtgccaattggcgccgagctttatttctgcaagtttttcggctgtctcgatggcgccactcgccaggttgcgcgttcccaggatcagtccgcctccagagaaatcgaacagccggtcaaccacggggagttgcgcttgaatctgacagacaagttcgtagaccggcgtgatgcccttctgcgcggcgtggcgatgatcgaagggtggggttccagggtgctgtgccccatgcaccgcgtgaatgatcatcagcagcaacggttcgagttgatcgaataataatccggccacgggaccgtagtctggcggcagtcgccaatgctggggaaatatagtcaatgccgatacgctggcgtttggcagttggtttcgtcgagccgggtcggcggccacgatggcaaggctctggatggccagggaggcagacgcaagagatgcctgctccagggctgaaccaaaccacactcgtcgaaggtgcatgcgcatggcgtccgaggacggcgtgatgctgcaaaggccggtctcatcaagggttgccctggcgatacccagtatgaccagcgccagtagctcagaaagccaaacgcattggcacgtcaggctaacagtgtcatgcgaggatggggcacccatggcttcgcatggcatggtcgagagtacggtttcaaacagctgcagatcgagcagccgcgcaatatcggtcagggtgccgtcgggtaaaggtcccgtgtcgacggtggtgtgtatctgggtttgctgcagatgcgcctcgcgggatttccacagtgcgctcgtgccggtgagtggcagcttgggtgccagcagcgcctgtatctggcacagctgttcgaccaatgtctgcacgcccgggcattcatccgtcagggaactgatgagttttcgattggattcgctcaaacagaacttgtgcgggtaagtgctgacgttgcaggcaaggcgtaaggcgtggtggcagcgggtatcgataaaaggcgtgtgcataggtgtagcgctcggccggaaggtgaatgttatcgtatggtgcttagaataaagggaatggagagggcgcgatggaatgtatatgccgacaggcaccgcacgcatgaacaaaatactcataggtctatcagcggttttgtcactggctcaaacgtcgggggccttggcagaaaacattaatggcaagacgctctacctccaaagatgcgcggtgtgtcatgggcccgatatcagagcgaccgggccattggctaaaaaaagcaatccgccaacgcctgaccttacaaccacagctttcaagcagcggctcaaggattatccgggagttatcgtgtcgtcgatcatccttcgtcccaatggcgacctgatcccaagaacgttgcgggagaacggggtaaagatagcgccgcatgcctggagcattaaggatctacgcgacctgcatcaatatatgagtgcggttatttcaaaaaaataagtgctctcgggaacagaagtggcgcaggcgatcagcagcaattgccctgcttaataggaagcattactattcacgccccgcctacccagtgcatccgcgatgacccctcagccgccccgcagaacaggctttttcgagcactacgaagagttgatcggaacctggacgcgccgcctgagaaaccgccagcaagccgaagatctggcccatgacacctttgtgcgtgtgcttgagtcccgcgccagcgaggtagtacaaccgcgcgcctacctgcatcaaaccgcacgcaatattgcggtggacgcctaccgccgcgaagaccgccgcgcggcgctgacgcttcaagtcattgatcacagcttgccccatggtggtgatccggagcattacatgcacgcgatccagttggccgattccatcgagcgggccttggcggagctgccgctcaactgtcgcaggattttcatctggcagaaaatcgagggcctgacccagcaggaaatcgccgagcgcctggggctgtctaaaaacatggtggaaaagtatatgatccgcaccctgcggcatctgcgtgatcgtctggatgcgatggcgccatgacccgctttgaatcaggatcttgctcgatggataaccgtgtccgtgatgaggccgcgcaatggtttgtacgcctgcaggacggcccattgaatgccgaggagcggcaacgtttcgatgcctggcgggcgcgggcgcctgagcaccagtatgaattcgatgtgctgcaagggctgtggggcgccaccgatctgctgcccagggcccgcttgcaggccttgggcgatacgccggtcgagcctcccaggcgccgtgcggtattgcactatgccgttgccgccagtgtggtcgccattgcagtgggcctgggtttagtcagcggggtgggccagtcaaagccttacagtgcagagttcagcacccgattgggcgagcatcgccaggtagccttgcccgatggctcggtgatggacctcaacagccgcagcgtggccgcggttcgctatgaaaagggcctgcggaacgtggaactcaagcagggcgaggcgatgttcagtgtcgagcatgacgccgggcgcccgttcgtcgtggtcgccgggtcaggtcaggtaacggttaccggtacgcgttttgatgtgcgccgtgatgaagaccagacccgcgtggcggtcgaggccggtacggtcaaggtgcaggggcgcatatcggatcagacagtgacgctcaccgccggccgtggcacccatgtcgatacccaaggccaagtggcagcggcctacgcggtgaaccctgaagaactgacagcgtggcgtaccggcaaactggtgttcaacaatgccaccttgggcgaggtggcccgggaagtgtcgcgctaccgtgagcaaccgctgcgtgtcagtacggcagcggtgggcaacctgcgcctgaccagcgtattcaaatccagtgacaccgacgccttgctcaaagccttgccgcacatcctccccgtggccttgcgcaccttgccggacggcagtcaggaaattatttcacgctgacattcaggtttttttcgagttcttcgtcttctcctgcaactgcaactggtttgcattaacagccgcacactcttgcgatcacaggactaggttcgacgtgaaaaaactcgccatccacaataataaaatctctcgctgggctcccctggccctggccattgcggtcagcaccgcgctgcctgccacgtatgcggccgatggcatacatatccgcgcccagtcactgggtgctgcgctcagccaactgggccagcagacttcgctgcaagtgttcttcagccccgacatggtggccgacaagcaagctccagcggtggatggcaacctctcgcccgaacaagccctgcgccaactgctgcagggcagtgggctggattaccagatcgacgccggctccgtgaccctgcgcccggtgagtaacggcaccggtgaagcgggttcaccgttggagctgggagtcaccgatatcaaggtggtgggcgactggctcggcgatgctgatgccgccgtggtgcaaaaccatccgggtgcgcgtaccgtggtgcgccgcgaagccatggtggagcagggcgcgatgaacgtcggtgatgtgctgcgacgtataccaggcgtgcaggcgcaggaagccaacggcaccggcggcagcgatatttccctcaacgtcggtgtacgcggcttgacctcacggctgtcgccgcgctccaccgtgctgatcgacggcgtaccggcggccttcgccccgtacggccagccgcaactgtcgatggcaccgatttctgccggtaacctggaaagcatcgacgttgtccgcggggccggctccgtacgttatgggccacagaacgtggggggcgtgatcaacttcgtgacccgcgcaattccggagaaattctccggtgaggtcggcactaccctgcagacctccgcccatggtggctggaagcatgtggagaacgcctttattggcggcacggcagacaacggcatcggcgccgcattgctgtactccggggtcaacggcaacggctatcgcaacagcaataactccaacgatatcgacgacgtgatcttcaagacccattgggcgccgaccgatcaagacgacttctcgctgaacttccactactacgacgccagcgccgacatgcccggcggcctgacccagcagcaattcgacgccaacccgtatcagtcggtgcgcgactgggacaacttcagcggtcgccgcaaggacgtgtccttcaagtacatccgccagatcgatgatcgcacccaggccgaagtgctgacctactattccgacagcttccgtggcagcaacatcgccaaccgtgatttgaaaaccctcagttcctacccgcgcacctactacacctttggtatcgagccgcgggtgtcccatgtgtttgacctgggcccgagcacccaggaagtcagcgttggctaccgttacctcaaggaaggcatgcacgagcaagccaccagcctgaacctggtcaacaacgtgccgacgccgggcgggcagagcgatggccatgtctatcaggaccgcaccggtggcaccgaagccaacgccttctacatcgacaacaaaatcgatattggcaaatggaccatcactccgggcatccgctttgaagatatccgcacccaatggcatgaccgccccgtcgtggccctgaacggcaagcgtaccgaggaaaaacgccgcgagatccacaacaacgagcccttgccggccctgagcgtgatgtatcacgtctccgatgcctggaaactgtttgccaattacgaaacctccttcggcagcctgcagtatttccagctgggccagggcggcaccggcaaccagaccgccaatggccttaacccggaaaaagccaagacctacgagatcggaacgcgctacaacgacagcgtctggggcggcgaagtgacactgttctacatcgacttctcggatgagctgcaatacgtcagcaacgatgtaggctggactaacctcggcgccaccaagcacgccggtgtcgaagcctcggcccactacgacctgtccaatctcgacccgcgccttgacgggctgacggctaacgccggctttacctataccaaggccacctccgaaggtgatgtaccgttcaagggccgcgacctgcccctgtactcccgtgaagtggcgacgctgggcctgcgctacgacgtcaaccactggacccataacctcgatgtctatgcgcaatccaagcagcgtgcaccaggtaccggcaccacctacattacccagggcaccgacgatggccaatatggcgacatcccaggttatgtctccgtcaacctgcgcagcggctatgactttggcgcgcaattgtcgaacctcaagctgggcgtgggtgtaaaaaacgtctttgaccagcagcattacacgcgctccagcgacaacaacgccgggatatacctgggtgagccgcgtacgttcttcgtccaggcaagcgtcgggttctgatattcagttgataggaaaaatcgcaacccacgggttgcgatttttttttgctcgggcacgccgccgctttgcctgggggcagcagctaaaagaccattgcctgctcgatctgtttcctacactcgcacagcatatattgttgctggcacaggaactgattccgacaaaaagccacacatgggaaagctgatgggcttcgacactacgttggagcgacaagctgaaaatcgcgcccactgtaatggagaaacgcatgtcggtaccgatgttggatccatcccccgtctctacctcatcaacctctgatccttcgcaggccactgccaagcccgaggtcaagaacactcgtgaagcgcctgctgcgccttctttcaaaggtcagagttccgccaacgtaaattttcaatccggggaaagtaaggccggtccagtgttcggcaaccatcaggcggccaccactggcgcagatgtgtcaggcagccaccatcaccatcatcacgctcctgcaatgcaggatttcctgagccagttcaagcaatggatgaaccaatggttttccggacatcggccgcctccgtatccaggctgcggcggtccaccaccaaggccgaacccaggttgcagcaatccgccgccgaggccgaatcccggggcgagcaacccgccaccgcgaccagaccctaccggcggagaaaggccctatccggtcgcgcctggcaggccagatccgcaatactcgctgaagaacaatgaagagttggcagcgcaattgcgcgacagtttccatgctttcagggaccccaggaatccagggtatatcagtgttgacagcatccttgcgatggcgagaagagggtggtcgcctaaccccgccatgcgggagaacattcgcttggccaatgagctgctgcggcgtccggaactgatggcggcgcttgaccgacaagcgtctaccggtgcattggataatctcatcgactttcagaatgtgatcgcggtcatcaagggcgaaaactacttcaagtacaagtctgacaaggagttggccgctgaaatgctcgagcattttgacgaattgaagggctggccctgggggccagaccttagaatccacgacctgaaaaagctcgcccgccaacctttcacaggcgacgctgaaaaggaccaccttatccagttggcccaggcagtggtccagcgaggtaatctgctcaaactgatggacgaccttgccagtaaagacggggacggaaagatcaattggagagcattggtcctattgtccaagtgaccaacctacaggcgctgcacggcgaatgcggcgcctgactcaattgttcgaggaacggattacactcatttgccacatagctgatatctacagtagtgattcacccgccgcttttcagattccgagtgagggcaaactcatgacttcaacctcgtttaactcccccccatcccagcgccttgaactcttgcacagcacccaggacgcgaaacttgcggtatcagaggagggcgcagcaacgcgaggcctgcacacccctgcaaaggaacatgcggcccaagccctgcgcatgaaggcttttgccggtcagcgacaattccaggcgcccgtttcggatgacttttccaggggcatgcttgcggacggacagacccccgaagatggtgccggatcgataaaaaatgtcgggctgattcacaccctcgcgggctggtggcgcagacgcaagttgggttgagcgtcgctggttgcggttttacatattgttattggtattcgttgtccgtaaggaactgccgggttcatccaaccacacatgatgtgcttgtccgagtggaattcattcgttgattttggtcatcaccgagccgatcaccaagcggatatgcatctcaaagagttggagaaaacccatgtcaatcgatggtgtactacctcccgggcggtctcacgcccctggtggaccggccccgcaacccatggcgccaccaccggtcgacagcgctggagcctggagtgaaacgccctccgtgcctgcggctgttgggcctcgcaagcccttcctgctgcgcgaaacattgtctgtcctgcgtcatcgaaacttgcagaacttccccccgcagcgggcgcagttttccctgccgggccccaactccacggacaagcaattggcgagtgccctggagaaagccttcgggttgctgcactcgtatatgaatgacgggcgcttgacctggttgtcattgcagcggatcgccgctgagcccaccggaaaaaacgaggagttggacggcgcgattcaggtcgtccgggaaattctcgagcgcccgcgactaagcgatgcgatcttcggtcgtgacggtgatatcacgcgagatagtctcagggcggcggcccaggcgttgcagggcaacagctccccaagcgccttcagccaggatccctttcatgcccagggcaatgctgatgtggttgaggcgctgcaagggcagtttgagcacttgagagataaaaccaaggatcggacctttcttttcgaacagcaccagtacgtcgacatcgcaaaactcagggaagttttgcaggatccgtatgaggttgatcaacagggcaacccggtgctggacccgtccaccgggatgcccaggtccaagtacagcgaaatgtgcgtctacacgatgaagaacatttttgagcggccgggtctgctacctgcgctgaagcatgcgaatactccacgcctgtttggcccgccgcatgtagaagaccacctgtgcaacaaaaacctcgaacgttggcaggagcagcacaaagctcgcaaagcgcgttgagccgtgacctacaccttgaggattctgccgctgatagcgactgccgccagcaataccgcaatcagcacgaaagcggtactcaaactgctgccatgggcgataaagccgatcatggcggggccggcgagaataccggcgtaacccagggtggtgatggccggcactgcaatatgttcaggcatgactttttgtctaccgacggcggtgtacagcaccggcacgatattcgaacacccggcacccaccaatgcgtacccgagcaacgctgtttcccaagccggcaataatgtcgccaggagtaagccggcacacgccagcgcgccaccgatcacgatcactagcgtggcgcccaggcgtcggacaatggcatcaccggtcaggcgcccagcggtcatggtcaaggcaaatgccgcgtagccaagaccggcgtaggcctcatccaggccacgctcagcactcaggaataccgcactccaatccagcacggcaccttcagccaggaacacgataaaacacaagcagccgataaacagcaccactccgtggggcactgcaaatgcaggacctgagctttcactgccatacggcaacaggtgcggcgcggccttgaacagcgcaactgccatgataatgaccaccaccagggtcgcctgcaggggcgacaggcccagccccagcaaaccggaaactcctgccgcgccgacaatgccacccaggctgaagaggccatgaaaccctgacatcatggtcttgccactggcgcgctcaacgatgacggcttgcagattcacggtggagtccacggtgcccaggcccgcaccaaacaggaataacccggcgatcagtaacgggatcgaactgacagtggccaacatcggcagggccaggcagatcatcagcgtcccggcggtaagcacgcgccggcaaccgtagcgagacgccagcgcacccgccgccggcattgcgatgatcgaacccacccccaggcacaacagcaatagaccaagcgtgccttcgttcaggttcgcgcgcgccttggcatacggcaccaagggcgcccacgcggcaataccaaaaccggcgataaaaaaagcgatacgggtggacatttgttccaaccgcccgggaaccacgggggctggagtgggaatggcagtcatgaaaaatccttggttttgcgttcagcgaacgatgtccggcgtgacatccttgcacatcaggccttttcgagcgagcagggttcccttcgcgtgcggggtaaaaaatgcggatcgatagcattattttacgaacacggaacgcgttgacgcttgaaaaccacactgacgttatcgtgcctgtaaggggtgacctgaaggtgtgtaatccttgtgagggtggttgagcctcaggtttcttgcggtggattaccacctttgagcccacttcccacacatcgagcgatctgtaatacgctgctgtcgcgctaagcaggtatcagagcggacgaaccgatgaaaaattcaaggcgggcgtggtcatgacccggttttacgatgcgcgcggcaatatttatggcgtggtcagcccttcctatttatgcagccggggaattgaggtgcccgacaacgccggcacggctgcaagcacgcgcaaggcgtgggccgcgtcagctgttgcgtccgaatgtagctggggttcattgccacgtgcgaaggatgccaaggcgtaccgttgcgacggtttgctggtggggcctttccaggcccggccaccgtttgatttactgatcatcaataccgacggctccctggccgaacgcagtggcaatggcctgactatcttcgcccaagcgttgactgaccaaggcatgatgacccagggcagcgaattgcgcgtgtatcacgacaagcccgatgcggtatcgcccgtggtgacttatatcgagcctgcactctacgaacagatacgtggtttctggctgaccttgggtcgccccgagttcgggccgctggcagtaggggcaattggcgtgggtacggtggcagcggggcgacatgagttcagccatgtggcagccctggccgcgattgaccctcaatggcggcgcagtcagtttgtgcgggtgggcaaccccattgcgtaacgttactggagcaggcgtgcgccttgccagctaacgatacgatgcatcagccaaggttgttcaaccgtttacagagcatcgcctttgcccctccggcaggtagtggccaaccctgtgtcggtggggtcaacctgcagtgggccgctcgggactccggcaagcgcgtcattgcccgtgtatttgagcgaggtgaagggcctaccgcgtcttcgggcaccagcgcttgcgccgtggcttgtgccgcgtggcgagcgggttgggtggaggctggagacgtcgccgtggtaatgccgggtggtacggctccagtgcatttgcaggcgaaggctgggaacctgttgagtgtcagtctgtttggggccgcccgactgataacctgaacctgtgaaaaccccggacggcttaatccggtgtcagctgtttcctgaattgttacctgttaaaactgtaagtcaaagtaagaaatttcttgatattagcgagccttgttttacagcgtgtcgctttttttaaaagacacttccaatctcgacgtacgaaacttctcttttattttttaacatccgaaacgttgccgaaatcgctaagctttaacgtgttcaggtgcttttttcgcaagccattgagggttggcgtggaagagtatttcaatcgaaaaagttgatggcgggtaacaaaggatggttcacgcgttttcttcctcacgttttaaattgttgcttccaggtattaatacggacttccaggttttgtccttcaaaggtcacgaagccctcgaccagccgtacttcattcacatgcaattgatcagcgaagacccttccattgacctggaagccttgcttcgtcaacccgcctatctggacttcggcgagggggatacgggcctgcatgggcaggtctacgccatcggccgggatgaccagggcgtacggttcacccgttatcacctgacgctggccccccgccttgcatggcttgcccatcgccgcaaccagcgggttttccagcagcgcaacgtgtcgcagattattgcgacgatccttgagcaccacggcattctcgccgatacctataccttcgagctcgggccggtggtgtatcccccgcggacattctgcgtgcagtacatggagtccgacctgcacttcatccagcgactgtgtgaagaggagggtattcacttccattttcgccatagtacggacaatcatctgctggtgtttggtgatgaccagacagtatttcgacggttaccggtgcagcgttattgttcatcgcctgatcctgcgctcgaggcccgcgtagtccagcgtttcgaccggcgcctgcaaacccgcagtcaacgcagcgtacgccgtgatttcgactttgagcatccttcgctacacctgcaagcccaggccggagccacggatcctttggaagactatggctcccccgctgggttcaccagccgtgaacgaggtgctcaactggcgcgccgcggcctggagcgccatcagcgtgatcgtcatcgagtattgggcaagagcgatcaaccggcgttatgcagtggtcactttctcgagttgtgcgatcaccccgattcagtctgcaacgacttgtggctactgacttcggtacgtcatgagggctaccaaccgcaggttttggaggaggccgcatttggagtcgacaggtttcaaggctatcgcaaccgcttcaccgcgacaccttggagcgcagtgcatcgaccgccgctcaagcaccccaagtcgacgatcagtggcagccaaaccgcgacggtgaccgggcctgcgggtgaggatatccattgcgatgcctatggccgtgtgaaggtgcgctttcattgggatcgtcgggacaagcctgacgataccagcagctgttggctgcgggtggcgtccggttgggcgggggatgggtttggcgccatggtcattccacgggtgggcatggaagtgctcgtgagcttcctggagggcgaccccgaccaacccctggtcagcggttgcctgcccaacgcgctacacctgcccgcctaccctttgccgcagcacaagacgcgcagcgttctgcgtagccgcagttctccccacggagcaggggccaacgagttgcaccttgaagacaggcgcggcgaagaactgatctacctgcgcgcacaacgcgacctggaacaacaggtgggccgtgacagccgcctggaggtcgccgggcagaggcatgaaatcatccgaggggtgagcacgctccggctggaaagcgaggagcatcgccacgtcgacggtgatcgcaaggtaacgctcaaggcacatgaccaccttgacgtacagggcgatagcctgacccgagtgggccagaccctggtgatcgaagccggccagcagattcatctccaggccggtgccagcctggtaatcgatgcgggtgcgcaactgagccttaaggcgggcggagagcacctggtgattcaagccgggagtattttcagcagccgcaccatcagccttggtggcacaccgtcggcaacccatccggtgggccctgtgcgggttgacgcgccaatatctgcggtgcaaggcgtcatcatggacttggccaagcaactgggcgcggatttttgccccctgtgcgaaggctgccgagaaggcggctgcgatatcgtggggagggcggcttgatggacagcttgcccaatcgatggatggctcaacagcggcagagagggtacgcgctgtgcctgatgctggagggccataacacggctcgccaacctctgttggcagggcgcggcccattgcactattgcgaactctacagcgagaccgatgcggcgcaattggcgagctcaggcccggtcatagtgttgctggagcagatgcaggaacctgcattggtcgagctgctgcaacaccccgagtcgaattgggggtggatgggtagtttgcctgatgccgatttggacgatgtgacacgacattggcgcgcgcgattgctgctggggcccaagggccagcaggtgctttatcgaattcacgacaaccgcaccctagggcgtgccttggcccatttatctaaagcgcattggccggactacctcgggccgctcatcagcgtgtgctattggcacgaaggccgttggtgccaggccgagaaccccgcaccaggcgactatccggtacccgacccgtcaccttggctggatgcacccaatccccaggccgaagccatcctgcacgccaatatcctgcgctacctattggccgagcacagcgaagacctggctgcattggttgagtttcaagacccgaggatctggctggcccagatactggagcaggcacgcacctggcaatggcacacgcctgagcagttggagtttttggtggtgcgtcggttggaagaggcgacccgcagcagcattgtccattggcaaccgagggtaggcgaggcgccaggggcgcattttgaacgggtggtggagcagtggcgtagggaggaagggaagggtgaatagatggatgaaagtggggttgcttgtggtcggggtcgtagggttttcggggtgtacggggaagggggtagagcattttacgttggaggtggatttgccgccgcagtttgaacttaaaacggcggctaattatcgatctgcaacgggtgaaacctgtgtcttgccgagacgccggggcaagagaccggagcggaaagtcttttttacagactacaaacctgtcgcgagcagggtgagttatgagttaccgctgactgaaacggtagaagggtgcccgttggtactgcgtagtttggagtttgatttctatgcgaaatggggaaagcggagtacggatgtgggtggtaactttgcaagtatttccattcaagatcgtgtggaaggtgagttgccagaggcggacatacagaaagtacttgggcaatgtagatggcattttcggacggtggggccgttgcatgcaatcaggaaactactgatctgcaattcactggattcaatgggggcattgcgaaagtcgcgggtggggggcgttgcgcaacggtcgcagttagctgggaaaaagctgaggctggtgctatctgtcagcaaggatgagttgcctgcgtttgatgacagatggatagctgtcccgggtgggtggaaacgttgcagagggaagagtttcgaggacctatatgggtattgcacagataacgccacggaatttaaacccataaaaatgccggacgggcgcatatgtgatatctacccaacatgccaataacaaggatgaagtcatgaagttggacggatggaagcaagcttattttgatgaacaaatgcctgcttgcgcattacaaggacactgggcaagttttcgtttggtcgatgaaacgtgcagtggaaaggcttatggcgggcttccatacacgctccatgacagttcagggcgccaatacatcggtagattgaatagtgatgggttcgcccagctgcgagatttttaccgaggccctgttgttttgatattggatagtttgtacaccggaactgaggaaccttattacctgcttagaactcgccaaacatacaagctacccattacagagcttcaaattcgcgccgagcgaacatttttttccgggaatgacggtaagcgtgttgagcgagatcctgcgaatcatcaagggcataggttttatcaagttgaagtcagggatttagtccgccataacgctcacttaccgccgttggcttcgtcagctcatcgtcccaagcggcatgcattaaagatgatggccgaactcggcttcggtccacctcagccattgttgtcaggagtcgtattgttccctaatcaacattctgtacttgaggtacgaccgttgcgagccctacggccattgctatccactgtcgaccagttgtgcgctttgaacctgtaccaactggctctaatatctgccgtcagttacctcgattttggtcagcagccctctgagcgtccagttgatcaggtcatcttcccgctggcccccagcattggacatttattttccgagcagctctcgatctgcgaggaagcctggcaaatcgatccgaagcaaacgcagcgtttctatccgctctatgaagaagtcccatactcccagcgtttcgaaatcctgcctttcgatcccgacttatatccccaaaatcgcccggaactaaaggacaagcaggaacaccctgcacgcctgcattttttcgatgacgaaaaatttggcactgatacccaggcgttcatcactcaccacgacgaggtcatcctgatttccgtgcgaggaaccgtcagcggtgctgatgcgctacgtgacgcagacgcccatcaagtggctttcgtcgacggcgttggtaaagtccacgagggcttctaccaggcttaccgtgctatgcgtgatttcgtattgcaataccttgaccaattccacattggccagcgtattgtgatttgcggccacagccttggcggcgctattgcattgctgttggccgaagggctgcgccgaaccccggatgctaactacaacattctcctctacacctacggcgcccctcgcgccgccgactccgagttcatcgccggcgcctcatccctggtccatcaccgcatcgtcaaccacaacgaccccgtccccagcgttccggcgcgttggatgaacaccaccgccaaactctggatccccggggccatcacattattcagtgcccctgcacccggaggcctattgttcgccgccgggctgatacgtgtgggcggcaacccctatcaacatcacggtgagcaacatcacttcatgccgatcacgctcccggacggcacccattcttcggtgctatggaaacctggctgtgagtccatccaggaggcgggctgtcatcgtgcattgcaactccagggggatatgcccgaccgtgacaatctgctgcggcagctttttcaggccggccaacacttcatgaccgccagctacatcccagcagcctgggccacactgcgacgctggcagcaagccctggatcgccaaggccccctggtgaccttgagggagtttgagctgctcgaccgcgccctcgaagatatgcgcgagcaactgagagccaaacggcgagaacttgcccgccagcgtcccgccaatgatcgcagctatgaacctaccgatgccttgaacgccgagatcgaccgcttgcacaccagccgcgagcgcctggcaaccctgcgctggcgtcgccttgaagctcgcgacgtctacggcagtcaagcacagtctgcgcaactgcaatcgagcctcaaacgttggttcagtcacgctgaaaaccgcgagcttgctcaatttgccagcattccgccgcctgcacaccatgatcagggaaaagcgcaaacgctggacatcgactcaatcgtctagccagccgggttatataaaaactccacctgcgccggctgtcgtttcatcagcaccttaccgttgcggatcgagtacagcggcaggccctggctgcgaacgacctcatagtcgctgtcggcggacaggatcagcaggttggcggggcgaccggcctgcagcccatatcggtcgcccagggccatggccttggcactgttgtcggtcaccaggtcgagggcgttttgcaggttacggtagccgagcatatggcagatgtgcaggccggcttccaggacccgcaagatgttgccgttgcccagggggtaccaggggtcaacgatggagtcctggccgaagcacacgttcatgccggcctcaagcagttcgttgacacgggtgacaccccggcgtttcgggaagctgtcgaagcgaccttgcagatggatgctttcagtggggcaggagacaaagctgatgcctgaatgccccagcaaacggaacagtttggcgcagtaagcgttgtcgtaggagcccatggccgtggtgtggctggcggtgacccgcgcgcccatgtcgcggctgcgggcttcctcggcgaggacttcgaggaaacgtgagtgcgggtcgtcggtttcgtcacagtgcacgtccaccaggcagcccgtgcgttcggcaaggtccatgaggaatttcactgaactgaccccttggtcgcgggtgtattcgaagtgggggataccgccgatcacgtcggcgcccaggcgaacggcctcttccattagttcgcggccattgcggaacgactcgatgccctcctgggggaaggcgacgatttgcaggtcgaccaggtgcgcgctttcttcgcgcacctccagcagggccttgagtgccgtgaggtccgggtcggtgacgtcgacatgggtgcgcacatgctggatgccgtgggcggcgagggcctggatggtttttttagcgcgggtcttggtgtcttccagggtaatagtggccttgcgctcaccccagcactcgatgccttcaaacagcgtgccgctcatattccagcgcggttccccggcggtgagggtggcgtcgaggtggatatggggttctacaaagggcggtatgaccaggttaccggcggcgtccaggtcgctgctcgtgagtgtcggggtcccggtgtgcgcagtaatgctggcgatccggccgtgttccaggtgcagatcatgcaggccttcacggttgcgcaggcgggcattgatgatgtgcatggtcaagttcctcttggctaaaaacaatcaggcagacagccgccggatcctcagggcgataccgatgtccaggcggtcatggcgcgtagtatggcgctgagcagcatataggtcagcgacgcggcaacaatccccaccagtggtgcgacccaaggcgagttgaacgccagtacggtgcccaccccataggctaccaaaccgggccagttgaacgccggaaggcgggcttgcgccaggcgtgggtattggccgcgatagcgatagaagaagtccgccatgatcactccaccaatcggcgggatgaccgtgcccagcaggatcaggtacggcaccagcatgtcgtacatgccgagcaaggcgagcagggtgccgatcaccgcaccggccagggtcacggtcttgcggcgtcgggtgcgcagcaggttgcagccggcgacggcaaaattgtagatggtattgtcttgggtactccagatgttgagcagcaacatggccatcgccgccatggcgaacccctgcagcagcaggacttccaccacatccggttgctgatagacgatggcgccataagcgccgatcagcaccatcaggccattgccgataaaaaaaccgatcaggcttgccagcaccgcgaccttggcggagcgtgaaaaacgtgtccagttggtggcttgggtcgcaccgctgacaaaggtgccgaacaccagggtgatagccgtggataagtccaattcaccggttggcaccaccgccagcagtccatccaggccgccgactttcagggtcgccacccacatcgacagaaccagcaatatgcccatggccggcacggcgatataggacaggatttccagcccgcgataccccacgtaggccgtggcgcagaacagcaagccaaacaccaccatcaaccccagcacgctgccctggctcaattcgaaatacttgcccaataccacggccgccgtggcagtaccccaggcataccagccaatctgggtaaaacccaggatcaagtcactgagcttgctgccgacttcgccaaagcagaaacgccccatcaacaccgagttcaagccgctcttgaaggcgatgtaacccagacctgcggcgtagatacccagcaacaggttacccagggccacgacgccgagcatctcggtgaaactgaacgctaccccaagcttgccgccggcaaacatggtagcggtaaaaaacgtgaagcccagcagcaccatggccgtggatgccaggcccttgcgcgcatgcaaggggacttcgctgagggggtaatcgttgcctggttcctgctgcgtcatgtgggttgctccctgaatgagtgacgcaggcctgttgcagcgtgcgtgccaagtcagaggcagtgatgcgcccagtttgtgcagcgtatttatagtcaaaccagcaagtgtcgcagagaaggtcatgccagagttgccgatcaagcgcgaaaacggtgcagcaagtgacacaagttggatctgttaaatcgcctgtagaaatttgctcatgtacacccggcgcagaccgttttccacggcccgatgggtttgtgcataccctcgacgagcgtatagcgcgatgttctcggtcatggcctcattggtgtacaggtggatgtgcgtgtacccagagtcggctgcttgttgctcggcgaaatccatcagcacgcgccctagccccaggccttgggcatccggtgccacggccaggttatccaacagcaggccagtgtcggtatcgagcaggatgataaagccttggacctgccccgcatggtccaatacatgtacgccaccggcttcgatccgctggcgatagtcttccagcatcggcgcgggtttgcggccgatgcgcaagacgtaaggtgagtaagcggcctgggcgatggcctcaatggcagcaagatcctggacagtggcggggcgcatcattgcaatgagcttctctggaagattccaccggcgcttcgaaaaaaccacccgcaggtggttttccgacacgcgatcgcttactcgccgcgatagatgcagccgctggtgcaggtctcatggatgcggatcgcaccgagttccggcagcaggggcttcaattcattccagatccacttggccagcacttcgctggtggggttttccaggccggggatgtcattgaggtagttgtggtcgaggcgttcgtagagcggcttgaaaatcgccttgatctccgaaaagtcgcgaatccagccggtatgggggtccaggtcgccgctcaggtggatcgcaaccttgaacgaatgcccatgcaggcgcccgcatttgtggccctccggcacgtggggcaggcgatgggcggattcgaatgtaaattccttgaagatttccacagtgttttcagctcggtcaggtgtctggcagttggcgagtttaacagcttgatcagcccctgcgcacaccgctcctgccgtcagagggcaagcagtcggtcgcccagcgcgctgttgtccgccaaggccaaaaactcatcccctagtcgccgactctcgctcatcgcggtttgccagtacttgttgcggctcgggtcatcacccatgaagcgcttgaaatcactgcggtccggcagtttgccgtagggcaggcgtgccaggtagtccctggagggcgccagcagcaacacatcctgcaagccttgcgggttgctgcgtcgccatggcaggcccttgtcaaaccagcccgggatgacccggtcagtgaagtgcgggtacagcacaatgtcatcgccgtggtagggcaggtcgaggtgatagtcgagcaggccaccgtcgcgataggtgccggcaccggcgccgggcaggtcgcgcacgccttgcatgaccatggggatcgagccggacgcaagcagcgcctggcgcaggttgcccaactccaggctgaggaagcgcgatgggaaatcgtgaaggggatgcaccggcggtgcctggcgcgggtcatggatgatcagccgttcgaaatgccgcgacagccgtgcgcggccccgcaagttatccgcgatcaccgaggaaaggcccagccccagccgcccacggtggtcgtcggcgagcaggccgtggctcttgaccaccatgatgttcaggcgatagtcgggattgtccagtatgcgtgcatcacggccagccagcaggtcatcgagcatgcgttggcaactctggctgacgccggccatggtcacgcctttggcgaagcgctgttcgttatacaggcggcccaggtccagcaagccttgcacagggtcgggcaggcaggcgctggcgaaccgccaggaaccgatggacgcgccgatcagcgcacgctcgcgcggcacgcggggtagccagtcaccaaacagcgccaggtccaggccctggatgcccaaggccttggggccgccagccgcaccggggagaatgccgacgtcggcaggcgcaagaccctgctcgcgaatgcgggcgaaggcgcgtttgccggccttgagggtcaaggcagggaacttgatatggatggctgtcataccggtctctgattgggcgaacggggcattatagaaaatattgcagacggtgggagaaacggcttgcgcgcaattgccatggtggcaattcagtttcagttaagttgcaacaggtagggtgaccggcgtaggaaaacatcctgtaacggagacttatcatgacgcgcctcactgttctgggcgccgccgctatcatcatggttacggcggcccaggccgcagccgtggacccggacaagccactgagcgtccccgccactgttactattgtcgcctttgaccaattggacgccacagccctggcgctgcaccctggctcgacgctgctgggcaccgacctggatgaggaatacggcaagtacgtctatgaagtcgaactggaagatcgcaacggcattgaatgggacgttgaactggacgcgctcaacgggcaggttctcaagaatcatcaggatacgtaatgaaggtaaatttacgcggcggcagtcgagtggcgctggtgctcatggttttctgctccggcctggcggcccgcgacctcaatcaggacgaggccttggcgctgcgccagcagggggtgatcctgccgctggagcaactgttgcagcaggccatggcgcggtaccccgactcgcggctgctggaggccgagttggaaaagaaacacggccaatatgcctacgaggtggaactggtgaccaccgaaggcgtggtgcgtgagatcaaactggacgccaccaacggtgacctgatcaaagatgaggaagactgatgcgcctgctcctggtggaagacaacgtgcccctggctgacgagttgctggccggtttgcagcgccaaggctatgcagtcgactggcttgccgatggccgcgacgctgcgtatcaaggtcgtagcgaaccctatgacttgatcatcctcgacctgggcctgcccggtttgcccgggcttgatgtgcttgcgcaatggcgcgccgctgcgctggccatcccggtattgatcctcaccgcccgcgattcctgggccgagcgtatcgaagggctcaaggccggcgccgatgattacctgagcaaaccctttcaccccgaagaactctacctgcgcatccaggccctgttgcgacgctcccacggccacgccaaccagcccaccctgcaggccgcaggcctgcatctggatgaagcgcgccagtgtgtgctgcgcgatggtgccgagatccagctgacggcggccgagtttcgcttgctgcgctacttcatgctgcaccccgaacagatcctgtcgaaaagccatctggccgagcatttgtatgatggcgagaccgagcgagactccaatgtgctggaggtgcacgtcaatcatctacgccgcaagttggggcgcagtgtgatcgaaacccggcgcggccagggctaccggtttggcgccgccccggcatgaagtcgatccagcggcgtttgagcctgggcctgatcagcgtgatggtgggcgttggcgtagtgctggcacaaaccagcctgtggctgttcgaggccggtttgcagcgttacctggaagcgggtttgcgcaatgacagtgagaacctgctggtggcgttggtgcgtgggccaaacggcgtacagctggatgagcaacgcctgtcaccggcctatcagcgaccgttctccgggcattatttccggatcgactttgccgatgtccactggcgttcccgttcactctgggatcaggaactgccccgcctgcccgaggcggggctcaagggcaacctgcaactgggcccggaaggccagcaattgctggtgttgcgttcggactacaagcgcttcggcctgccgatttccatcagcgtggcccaggattacacacccgtgcgggaaagttttcgcctgatgcgccagattggcctggtgatggggctggcggcgctgctgctggtgctggtcctgcagcgggtcacggtgcgccgcgccctgcgcccgctggagacggcgcgcaaccagatcgcccaactgcaacagggcaagcgctcgcagctcgacacccaggtgccattggagttggaaccattggtggcgcagatcaaccatttgctggcgcacaccgaagacagtctcaaacgttcccgcaatgcgctcggcaatctggggcatgcgctgaaaaccccaatggcggtattgctgagcgcggcctccagtgaggcgctcaaggatcatccgcagttgagccagctattacgcgaccaactggagcaaatccagcaacgcctcaatcgcgagctcaaccgcgcacggctggctggcgaaaccctgccgggtgctttgtttgattgcgaaaaagaactgcccgtcctgctggcgaccttgaacatgatccatggcgaccatcttgacctcagctatcacgtttcgccgggcctgcaattgccctgggaccgcgaggacttgctggaattgcttggtaatttgctggacaacgcctgtaagtgggcggatgccgatattcggctgagcgtcagcgaaacccagcaaggctacctgttggtggtggaggacgacggtcccggtattcccgaggcccagcgtaaccaggtcttgggtcgcggcgcgcgactggacgagcaaattgacggacatggcctggggttggggatcgtgcgggacatcatcgaggtgtggggcgggacgttgcagttacaggagagtgagctgggtgggttgaaggcactggtcgagttacccaagcgttaatgcccggctaaatctctaaaagtatgggcgcttgcttccgtggcggcctgacagtcaacggctgcccaactgaggtgtcgcgatccaaatgtgggagggggcttgcccccgatgagggcgtgtcagtaaatacatctgggggctgacccaacgccatcgggggcaagccccctcccacagtagatctccttaggcttacaccctgaactgatccatcaacccctgttgttgattcgccaggctgttcaacgcctggctgacccgcgccgattcattggcctgctccgataatgactcggtcacatcgcgaatggtcgccacattgttgttgatctcctcggccaccgcgctttgctcttcggcggcgctggcgatctgcaggttcatgtcgctgatcaccgtgaccgcgtcgccaatctggcgcaaggccgttaccgcttggccgacctgttcgacgctgccttgggcctggcgatagctgttgcccatggagccgaccacgtcggtggtgccgctttgcagttgctcgatcaccaggcgggtttcttccaccgattcctgggtgcgccgcgccaggttgcgcacctcgtcggcgaccacggcaaagccccgaccggcttcaccggcacgggcggcctcgatggcggcgttgagcgccagcaggttggtctgttcggcgatgccgcgaatcacttcgagcaccgagccgattttctcgctgttggcggccaggccttctacctgggtcatggcggtgctcatgtcggcggcgaggtcgccaatgttggcggtggtgcggtcgatcacggtcaagccttcgcgtgtggcctggtcggcgtcgcgagcagcctgggcagcttgggcggcgctgcgggcaacgtcctgagcggtggcgctcatttcgtgggaagctgtcgccacctgatccacctggcggtactgctgctccatgccagcactggtttgcgtggcaatcgcggcggactggtcggcggtgccacgggcatcctgcaccgagcgtttgacctcggcaatgatcggttgcagcttgtcgaggaagcggttgaaccagccggccaactggcccagttcatcctgcttgtcataggccaggcgccgggtcaggtcaccttcgccgctggcgatatcttcaagcatgtgtgccacgccgaggatcggccgggtcacgctgcgcgccatcagccacaccagtatcaggcctaccacagcggccagcaggcccaggccaagctccagcagggtgcctttggcattgtcagcgtccagctgggttttcaacgcctcggcgggcgccaccaggactttttccggtacatccagcaacacgccccacggcttgcccccagggatcggcgcaaagggcgccagcaccttgagctgatgaccggcacgcaggctgtgggtttgagtactgctggccaaggcgctgaccaactgctcaccgctggccgtatcaacctgagccaggcgctggctgagcttactggcatccgggctatagcctgcaagcaaaccggtcgggctgaggatgctgacctgggtctggccgtcgtacagcttctgactggcctgttggctcacggcctgcaggctgttgaggttgatgtccaccgacagtgaggcgatgactttgccattgaccatcagcgggaacacgatgctggtcatcagcaccttctggccgtcgatcacataaaagtagggttcgatcacacacggcttgagcgtggtgcgcgggcaggtgaaccaggcgttggctttttcgccactggggctgacggacgtgtcggtcatgtcgctttcgggcagcgccatcgaagtgatcttgcccggcgtcggctgcgaccagtacaaggcgaatcggcctttgtcattactgcccagttctgcctggttggcgaacaactcgtccttgccgtccagcgcattggcttcgaacaccagggacaaacccagcaggtcggggttggcttgcaacgcggccttgacctggcgggtcaggtcttcacgggtatcgaaggcgtcgagaaagcgtttctctgcctgctcgcgcaaaaacagcacctggcgggaaaacccatggccgtactggtaggcatccatgaactgctggcgaatgcccaacgcctgtacttcaccttgggcctcgatgcgcgcctgggcggcttcgtccagcatctgcatgctggaggccttgacctgctccgagctctgcgccatgcgatacagcgacagacccaccagcagggtcacgatccccagcaggcacaagcccgcgagcagggtgattttccattgaatggagagctgcctgagcgacatcgggacatccttacctgaaagcacatggaaacagcttatcggccggtgcgcgtggttctttattcaaacgatcaatttaaacctcaaaaacggcgccgctttttgacatgcgcgcctggctgctgcaaagtgcgcgccctctaataagacctctttcaagcctgcacgccggcagctgttcccatgggccgtgcgcgggcatgcctgtcttttttgtttttgcttgaggtaaccatgattaacgcagtcatcgccgcggtcggcaccatgctggtactcagcctgtcccgcgtgcatgtggtcatcgccattattgttggcgccctggtgggcggcttgacgggtggcctggggatcgacgccacgctcaaagccttcaacggcggtttaggtggcggcgcaaccgtggctttgtcctacgcattgctaggcgctttcgcggtggcaattgccaagtccggcttggcccacgcgctggcggacaaagccttgctgctggttgatcgccaggaagccagcggtggcagccacgtcaaatggttgttgattggcctgttatgggtggtggcgattgcttcgcagaacatcctgccgatccatattgcgtttatcccgttgctggtgccgccgctgctgtatgtgctgaccaagctgcaactggaccgccgcctgattgcctgcgtgatgacgttcggcctgatcacgccgtacatgttcctgccggtgggtttcggcaatattttcctcaaccagatcctgctggccaacgtagccaagagcggggtggatatcagccaggtcaacgtcacccacgccatgggcctgccggcactgggcatggtggtcggcctgctggtggcagtgtttatcagctaccgcaagaagcgcgtgtatgacctggaaaaaatcgagcgcgtcgagcaagtggcggtgcagtacaacccgctgaccctgctggtggccggcctggcgattgcctcggcgttcatcatccagctgtggctggactcgatgatcatcggcgccctggccggattcctgatcttctcggtatcgggcattgtgcgctggcgcgacaccgatgacctcttcaccgaaggcatgaagatgatggcgatgatcggtttcatcatgatcgcctcgtcgggctttgccgaagtgctcaaggctaccggtgacgtgcgctcgttggtggaagcctcggcggcgttcatcggccatagtcgtggggtaggggcgttgctgatgctgctggtggggctgctggtgaccatgggcatcggctcgtcattttccacggtgccgatccttgcggcgattttcgtgccgttgtgcgtacaactgggcttcagcccgttggcaatcgtgtgcatcgtaggcaccgccggcgcattgggcgatgccggctcgcccgcgtcggactccaccctcggccccacctctggcctgaacatcgacggccagcaccaccatatctgggacaccgtggtgccgaccttcctgcactacaacataccgcttctggcttttgggtggctggccgcgatgacgctctgatgaattctctgtaggagcgagcttgctcgcgaaaaacgccaacgataatgcgaacaacctgaaacccccgcagagttctcaggtgcttcgcgagcaagctcgctcctacagaaatcactcacctggccgttaacctctcaagtcgccactaataagagagaaaagccatgcgtctgagtttgaaggccaaagtcctggcccttgccgtagtgccggtgttgttgtttgccgtggtcatcagcctgactaccgtgtggattctccagggccaggcacgcaacgaagtggatgaaacccgccagcgcttgctcaacgacgccaaggccaccctgcaaggttacgtcgaagtggccatgaccaccatcaagccgctttacgatgcggcagcccccggcgacaccgcggcgcgggcgcaggtggtcaagttgctctccaataccagctacggcaaggacggctatttcttcggctacgactccgagaccatccgcctgttcaagggcaacagcccggacggcgtgggcaaaagcttcaaggacaaccgcgaccccaacggcgtctacgtcaaccgcgacctggtcaaggtcggcaaggatggcacccactacctgcaatacagctcgacccagcccggccagaccgaactggtgcccaagctcggctataccgaatacctgcccaagtgggacatggtcatcggtacttcggtgaacctggacggtatcgaggcccaggtggcggtggtcgaagccaaggtcgagaaacgcatggaaggcgtgctgctgagcatcctcggcgtcgccgtggtggtactccttgtgattgccgcggtgggcatgctcgtggccaataccatcctgcgtccgctcaacctgatgaaggccaaccttgacgacatcgcggctggcgaaggcgacctcactcggcgcctggcgattaccagccaggatgagctgggcgacctggccggtgcgttcaaccgctttgtcgataaaatccatgggttggtgcgccagatcaccgaaatgaccgcccagctcaccgggctggtcggccaggtatccgaccaggcccagcgctccgagcaagccatggagcgccagcgtcacgagaccgatcaggtggccacggcgatcaaccaaatgtcgtccgctgcccatgaagtggcgcgcagcgcccaaggcgccgctgtcgccgcgcaacagaccgacgctgaaggccaggccgccaaacgtgtggtggacggcagcatcgcgcagatccatgcgctggtgaacgatatccgcagcagtggcgtgtccctggacagcctgcagcaggatgtgtcgtcgattgtcagtgtgctcagcgtgatccgctccatcgccgaacaaaccaacttgctggcgctcaatgctgccattgaagccgcacgggccggggaggccgggcgcgggtttgccgtggtcgccgatgaagtacgcgccctggccagccgcacccagaccagtacccaggaaatccagggcatgatcgaccgtctgcaaaaaggcaccgaggctgccgtggacgcaatgcgccgctccagcgatgccggcgatggcacctcggcccaggccaaccaggccggggcgtccctggacaccatggcccagttgattggcaccatcaattcgatgaatgcacagatcgccagtgccgccgaagagcaaaccgctgtggccgaagagatcaaccgcagcgtgcatcagattgccgtggcagtggacagcgtggcggatgaaacccagctgggtgcccagacctcccgcagcttggcggatctgggccagcgcctgggtaagttggttggtcagttcaggatctgatcgttcacaggtcgcgcatcagcaggccaaaatgcaggtccatctcggccggcaagggcacatacacggtgtgcccgtcccccggtgccacctcaatggcttcatccttggcgttgcgcaaggtggccaggtcaaagtgaaagttgccggccggcgtcattaattccaagtgatcgccaacggcaaaacgattcttcaccttgacctctgccaactcgccacgacgctcgccggtcagctcaccgacaaactgctgtcgctcggacaccgagctgccgttctggtagttctggtattcatcatgcacatgacggcgcaggaaaccttcggtgtagccgcgctgggccagggactccagattggtcatcaagctgcgatcaaaggcgcgcccggccaccgcgtcatcgatggcctggcggtacacctgggtggtgcgtgcgcaatagaagtgggatttggtgcggccttcgatctttaacgagtgcacgcccatctgcgccaggcgctccacatgctgcacggcgcgcaagtccttggcgttcatgatgtaggtgccatgttcgtcttcgaaggcaggcattgactcatcgggacgattggcttcctgcagcaggaacacctggtcggtgggcgcgccgattcccagcgtcggctgatattgctggacgatgtcgccggtcgcgttctccaccgcgggcgtggcctggtacttccagcggcaggcgttggtgcaggtgccttggttggcgtcgcgcttgttcatgtagcccgacagcaggcaacgtccggaataggccatgcacaaggcgccatgtacgaacacctccagctccatggccggtacgtgctggcggatttcatcgatctcttccagggacagctcccgcgacaggatcactcggcaaatcccttgttgttgccagaactccacgctggcccagttcaccgtattggcctgcaccgacaggtgaatcggcatctgctcaaagtgctggcgcaccagcatgatcagcccggggtcggacatgatcagcgcatccgggcccatggcgatcacgggcgccaggtccttgaggaaggtcttgagcttggcgttgtgcggcgcgatgttgaccaccacgtagaagcgcttgccctggtcatgggcttcctggatacccagggccaggttggcgtggtcgaactcgttgttgcgcacccgcaggctgtagcgcggctggccggcatagaccgcatcggcgccgtaggcgaaggcgtagcgcatattcttcagtgtgccggcaggagcgagcagttcgggggcaatgataggtggcatgggtgtgggtcgcaaaaagccgcgagggtagtacaggggcgggcgcggttcattgatccaagtctaaacaaggcgatctatgcttgttcaataaacaagggcactcccacgtttcgccgcggactaagcaacagggccgacaccggccctctgcttttttgacatggatcggacatgaatcaaaccaacctgcaattcaagaccctgttgttgctgctggccctggtgaccattgcttttatctggatattgctgccgttctacggcgcggtgttctgggcagtgatcctcggcatcatctttgcacccatgcaacgccgcctgcagcagcggttcggctggaaccgcaacctgacctccctgaccaccttgttggtgtgcctggtgatcgcgattttgccggtgatcattaccagtgcgttgctggtgcaagagggggccacgctgtacaaaaacgttgagagtggcaagctggatgtggccggttatatcgagcaattcaagcatttcctgccgccgtacttccaacacctgctcgaccgcttcggcatgggcaacctggaagggctgcgggaaaaagtggtcaagggggcgatgcaaggcagtcagttctttgcctcccaggcgttcagcttcggccagggtacgtttgatttcctggtgagctttttcatcatgttgtacctgctgtttttcctgctgcgcgacggcccggagctggtacgcaaggtgcgcacggcggtgccgctggccgagccgcaaaagcgtcgcctgcagctcaagttcaaccgggtggtgcgcgccacggtcaagggcaacgtgctggtggccgtgacccaaggcgcattgggtggctttatattctggttcctggatattcccagtgcattgctctgggcggtattgatggcgtttctgtccctgctgccagcggtgggcgcagggattgtctggggcccggtggcggtttacttcctgctcagcggctcgatctggcagggcgtggtgctggggcttttcggtgtcttcgtaattggcctggtggacaacgtgctgcgtccgatcctggtgggcaaggacaccaagatgccggactacctgatcctgatctcgaccttgggtggcctgtcggtgttcggcctcaacggcttcgtcatcgggccactggtggcggcgttgttcatgtcgtgctgggcgttgttcgtcgaaaccaagccacgggtcaaattgccgttgccctaggcttgaagcctgaagttggctactcgttggcgctgtgtctcggcgtcggacaatgaagtgagcgggccgctgatcggctcgccatcgcggaccacgtaccaacaggcgagcaggccaagcttacgtagaggggctgggacggcgctgccgatgacagacatgatttgaacagtgggcataagtacctccaatcgttatggaggtcaccttacgatgcgctggcaccggggaaaaatcacctggctcgatagtcgacatcgacgccaggcgttaatccaccacctggtcgagcatgctcactacttcgtgctcactgagcagccctttgcgcaccaggttttcggccagcaatgcgaggaacttcgcactgcggtggccctcaaggtgcttgagttcggtcagggcactgtagaccttgctggacgtgcagagaccggcggtgcgatgcggattttgcgtgggcatggcaatcgtccttaattgttattgggtggactggatcgatagtgagactggtttatgacgcaaccatgacagtgcacgcctgggccgatcaagaggatattgcgcctttataatgtgggatagacgcttgggcattgttctcacagcgacattcgcaaaataaatccggactttccaggcaaaaaaaggccccgctcaggagcgaggcccattcaagttacttaattcaaacctaccaaccgcggccgtagtagccgtgtgggtggccgtagtagccgcgaggcggaccataatagccgcgtggagggccgtaatagaccggggccgggcggtaataaacctgctgttgtacatacaccggcggtggtggcgcgtaatagaccggtggcgcagcggcatacaccggctgcggctggacgtacaccggttgttgcacatagacctcacgaggctggctggcaacgacggagccaactaccgctgcgccaacaagtgcgcccaacactgccgggccaccccaaccaccaccgtgggcggaggcttggccggccatcgcaagtgcaccgatcagcaaggcgattctggggattttacgaatcatggtcattcctcggttagcccctgcgcttgtggtctgcaatcaatagactcaaggattgtcgcggggatacttttaagacaacgtgtttcaaaaaaacagcacttccattaggtaaaggttgtgtaaggtctgtaccgatttgcttacttcaaggagttacccatgcagatgcaccccaacaaggacacccagctgtgcatgtcactgtcggcgcgccccgggaactttggcctgcgttttcataaccacttgtatgaacaactgggtttgaatttctactataaggccttcagcagccaggacctgcccggcgcgatcggtggtatccgcgccttgggcgtgcgtggttgcggagtatcgatgccgttcaaggaggccgccattgccttagtggacgaacttgacgattcagttcaagccattgattcgctcaataccatcgtcaacaccaatggccacctcaaggcctataacacggactacattgccatcgagcaattgctgaaaaagcacgccgtgccgactgactccacgttcgccctgcgcggtagtggtggcatggccaaggcagttgccagtgccttgcgtgatggcggctatgcccgcggcgtgatcgtggcgcgcaatgaagcggcgggccaggcattggcgcgcaaccttgggtatgaatggcaggcggacctgggcgacttgcgcccgcagatgctgatcaatgtgacgcccatcggcatgacaggtggggccgaggcggatgcattggcgttcgaggccgacgcgattgatcaggcggaaactgtcttcgatgtagtggcgattccagctgaaacacccctgatcgtgcgtgggcgcgccaagggcaagcgggtgattaccgggctcgaggtgattgcaatccaggcgctggagcagtttgtgttgtacaccggtgtgcgcccgacgcaggagcaatttcaggcggcggtagccttcgcccgcaattgaaggccgctgtagcgctgatgtgggagggggcccccgatgacggtgtatcagccccagatgcacttattgaacgccttcatcggggcatagtgatctacacaacttctggtatggcgctgtacctgtgggagggggcttgcccccgatggcggccttagggtcgaccaggatcttggatcagaccgagtacatatccattgctgcggtaacggctgctatgggttccgcccttacggcgcctaagatcaacagcagatcaagatcaagagcgactcgctgcgcatcgtggttaccggctacacagttgtgtagacacccatgctcatcggggggcaagtcgaatcgtcgcaccacccctcccacattttttactgtgtcaggcctgttccagttgtgccaggcgttcttccaatgctgcaatccgggcttccagttcttcgatacgttccaatgggactgaactgccaggcccacgctccaccggagctccccgcgccgtgagtatcgcctcgatgtccgccgggtctcccaacgcatgggtataccggtcttcccgctgtcccgcctgacgcggcaccagcaatgccaacccccgcgctatcagacgttccaactgatgcacgacctgctcggcatcctcgaaatcatgcatgcgcccgctgcgggtcagcagctcattgaccgtctgcggcccacgcaggaacaacagcccggtcaagatcacctgggccggcaccagttccagggccttgtccacacggtgttcccagcggtcggcgcggctgcccatcaccaggcgggtaaagccttggccttccagcgcacgcaggctctggccgacctgaccttggctgaggttcatcaccggttcgcggctggtcttctggttgcaggccagcaccagggcgttgagggtcagtgggtaggtttccgggttggttgcctgtttctcgatcaggcagcccaggacgcggatttccgtgctgttcaggcgcggctcaggggtgtcggtgtcgtgctcggcggtcatcgcgctttccctatgcagtgaaggtcaccagcgtaatcctcaaaaaataaaagacaagcgccgggcatggctataatcgccgctggttcaaaccctgccattaccgtgagactgccatgactatttccctgtacgccgcttctatcccggtcttcaagcaaatgctcaccgccctgagcggtgtgttgaccaaggccgaagcccacgccaccgccaggaacatcgaaccgaacgccttgctgcaagcacgtctgttccctgacatgttccaactggtgcgccaggtgcaaatcgccgtcgactttgccaaaggcgtttccgcccgcctggccgagatcgaagtacccaaatatgaagacagcgaagtgaccttcgccgacctgcaagcgctgatcgccaaggtcctggcgttcgtcgacaccatcaaacccgagcagatcgatggcaaggaaggtatcgagatcgtcacccgccctggtactccgaaggaaaagcgcttcagcggccagtcctacctgttgacctacggcctgccgcagttcttcttccacgtcaccaccgcttacgccttgctgcgtcataacggtgtggaagtgggcaagcgcgattacatgggcgcgttctaagccgccacaaaaaagcccgggagcgttcttcaacgaaccatcccgggctttttcatggctggcttttaagccggctgttcttccttgcccagacacgccgccgcagtaaacagcacatcggtcgacgagttgagtgcagtttccgccgaatcctgcagtacaccgatgatgaaaccgacggccactacctgcatggcgatttcacttggaatgccgaacaggctgcacgccagtggaatcagcagcagcgaaccacccgccacccccgatgcaccgcaggcacacaccgcggcaaccacgctgagcagcacggctgtaggcaggtccacggcgatcccgagggtgtgcacggccgccagggtcagtacggtgatggtgatcgcggcaccggccatattgatggtggcgccgagtgggatcgataccgagtaggtgtcttcatgcaggcccaggcgtttgctcagcgccaggttgaccggaatgttcgccgccgaactgcgggtgaaaaatgcggtgatgccgctttcacgcaggcacatcagcaccaacgggtaagggttgcggcgtagcttccagaacacgatggcagggttgatcaccagcgccacgaatagcatgcagccgatcagcaccaccagcagatgggcatagccgagcagggcgccaaagccagaggtggccagggtcgaggccaccaggccaaagatgcccagcggggcgaagcggatcaccacgcgcacgatcagggtcacgccgttggacaggtcgtccagtaccgtgcgggtggtttcgccggcatgacgaatggcgatgcccatgccgatggcccaggcaaggatgccgatgaagttggcgttcatcagcgcgctgatcgggttatccaccacgctgagcagcaggctttgcaacacttcgccaataccgccgggagcgctcacggtggcgtcatgggtggcgaggaccagggaagaggggaacaaggtgctggccaccactgcaaccacggcagcagcaaaggtgccgagcaaatacaggaacaggatcgggcggatatgggtttcctggccgtgtttatggttggcgatcgaggccattaccagtacaaacaccaggatcggcgcgaccgctttcagcgctgtgacaaacaccttgccgataaaaccggtggcgcgggcagcctcgggaaacagcaaggccagcacgatcccggcgatcaggccgatgacgatttgggtgaccaggctgacgcgcattagacgttgcaacagggaaggggcagcagtcataaagagttgtctctagtttttttagttgggtacagcattgcaggcagaaagtactgtaggaagtagtcgcgaagtctaacatgctgtacgaagcgtcttgttcgctgcggcattcagtcacccgcgtccgtcgaacttgtccaaacccggacatatcctgttaatattcacccctctcatctttcctctccgtcagcgggccctcagggctgtcgttgatgtcgtcgtttctggagttttcatgttgttccctatcctgctgctgtcggctgccggttttaccgtgctgaccacagaattcatcatcgtcggcctgttgccgtcgattgcccgggacctgaatgtcagtgtgtcccaggctgggctgctggtgacgctgtttgcatttaccgtggcggcgttcggtccctttctgaccgcgtactgcgcacgattccagcgcaagcgcctgtttatcagcatcctgatcatgttcgcggtggccaataccgtggcggcattggcgcccaatatctggataatgtccctggcccgtttgattcctgccttggggctgccggtgttctgggccttggccagcgaaacggcggtagatatcgtcggcccggagttcgccgggcgtgcgattgaaaaaatcggctttggcatcgtctgcgccacggtgttcggcattccggtgggtacgctgatttccgatatgttcggctggcgcagtgcgttcgccgtgctcgcggtgattgccctggccaaggcgttgctgctgtttatctacttgccggttacccgggcgaagaacgagcaggtcaccttgcgctcacaattcaagatcctgcgcagcccggtgatgcaggggcatatcctgttgtcgatcctggtgttcagcggcatgttcaccgcttatacctacctggcggatatccttgagcgcctggccgggttcgacggtacgctggtgggttggtgcctgatgggctttggcgcagtcgggctgatcggcaactctctgggcgggcgcgccgtggatcgtcacccgttgatcgcatccatggtgttctgcgggttcatgatcgcgggaatggtggcagtggtgccggcgattcattcgactataggcctggcggcagcgatggcggtgtggggcgtaacccaggcggcgatgttcctggtcagccatgtgcggctgatgaaggccgcgccccatgcgccggcgtttgccgcatcgctgaatatcgccggcgccaacctcggcatcggtctgggcgcaatggtcggtgggcatgtcatcgataccttgggcctgggcagcctggggtttgccgcttcgggcttcatcctggtgtcgatcctgctggcactgtggctgatgacggccaagcaatcggtcgcccccagcacctgatggatcagggcagggcggtaaacaactcccgtcgggcaccttcggtaatcgccacgatgccagggtgcttgaccttgcgctccaccgaaatcgcatagaacgactcggtcaccgcatcggtctggccgatcagggccacgccgtattggcgtaccacctcgtcggcgatcacgctgggggcaataaagatcccactgccggattgcccgaacgcttgcatcagcgcactgtcatcgaactcgccgatgatccggggctgaacctgctgctcggcaaaccagcgctgcaaacggctgcgcaccaccgtctccgctcccgggatcaatagcggcgcgccctgcaaacactgtgggaaatcaccgccatattggtcagccaacgcctgggtggcgaaaaaactgataccgcattcccccagcttctggctgtagcccttgatgtccagatgcgtgggcatgggactgtcagaaatcaccaggtccaggcgctggatcgccaggtcggccaataaacgttcgagtttatcttcacggcaggtgatgcggatcggttcgctcagctccatggtcggtgcgatcaaccggtagacaatggacttgggtaccacatccgccaccccgacccggaacggaatctgttgttcatcgggctgggctcgcagcatcgcctccagttcattgccggtctggaacatctgctcggcgtagggcagggcctggcgcccggcttcggtcagctcaagctggcgccctacacgctggaatagcgcaatgccgaaggtgtgttccagcaggctgatctgcccgctgatggtctggggcgtaaggttcaactgctcgcaggcgcgcacgatgctgccggtcttggctaccacccagaagtaatgcagctgtcgataattgagcatgacggtctacacttcgtaaaaaccgaagtatacgcgagaaaaatacgaattttcctgaactgtttgcctgcatagaatgcctcgctatcgcggggccactatttggacccaatggttctaacgaggaatacaccatgaaactcaattcactgggtgcggcgtcgttgcttgcgctttcattggtaatgatcagtggctgtgatcaggtcgaaaaaagcgcgcaacaggtgttgggcaaggccaccgaatcggccaagcaggccatcgacgacacccacaaggccgccgaacaggcattgagcgaagcgacccagggcttgatcagtcctgagaagcaggaaaaagacgccgaaaacgacgctgaatccgacacccaagaaacctaatttcccagcactactacgtcaggactgacctatggattaccttttacaactggccgccagccccaccgcctgggtggccctggccaccttgatcgtcatggaaatcgtgctgggcatcgataacctgatcttcatctcgatcctcaccaacaaattgcccgagaagcatcgggccaaagcgcgacgcatcggtatcagcatggcgttgatcctgcgcctgggcctgttgagcaccatcgccttcatcgtgcagctgacggcgccggtattcgaagtgttcggccaggcgttttcgtggaaagacatgatcctgatcgccggtggcctgttcctggtctggaaggcaaccaccgagatccatcacagcatggacccggaacccgaagagaaggccaccgtcagcaacggtgtgaccatcggctttgccgcggcaatcggccagatcctgatgctcgacctggtgttctccatcgacagcatcatcaccgccgtgggcatgaccgagcacttgccgatcatgatcatcgccgtggtggtctcggtgattgtgatgctggtggcggccgaacctttggccaagttcatcaataacaacccgacggtggtgatgctcgccctgggcttcctgatcatgatcggtatgacgctgatcgctgaaggcttcggcgcccatgtacctaaaggctacgtgtatgcggccatggcgttctcggcggcgatcgaatgtctgaacatcgcccggcgtaaccggcacgcacgattgcttgctgcccggcagtaacgcttgacctcaaaagccagccgcgttcattagagcgcggttggcttttggctatctggtagaattctcctacacgatagtcagaggttttccatgagcgatcagattcgacttacgcagtacagccatggtgcgggttgcggttgcaagatctcgccccaggtgttggaagtgattctggccggtagcggcgcacaaaacctcgatcccaacctctgggtgggcaacgcctcacgcgatgatgcggcggtatacgccatcgacgacgagcgcggcgtggtatccaccaccgattttttcatgccgatcgtcgacgaccccttcgacttcggccgcatcgccgccaccaacgccatcagcgacatctacgccatgggcggcgaccccttgatggccatcgccattctcggctggccggtcaatgtgctggcgcccgagattgcccgcgaagtaatccgtggtggtcgcgctgtatgcgacgctgcgggtattccattggcgggtgggcattcgatcgatgcgccggaaccgatcttcggcctggccgtgaccggcatcgtgcaaaaacgccatatgaagcgtaacgacaccgccactgccggctgccgcctgtacctgaccaaacccttgggcatcggcatcctcaccaccgccgaaaagaagggcaagttgcgcgaggccgatatcggcctggcccgtgactggatgtgcaccctcaacaaacccggcagccgctttggcaagttggcgggtgtgatggccatgaccgatgtcaccggtttcggcctgcttggtcacttggtggaaatggccgacggcagcggcctgacggcccgcattgaatatgcaaaagtcccacgcctgcctggggttgagtactacctggaccaaggctgcgtacccggtggtaccttgcgcaacttcgacagctacgccagcaagctcggccgtgtgcaggagttgcacaagcgcgtgctgtgcgacccgcagaccagcggtggcctgctgatcgctgtcactccagaaggcgacgccgagttccacgcggtagccgccgagctcggcctggcccttgagcctatcggcgaattgtttgagcgacagagcaacgcggtagaggtggtttgatggcggctgacatcaccgattaccgcgacatcttcctcaacgaccggccgatgatggatacccgcgcaccggtcgagttcaacaagggtgccttcccaggggtgcttaacctgccgctgatgaccgatgatgagcgtcagcgggtcggtacctgttacaagcagcagggccagcaagcggccattgtactggggcatgagctggtgtccggggcgacgaaggccaagcgcatcgagcagtgggcgcactttgcccaggccaatcccgacggctacctgtactgcttccgtggcgggctgcgttcgcagatcgtgcagcaatggttgaaaaccgaagcaggcattgactatccccgcgtgggtggtggctacaaggccatgcgtgcttttctgctggagaccctggagcaggcgaccagccagtgtgatttcgtgctgcttggcggcatgaccggcactggcaaaaccgaagtgcttggccaactgcgcaacgccctggacctggaaggccatgccaatcatcgtggttccagcttcggcaagcgcgccacgtcgcaaccgtcgaatatcgactttgagaaccgcctggcggtggacttgttgaagaaacgtgcacgcggcatcgagcagtttgtggtcgaggatgagagccgcatgatcggcagttgcgccttgcccttgccgttgcacaagagcatgcagacattttcgatggtgtggctggaagacagcgtcgagggccgcgtcgagcgcatcctgggtgattacgtggtgaacctttgcgccgagttcatcgagatgtttggtgaaaccggccaggcgttattcgccgagcgcctgacccagagcctggccaatatccacaagcgtctgggcggtgagcgtttccaacggttgcaggccgtcttgcaggacgctctggcggaacaggcgcgaactggcgccgtggatctgcaccgggtgtggattgaaggattgctgcgcgaatactacgacccgatgtacgcgttccagcgtgaaaagaaaggcgcacggatcgagttcgtcggcgagcaggcagcagtggtggagtatttgcgtgagcgcagcggacgacgaggttgataagtgaatttcaagggcctcttcgcgagcaagcccgctcccacatgttgattggtgaacacggtcaaaatgtgggagggggcttgcccccgatggcggcctgacggccgaccagaatgttgaatcagaccgagtacatatccgttatttgggcaacggccacttatggttccgcttttacagcgggtcactttgaaaagcgcaaagtaaccaaacgctcttgccccaccactcggcacctcgcccaggctcggtgtgcccgtaatccgacagggatttggggggccgccgccacgcgccatccatggcgcggggcggctaaatcggcatccctgccggtttaccccccaaatccctgtcgaattccggccagcgtggtttaacggggcgcctaagatcaagatcagaagcagatcaagatcaagatcaagagcggctcgcttcgcatcgtggttactgacggtcgctacgtcagagttgtgtggatacccatgccccaacagggccctcagccttagcgcatccctaaagaatcaccgccccaatcaacccacacaccacccccaccagcatggtcaacccggccaccgtcaccagcaccctcgcatcgaaatccttgcgcagcatcaacagcgacggcaggctcacgcttggcagggtcatcagcaacgccacggccgggccggtgcccatgcccagggtcatcatggtttgtacgatgggaatctctgccgccgtaggaatcacgaacagtgtgccgacaatcgccagcggcaccagccataccaggctgtcggtcatcgccccgtctacatgggggaacagccacacccgtgccgcgccgaggatcagcaccgccaggatgtaaaccgggatggtgctccagaacaactgccatagggtgcgcagccagcgcaacaggaacggttgcgattccacggtactgacttcggcgacggcttccagcgccgcctccggtatctgctccgggcgcgcaatacgttgcgccaccagggctaccccgaccaccagcacaatccccgccaccagccgcagcgcggtgaagtcccagcccaatacaaagcccatgaacaccagggtggccgggttcaacaccgggttggcaatccagaacgccagcgccgcgccgaccgacacttgctggcgccgcatgcctgccgccaccggggctgcacagcaactgcacatcatccccggcagggcaaacaacccgccgcgcagggtcgagcccaggccggcacggccgaacaggcgcagcagccagtctcgggggatcagcacttgcagcaacgaaccgaggatcactgccagcaccgcggctttccagatcgccaggaaatacacctgggcataggccagcgccgccgccaggggcgagctttgctggtcattgaggatcgaggcgccgatgctgtggttgtcggctgctacaaacgccttgaggtagtagggcgaccatttcacgtagtagaggccgatgcaggccaccaggagaaacagcgctggtttccaccagaacgaccagccccggcggggctgggtggaagcgaggttggacatggagagaatccgcaggtgagtcaatagccgggcatcatacgcccctgcggcccaagcttcagatatctgcactgacctgggtcggatccggacagctttcctcgccgttgttcagcccctgcttatagttgcggctgagcagcgaggccttgccgttgtgccaggtcagtgtcagcacgtacagcgagtcatagtcattgccggaccagtcttcggtgatggtgtgcttttcgccgacggcttcgctggcgaccttgttgatcagttccggcaggtaaccgtgggaccaggcggtatagatcgtcgcgttgtgatacttgtcttcgaccagttcgtcggcgagggcgctggtgtcatttgccgaaaacttgatattcaccggcaggccgagcttgatggcgctggggctgatggtcatcagcgggcgaatgtagctataggaattatccagctcgccttcctcgacattgcgcgtcgggttggccgcaaacacgtagttggccttgccgaatttttccggcagcaccgtggccaggttcatggcgcggttcaggccctggcaattgagctggcccagaccgccggccggtttttcgccgtggcgcaggaataccagggtttgcacgccgtccacgggttgcgcacggctttcacgggcatcgaggacggtgacgatggccgcgctgaccagcagcagcggtaacatcatgtatgaataacgtttgagtcgttgcacgaggcgcagaggcttgatcttcattataggttcgagtcttcatgcgtcggattaaggcggacaagcccggccccagcgacgcttcaagcgtcctgcggtgttccctgtcgatatagcaaggtgcctcctttcacccttcgggcgcacttaagagtgcattcaggcgctttggttcgccactcgggatgctaaccggggaatgttgcgcaacgatgacccatgcacgacaacgggtggatgactatcatgaggcttttccgtccaggggttcttcaatgaatgcacttgccgctttcccgatcaacagtaaatggcccgcccagcatccggaacgtttgcagctgtattcgttacccacgcccaacggcgtcaaggtgtcgatcatgctcgaagaactgggcctgccctatgaggcgcacaaggtcagtttcgacacccacgaccagctgtcccccgagttcctgtccctgaaccccaacaacaagatccccgcgatcatcgaccccaatggcccgggtgggcagccgctggcgttgttcgagtctggtgcgatcctgatctacctggcggaaaaaaccagccagttgctctccgaagacccggccacccgctatgaaaccctgcaatggttgatgttccagatgggcgggatcggcccgatgtttggccagctaggcttcttcaacaagttcgccggcaaggcttatgaagacaagcgcccgcgggaccgctacgccgccgaatcccgacgcttgctgcaagtattggaaaagcgcctgttgggccgcacctggatcatgggtgacgactacagcatcgccgacatagccaccttcccctggatccgcaacctgatcggcttttatgagtccggcgacctggtgggcattgccgatttccctaacgtactgcgcgcgctggacggctttgttgcacgtccggcggtgatccgtggcctgaacattccgagctgacgcatgcagactttcgatttcaaacaactggacgtcttcagcgaagtgcctctcaagggcaacccgcttgccgtggtgctcggcgccgacagccttaccgaccagcaaatggccgacttcgccaattggaccaacctcagcgaaaccacgtttttactgacgcctcgcgatccgcgggccgattaccgggtaagaatcttcaccaccctcaaggagctgccattcgccgggcatcccacgttgggcagttgttacgcgtggctgcaggccggtggcgtgccgcgcggggaagagattatccaagagtgcgaaatcggtttggtgcgtatccgccgccaaggtaacgagttggcatttatcgcaccgccgttgttgcgtgccgggccattggaggcgccgttgctggagcgcgtgcggctggccttgggcctggcgcccgaggccattgtgcgcagccagtgggtcgacaatggggcgggttggctggcggtgatgctggctgatcgtgaggcggtgctgggcctgcgacctgactattcgcaactgcaagatctcgccgtgggagtgatcgccccctgtgacccggcacgtgacgcaatagacgcacactttgaagtgcgtgcctttgtcgccggcgacggcgcccctgaagacccggccaccggcagcctgaatgccggtgtggcgcaatggctgttggccgagggcctggcgcccaaccgctacgtggtcagccaaggcacggccatggggcgggcggggcgtattcacatcgagcgccagggggatgaagtttgggtaggtggcgccgtggcagtgtgcatcgcagggcgactacagctctagatcaatgaattgttacgtgcctggcaatacactattggtcccttggcatttgtgttgccgggacttgggggcataagctttggccccaaagatttcagccattttttcaggaaagccatgaccagtcagttcccccaagcccgcccacgccgcctgcgccgttccccggagctgcgtggtttgttccaggaaagcgaattcacccttaacgatttggtgttgccgattttcgtcgaagaagaaatcgacgacttcgtgccgatcaccagcatgccgggtgtgctgcgtatccctgagaagaaactggccggcgagatcgcgcgttacgcccgtgccggtatcaagtcggtgatgaccttcggcgtgtcccaccatctggacgccagcggcagcgacacctggaaagaacagggcctggtttcgcggatgtcctcgatcatcaaggacgcggtgccggaaatgatcgtgatgtccgacacctgcttctgcgaatacaccgaccacggccactgcggcgtgatgcacggcgctcatgtggacaatgacgcgaccctggtcaacctcggcaaacaagccgtggccgccgcccgcgccggtgccgatgtgattgccccatcggccgccatggacggccaggtccaggccatccgtcgcgccctggatgacgccggtttcacccatatcccgatcatggcctactccaccaaattcgcctcggccctctacggcccattccgcgaagccggtggcagcgccctcaagggcgaccgcaaaagctaccagatgaacccgatgaaccgccgcgaagccgtgcgcgaatcgctgctcgacgaacaggaaggggccgacgcactgatggtcaagccagccggcgcctacctcgacatcatccgcgacatccgcgaggcttcacgcctaccagtggcggcgtatcaggtgagcggtgagtacgcgatgataaaatttggcgcacaggccggggcgattgatgaggaccgggtggtgcgcgagaccttggggtcgatcaaacgggcgggggcggatttgatttttacgtattttgcgatggatttggcggcgtcggggatttaaggacatcgtttctccctgtggtgagctggcttatcacagggggaggggcactcataacttagttgaatttttcgtaatcttgcgcacctagtgacaccaaccatttcctgaagaaatcaatttgttcctgtggatcgtttgttaggttctcctcttcgtagtcaaacaaatggactatgtcgtcgttggtagcttgctgacctaaagtcatttcgtatgcgacgagccccgcgctcatctgagaagccattcttgatggtttaacgtttatttttgcccctttgcataaaaaggttatatgcgggaagtctgctctgatttttgcgaagcaaatatataagtcatgcccttcataaacttttttaaagttgtcggcctctgaaaatttcatgatgagcttccttgggtcatatttgacggtgacctccttgtgctcgtttttgattattacctttatatttttagttttcattttatttcctgttggggtttggtatggaatatccaacgtaagttccatcagattttactggggtggcgcctaatatattctctgtgtcgattttgttatggatagcgaattctagttctttagggtatggcgcctgcttgcccagttctgtatttatatcatgcccctcaatactcttaagcgtgtacaaatagccttttttatctccgtagctggtagcaaaagtgatcccgactgctcgtgatggcgatgtgcttataaagttgctgggagggtcactactgtcaattgcgtgtaggtacaaatcttcgctatcacctttgcttttaaagccatttttgaatacctcgtttggaggggttttgtctccgcgaaaaagatactcttcgtcattatgagaaatcggaaggttgggttctgatttcttacttgatgctggagttgaaggatcttcaacccctaaggatggctcgcatcctaccgtacctgggcatctgttcagtcccagcggatctacccaccccgtagggttaggtacataccggtacccattaatcccacccgccaacttcaccgggtccggcgtcaggtagcgaccaatatccggattgtagtagcgatggcggttgtagtgcagcccgctttcctgatcgaaatactgtccctggaaacgcagcgggttgtcgattttgcctacgtcgagccgggcgatctggccgtaggcgcggtagtgggcggaccagacgatttcgccctcaggcttggtgagttcctgcggagtgccgaggtggtccagttggtagtggtagggcgtcgtggcttttgggccgaagccttccagtagcgccagtggacgaaagctgtccggttcgtagatgtagctgcggtggcggtccgcgtgatgttcggcaatcagcttgtcgccttgccagaaaaactcggtggtcttgccatctacggtcttgctgatgcgccgcccaaaggggtcatagcggtaactggcggtttcgccgttgggcttcgtcacgctgatcagccggtgctggcagtcgtaaccatattcagtgacgagctgcttgcccttaccgcgtcgttcgcggatgaggttgccgaaggcgtcgtagtcgtagtggcggtcgccctggatcaccaggcggttcgccgcgacgatgtccgggccggggcggtcttgcatgagcaggttgcccgctgggttgtgggcgaagcgttcctgcacgtcttgggagtggtcggcgcgggtcaggcgggcgagggggtcgtagtggtagcggtgctcgcctttgcgggtgtcgagcaggcgggtgaggttgccggatttgtcgtagtcgtattggcgctggtagcggtggttttggtgttgggtcaccgcgtgagcgtgcaggcggttttggtcgtcgtagtggtagtggctgaggagctggccttgttggcgttggtgttcacggccggcacggaagagatgcgatgtgagcacttcgccgttgagctcgacggtggcgaggtggccgcctttgtcgtggttgaaggtgaggcggttgttgtcgggcaggcgcaggttttgtagctggccgcaggcgtcgtagccgtagcgcaaggtgccccagccttggtgctcggcgacgaggcggttttgccggtcgtattcgtaggccagggcccaatggccgtcttcgacgctgaggaggttgccttggcggtcgtaggcataatcgaccaggctgccatcgggcagggttttccggacgaggcgcccagcatggtcgcgctcgtaacgggtaatgagctgactgccgtcgtcgccgtattcggtcttttcctgcaggttgccgttgaggtcgtaggcgtaagcggtgcgctggccgtcgaagccggtttcctggtggatcaggccgttggggtgataggtgagctggtaggtttcgccgacttcgttttcgatctcggtgagcaacagccgggcgttgtcgtagcggtagtggacctgggtgccgtcagcattgaggcggcgactgatcaggtgcaggccgccttcgtattcgtagcgggtgacgtggccgagttcatcgcgctcggcgatgatttttccgtaggggttgtagctcaattcccggcaagcgccgccgggctgggtcagtttcagcagacgtcctacggcgtcccattgatactgggtcagcgccccgtattcatcctcacacgctacttgccgccctagatcgtcatagcggtagcgcttgattccgccattgggcaattgttcctcaagcaactgccctcgctcattccacaccaaccgatgacaactgtgatctggataccaaaccccggtcagttgcccacgtttgttgtagctgtagttcgtgacctgcccgtcaggatcggtcctgcgcgtaacatcgccctggtcattacgctcatatttccagaccgcctcgccacgcctgactacgcgtacgaaaccattgtcatgctcgtaggacgtcggctcgtcatcccccggaaacagcgccaccaagcgtccggcttcgtcgtactgataggccgtcaccgcgcccagcgggtcctgctcgacagttagccggccttggtcatcgtaggatttgaagtgctgggcgccgtcgggatcgatgcgttgtaccaagcgcgcccggtcgtcgtggacataaacttcctggctaccatcggcgttgtgcacggtgacacggccgtcatccccccaggcataacgcgtgtccatctgcgaaaaactcgcccaatgccggacgcaacgcgccgccttgccggagccttcccacgcccaaaagaaactcgccccaccggccaactgccgctcaagaatgacgtgctgatcgtcgtaccgataacgctcgctttcaccgacagcattggtcgcacaaaccagtcgtccgtcttcgtcataggcgtaggaaacgacattctgctcggtctcccagacgtagggctcgcgccctttggcgcgatgaacctggtaatccaccgcgacgatccgatccagctcatagcgcagcaacagtgagcgaccagcgccgttatccaaccgctcaattcgcccggaatgatcacggcaaatgcgcaggcggttgtcatacgcatcactgatcgagaccagcacaccatcgcgaaagtgataaaaccgtgacgcctgggccagcaccagttcatcaggcgccgagcccaggtagatcgccgcttccgccaggctattggtgatcgcgggtcgagaatcggtgggcaacggaaactgcgtacggcgattctcatggtccgtccacaccaccgattcgcccgacacaacaagccgatgcgccagcgcatgactccagccaaaccccaacccacaatccacttccaccgcactggtgcgatacaagcgtgtccactcaaacggcaagatcccgtccagcgcaccatcggtgagggtcagcaattcctccccggtgaccatcgacaccgggcagccatgagtgaccgtcttgtccgcaggcgccgtcgcatcccccttgggattcgaagccatggccggcgcatcatcgacatgctcctgccgtaccagtaccgtctgccgggccttgcttcgcactgcgggcaccgggttcgaaaccagttgatccccagccttcaacggtacagccggcactaccttgaccggcgtcgccgcactgctcagcaacaacggcttagccgcctccacatgcggccccaaccccggccccacaagctgcttggccagcatctccaacaacacccgcgcccgcccggacctgatagggctgagcacctgagcccctaaccgcgccgccacgcccatcgcccccaagacgcgaatcagcagcaacccgatcagtacctcaccggtgatttcgccccacagctcactcatgtccggcggcggcaacatacgcatccagctgaccatcgccgccacgtagataaacaacagtggctcatcactgagcaccagcagtccctgggcaatcgcgtctgtacccagcgtcaacagctcatccaattgcgcttgagagaggtattgcagcagcttctcgctgttgggcttgaggtcggccagcaggtcatacagctgtgtgatgttgtcccaaaggccgtaaagggccttgcccataccactgagaaacgctgcttctaccagtcggcgtcggtcaagcggtgtcgcgttggtatagcctttccactgcgcctggaacctgctgtcccacgcttcacgcaggcgcacttccagcccgccgatcaccgcctgataagacgcatacaacgccttgacgtgatcgcgggtaacgttggggtaaaaagtgacccgatattgctggttgcgatcacactcggtgatctcgagaatgccgctcgggccgatggtcttgtggatggggtcgcccagtgcgccgccgtttggatcaacgcgttgcaacatcaccggcgtgttgccgacaggtacgaaccgggtgctctggaacatatgcaccagggtcagcgtcccgctggccgggcatgtggcgacggtgctgctgggaagcagggaacggttgatcggtgcaacgagcgccacttcatccccgaccttgaacacctgctccacatccagcgccgagaagctccagaaactctcggcccaggcgtcaaacgtattcaggcaatcgcggaaatcgcgcagaaccccctcagcgttgggcgtctgcacatccatcggggtcagggccagcctgccgatggccgggttcaagcaacagccccgacaaccggggctctaacgaaaaaagccatctgcaatccctcgcactgttcaatcaggcgaggaactttgcagcggttcccggggcaggggggtagagcttatccggcagttatgtgggatgtttcagctacgaccaggcagccggttctgcacaccgacgaaccccggttagacttacctgtcgatatctgcactgtccggcccgtcgttcatcaaggaagccccatgtattcaagccgtctgctcctctgcctcatgcctttgctggtgctcgccggttgttccacttcacgcggcccgcagcagcctgagcgcagtgaagccgaggtgaaggcgcagatcgtgcgcctgctgccggccaaggtggcggaccgcaacggttgggcccaggacatctacaccgccttcgacacccaaaagatctaccccagcactgaaaacatctgcgccgtactggcggtgaccgagcaggagtccacttttcaggtcgacccaccagtgcccggcatgggcaagatcgcccaggatgaaatcctgcgccgtgccggcaaggtgcatgtgcccgcgttcgtggtacgcagcgcgttgcaattgcgttcgcccactggcaagacctatgccgaccgcttgaatgccgcccgcaccgagaaggacctgagcgcgatcttcgatgacttcatcagcatggtgcccctgggcaatacgctgtttggcggcttcaacccggtgcacaccgcaggcccgatgcaggtcagtatcgacttcgcacaaaagcaggcgcggggttatccctacacggtggacggcacgattcgccgcgaagtcttcacccgtcgcggtggtatgtacttcggcatcgcccatttgctcggctacccggtgagctacgaccagccgctgtaccgctttgccgatttcaatgccggttggtacgccagccgcaatgctgcgttccaggccgcggtcagccgcgtgacgggcaaagagctggcgctggatggggacttgatccgctatggctccctgctgcccggcaccaccgaactggcggtgcgctcactgggggcgaagctggatatgcgcaacccgagcatccgcagccagttggagcagggcgaccagttggacttcgaggacaccacgttatacaagcgcgtcttcagcctggccgatcaggccgcgggcaagccgctgccacgggcgatcctgccgggcattgtgctcaagagcccgaagatcacccgcaacctgaccacggcatggttcgccaagcgcgtggatgagcgctatcagcgctgcatcaaacgctgacgcagcaactcgccacgcatggcggggaatttgcgcggatgatggtaatggcggctgcgtgacgcttggcgtacaccttaacgctcgttcgcaggaagagccgccatgaccacccatgccattcctcaaggctttgttccattacctcgcagcagcccattactggacctgctcggcccggcgtactgccggggcgaaggcttgcagcttgaagtcggcctgcgcgccgataaccgtcacgccaatgggcgcggtacggtgcacggtggggtgctggcaaccctggcggatatcggcatgggttacgccatggcgttttccagcgagccgccgttaccgttgattaccgccagcatgaccgtggactacctgggcgccgtgcaggtgggggagtggatggtggtgcgcttggacagccataagcgcgggaggcacatggcgtttgccacgctgagtttgcaagtggatgagcgcgttgtgctgcgggcgagtgcggtgtttgcggtgccacaaagtgacaggcaatgagatcgaatgtgggagcaggcaagccacacattttgaccgagttcattcaggggtatcgataaaagaaaaggcgtggcttttcgtggagccaggccttttctgtattgctcgttatgtctcacctgtaggagcgagcttgctcgcgaagaactcacaggcaacacgttctaacaggagcgctgcgtgatcgttgacgattttcgcgagcaagctcgctcctacaggtcagctgcgttcgagcgccagggccacgccttggccgccgccgatgcacagcgtcgccaaacctttcttggcatcgcgcttgatcatttcatgcagcagggtcaccagcacgcggcaacctgaggcaccaatcgggtggccgatggcgatcgcgccgccgttgacgttgactttatcggcgtcccattccagctctttgcccactgccaaagattgcgcagcgaaggcttcgttggcttcgatcaggtccaggtctgccaactgccagccggccttgtccaggcagcggcgggtggccgataccggaccgatgcccatgatggccgggtccacgcccgcattggcgtagctggcgatacgcgccagtactggcaagccgagggcgcgggctttgtcggcgctcatcagcagcacggcggcggcgccgtcgttgaggctggaggcgttgccggcggtgacgctgccgtctttcttgaacgccggcttgagcttggccagggattcggccgtggtaccggcgcggggttgttcgtccaccgcgaaagccaccgggtcgcctttgcgctggggaatcaggatcggggtgatctcatcggcaaagcgtccggactcgatggcggcggcggctttttgctgggaggcggcggcgaatgcatcctgggcttcacggctgatgccgtacttgtctaccaggttctcggcggtgatgcccatgtggtaatcgttgaacgcatcccacaggccgtcggtgatcatgctgtcgatcatctttgcgtggcccatgcgcaaaccagtgcgcgcggctggcaatacgtacggggccaggctcatgttttccatgccgccggcaatgatcacctcggcgtcgccgcaacgaatggcctgtgcgcccaggtgcagggccttgaggcccgagccgcagaccttgttcagggtcaggctcggcacggcgtggggcaggccggcgaggatcgaagcctggcgcgccgggttctggccgctgcctgcagtgagcacctggccgaggatcacttcatcgacctgggccgggtccaggccggtctgctccagcaggcgacggatcacggcggcacccagttccggggccgggatgttcgccagcgaaccttggaagctgcccacggcggtgcgggtggcagcaacaatcacgacgtcttgcatggaatctgtcctcactggaagtgcatttctggaacgtggtccgggacgatcagtttaccggcggtcttgctcacaatctcttcaacgctgacgccaggtgcgcgttccttgaggacaaaagcgccattttcgatttccaggtacgcaaggtccgtcagtacacgcttgatgcagttcgcgccagtcagaggcaggctgcactggctgagcaatttggactcaccgtccttggatgcgtgggtcatgatcacgatgatattttccgcgccggccaccaggtccatggcgccgcccatgcccttgaccagcttgccggggatcatccacgaggcgatgttgccttgtacgtccacttcaaatgcgccgagcacggtgaggtcgacatgcccgccgcgaatcatcgcgaaggactcggcagaggagaagattgacgcgccgatgcgcgcagtgacggtttgcttgccggcgttgatcatgtcggcatcgatagtgtcttcggtaggaaacggccccatgccgagcaggccgttttccgattgcagcatcacttccatgccgtcggggatgtagttggccaccagggtcggaatgccgatgcccaagtttacgtaatagccgtcctgcatttcgcgggcgacgcgttgagccatttgttcgcgggtaagcgccatggtgatttcctcttattgttctggacgtggattatttgcggacggtgcgctgttcgatgcgcttctcgaaggtgccgcaaatgatccggtcgacgtagatgccaggggtgtggatctgcgccgggtccagctcgcccggttcgacgatttcctcgacttcgaccacggtgatcttgccggcggtggcggccagcgggttgaagttctgcgcggtgtggcggtagatgacgttgccgaagtggtcggccttccagcctttgacgatggcaaaatcgccggtgatggattcttccatcaagtaggggcggccattgaattcgcgggtttccttgccttcggcaaccggggtgccgacgccggtggcggtgaagaaggccgggataccggcgccgcctgcgcgcattttttccgccagggtaccttggggagtgagcaccacttcgatttcgccgctgagcagctgcttttcgaacaaggcgttttcacctacataggaggcgatcactttgctgatctgtttttcttccagcagcacacccaggccgaagccatcgacgccgcagttgttggaaaccaccgtgaggtcgcgggtgcctttgcgcttgatttcggcgatgaggttttccggaatgccacacaggccaaaaccgccggagagcacggtcatgccatcttccaggcctgccagcgcttcttcataggacgccacgcgtttatcgaaacctgccatatgcacctcttttattgtttgtggtccagccagtgaaccgagtgttgcgctgatggattgatttgttaagttgttttttaaggttgattgatttagaaaacagcatagtcgatccttcgtccggagcagccccatgaccgttaaacagatgcgtgcctttctcgctgtggcccagagcctgagctttgccgcggcctgcgagcgcctgcacctttctcaatcggcgctgagcctgacgatcaaggggctggaggagggcttgggtggccgcttattcagccgtaacacacgcaatgtcgcgctaacccccgaaggtgaatcgctgttgcccctggcacgtcgattgattgctgactgggacaatgccgaggacgaactgcgccagcgattcacgctgcaacgggggcgggtaacggtagcggcgatgccatcgttcgccggcaacctgttaccgccgatcctgaagatattccgcgcacgttacccccaggtgaatgtgacggtgcatgacttgatcaacgagcaagtgctggagatggtgcgtgatcggcaagtcgagctgggcgtggcattcgagccgtccgaaggttcgtcattggccttcacgccgctgtacctggaccgctttattgccgtggtgccgggtgattcgcccttggcgcaatgcgctgaagtcgattggaaaaccctgttggagcatccgttcattaccttgcagcggccatctacagtgcgggtgatgctggaagatcacttgggtgctttgcaaatgaagctgcccgtggcgttggaaagccatcaactggcgacggtgggcaagatggttgccagtggcttgggggtcagcgcagtgccggcgttatgtgcacggcaaatggaggaagcgggggcccattgcattactttgagcggcccggtgatcgagcggccgataggagtattgaccaagcccgggcatgaactatcggcagcggcccaagtattgtttgatatcttttgcgatgaggcgaggaagggcaggtttccaactttttgaacaggtcacaaaaaagtgtgggagctggcaagccaactcccacacttgatcgagtgatgcttattagtagtagcgatcgatcactttaacctgcgagttatccttgaaagatgcccaggcattgttaagggtatcgaacacctgctcgataaaattgcggtcggccgcggctttcttgccgacataaccctggcctcggcgatacatcttcaggcgcgccgccagctcacggttattgcggtcgaactcggcctctttggtgttgggagccaggcagtcaatttgcacttcgccagatttgccaatccacaggatatggtcgtcgagtgtgtctttctgcgctgcgaacatctcagccaattcatcaatagttggttggttgttcagattcatgtgtaagccccttgaccagttggcgatctatcaattgattcgttaaaacgctttagttgtctccggttcggaaaaccgggcgtcagtgacggtctgccgaatacgggcagggtcttgagcctgatgcatgtagtcttgctgatgaactgctacgcaatgctttcataacgaagacaagcagcgttcaggctccttgtacctgtccctttcggggctggtcagcttcatcaatccgccttgtgggcagtgcacatccggaaaaacagctcggcggtcagacgagcctgttcaaaacgcttgttaccaacgctcccgatccgggagacgtttagatcatgcaaggacaaaaagcgtacgtcaacgattatgtagtgattatttttgctcactacataaatcgttgtgggggcgggagaatgcggaaaaacgtgacttgggcgtcatttttggagttgctggtcgagcgtttaactccctgtaggagcgagcttgctcgcgaaaatcgtcaacgatgactcggaacacctgacacccacgcggtgcgctcaggtttttcgcgagcaagctcgctcctacattcgttcgacaagcaacggcagtagctgctcgcaggaggcctggattttaaccagcagcagttcatcccctcgggtcttgcccaggttgatcgcaatcaccggcttaccctgttcgaccatcgccttgcacaagcggaacgccgaataggccatcagcgacgaccccaccaccagcaaaccgtcagcatggtctaccgccgtcatcgccttaagcgcagttgccggtgcaacgttctcgccaaagaacaccacgtcaggtttgagacgttcgccattgcaatgggggcagcggggcacctggaagcactgttcgagcgcggtgtcgagcaagctgtcgccatccggcgcctgcacggcatggacttgtgccatgtgcgggttatcgacctccatctgccgctggatcccatcacgtgcgctgcgcagttggcaatccaggcacagcacccgatgcaggctgccatgcagctcaatcacatcgtggctgccggcctggtcatgcagggtgtcgacgttttgcgtgatcagcccactgatcagctcgcgctgttgcagcgtcgccagcgcccggtgggccttatttggctgggcaatgcgcacccgcggccaacccagcatcgcccgcgcccagtaacggcgccgcgcctctggggtggcgaggaattcctggtacatcattggggccttgccgcggcgcacaccctcactgtcgcggtaatcagggatgcccgacgaggtgctgatccctgcaccggtcagcaccacatagtgtcgtccggccatggcccggtgcagggtgtcgaggtggtcttcctgatgtaccaaggtgtcgagcatgggttcccctattcgccgcggatgtactgctccaactgctggatcaaggctgcttgttcggcaatggcttccttgaccaggtcgccgatggacagcaggccaagcagtttgccgtcttcgaccaccggcaggtgacgcaagtgactgtcggtcatgatgttcatgcattcctcgacacttttatgggtgtctaccgttatgactggcgaactcatcacctcatggaccttggtggtgaccgacgacaggcccttgagcatgattttgcgcgcgtaatcacgttcactgatgatgcctaccaccacgtcatccttgaccaccggcagagccccgacgtttttttccgacatccggaccaaggcttcaaagacggtgtgatcccatttgatcgtgtggacgtcctggtttttttggtccttggctttaagcaattgtgcgacggtcttcatggcggccactccggtgttgttgtaggtagtccagatcccctacagaatcctagacggcccacggcagggcaagacccaaagcggcgttaaacccgtcgaaaaacgtcatttgccggattttttccggtattaccccgccgttgtcggttttttcgcccgcttggggctggctgccgtcttacgtggggcgctcttgcgtttcttcttccagggtgtggcgcctcggcctgcggggctggctgggccagtgatggtcatgcgcatgccgttgcagcgcgctacctgcttgctcatccacgccgcttgcttggcgacgaattcctcaaggctcatttcgccgctttgcaccatgtccagcgcctgctcccagatggcggtggtgcctgggtcggcgatggcgcggggcactgcgtcgatcaggctaaacgccgccggggtggccgacagggccttgccgttcttcaccaggtaaccacggtcgagcaagccctggatgatcccggcgcgggtggcttcggtgccgatgccggtggtgtccttgagcttttgcttgagcagtgggtcttccaccagcttggcgacgtttttcatcgccttgatcaggtcgccttcggtaaagggtttgggcggttgggtccacaagtccttgagattgactttggctacggcgtagtcctggccctgcaccagtgtcggcaaggcctgtggcgcgggcgcttctcggcctttggcgggggccagggcttcgggcaatgcgcgtttccagcctggctcgataatgactttgcctaccgcgcgcaatgcctggcccgcacagtcgaagtccgcctgggtgcggtcatattcatggttgggcaggaactgcgccaggtagcgcgcacgtatcagggtatagaccgcacggtgcttgccggtcagttggcttaaatccttgcccgccccggtggggatgatgccgtggtgggcgctgaccttggcgtcattccaggcccgcgagcggcgctgggggtcgatatgcggcatcagctcgttgactgccgcatccgcacggcccagggccgcgagaatcttcggtgcttcactgtgctggctcagcggcaggtagccgcaatcactgcgcgggtaggtgatgaccttatgggtttcgtagagggactgggcgatatccagggtttcctgagcgcccaggccgagcttcttcgagcagatttcctgcagcgtgccgaggtcgaagggcaggggcgccacttcgcgcatgcgttcggtgcgcagcttcaccagccgcgcagtggcggcattaagcatggcgtcggcggcgtcccgcgccaattgcgggttaaggcagcggccctgatcgtcgcaggcatcgtcatgggcgcgccactgggcagtgaagatcatgcgctcgtggcgcaggtccacatcgatagcccaatacgccaccggcacgaaatcggcgatgctgcggtcgcggtccaccaccaggcgcagggtcggggtttgcacccggcctaccggcaatacgccctggtaaccggattggcgccccagcagggtaaacaggcggctcatgttcatgccgatcagccagtcggcgcgggagcggcccagcgccgaatgatacaggctgaaggtttctgcaccgggcttgagcgcagccaaagccttgcgaatggaggcgtcgtcaagtgccgacagccacaagcgctggatcggcccgcggtagcggcaatgctccaccagttcgcgggcgatcatctcgccttcgcggtcggcatcggtagcaattaccaactccagggcttcccccagcaagcgcttgacggccttgtattggctggcggtcttgggcttgaccagcatcttccatttttccggcacgatcggcaggtcggccagcacccagcgcttgtacttggcgtcgtaggcctcgggcggagcggtttccagcaggtggccgatgcaccaggtgacggtgactccattgcccagccaacagccgtcgccgcggcgactggcgccgagcacggccgcgatatccttggcctgggaaggtttttcacagaggtacagccgcatggtcatcccatcagattggattgatgccttgcaggatgctcagtcagagggatttgagcaaccattatctgtatggatgtacagcaatatgtgtgagcaacaacaaccgaatgtgggagggggcttgctcccgattgcggtgtgtcagccatgaagatattgactgaaccactgctatcgggagcaagtcgaatcgtcgcaccgcccctcccacaggggatctccaatgttcaaacgaactcagttgttatcgatatctacatgccgggtttctttaagacagaacaacccgacaaccaggctaacccccgtcaccaccactgggtaccacaggccatagaagatatcgccggtgtacaccaccagggcaaacgataccgtcggcaggaacccgccaaaccagccgttgccgatatggtagggcagggacatcgaggtgtagcggatgcgtgttggaaacagctccaccatcagcgccgccaatggcccgtagcacatggccgcgatcaggatcagcacgacgatcagcaccactaccatgaccttgttgacctgggccacgtccgccgatgtggggtagccagccagggccactgcgccacgcagggccgcctcatcaaagccgtcgatacgcacatcgcccacgctcacctgcaccgggctgcccgctggggcggcggcgctgctatagggcaggccctgtttgaccaggaaggtcttgaccttgtcgcacgggctgtcaaaacgtgccttgcccaccgggtcgaactggaaggtgcaggtggccgggtcggccagtacggtaatcggggcttgacggctggcctggtccatcgccgggttggtgtagtgcgccaggcccttgaagatcgggaagtacagcgcggtcgccagcagcaggccaagcatcagcaccggtttacgcccgactttgtctgacagccagccaaacaggataaagaacggtgcaccaattaccacgctgatgatcagcagcatattggccagggcagggtccatcttcaggaactgggtgaggaagaacaacacatagaattgcgccgcgtaaaaggtcacggcctgcccgccgttaatgctgaacagtgcgatcagcaccaccttgagattttcccatttaccgaatgactcacggatcggcgccttgctggccttgccttcctctttcattttcaagaaggccggcgactcgtgcaggctcatgcggatccaggtcgagatgcccagcagcacgatggaaaacaggaacggaatgcgccagccccacacttcaaactgatcgcccgtgaagtaacgacaggccagcaccaccagcaacgacagcaacaggccgagggtggcggtggattgaatccagctggtatgcagcccgcgcttgcccggcggcgcgtgctcggccacataggtggccgcgccaccgtattcgccgcccagagccaggccctgcagcatgcgcagcacgatcaggatgatcggtgcggcgataccgatgctggcgtaggtgggtaacagcccgacgcagaaggtcgccacgcccatcaggataatggtgacgaggaaggtgtacttgcgcccgatcatgtcgcccaggcggccgaacaccaacgcaccgaatggccgcaccacaaagcctgcggcaaaggccatcaaggcgaagataaacgccgtagtgtcgttgaccccggcgaagaactgcttgctgatcaccgccgccagggcgccatagaggaaaaagtcataccactcgaacaccgtccccagggacgaggcgaaaatgacctttcttgattcgttggcggtgcttgctctggccgccgagcccaggggttgagcatgttctgacatcgggtgtccctcacagtgattatttattgttgttccactgtcggcgccagcctcagcgccgctatttctcaatttccatgtaggagcgagcttgctcgcgaaaatcgtcaagtgttacgcggggtgccctgtagtgcgcggtgctggtgggtttttcgcgagcaagctcgctcctacagtagtcggtgaaaggatcagctgcgcggccttctccgcgatcatcagcgtgggtgagcaggtattgccggaggtgatgcgcggcatgatcgacgcatcggcaacgcgcaggccgggaatgccgtgcacgcgcagttggctatcgaccacggcgtcctggtcattgcccatgcggcaggtgccaaccggatggaagatggtggtgccgatacgggcagcggcttcgtgcagttgttgttcggtttgcagcgcgtcgccgggcaggtattccaccggtttgaactggctcagggccggtgcggcgacgatgcgtcgggtcaggcggatggcgtcggcggccacgcgcaggtccttgggatggctgaggtaattgggttgtatcagcggcgcatccgccggattggccgagcgaatatccacgcggccgcggctttgcgggcgcaggtcgcagaccgatgcggtaaacgccgggaagccgtgcaacggctcgccaaagcgctccagggacagcggctgcacatggtattcaaggttggccgaggtctgctccggaccggagcgagcaaacgcgcccagttggctcggcgccatcgacaacgggccgctacggtcatacaggtagcgcaggcccatgcccattttgccccacagcgtgccggcaatctggttgagagtgcgggcattttccagcttgtagatcagtcgcagttgcaggtgatcctgcaggttgccgccgaccccaggcaattcatgcactacgccaatgcccagtggtttaagcacattggcggggccgatccccgaacgttgcagaatggccggcgagccgacggcgccagcgcacagtacgatttccttgcgtgctttccagcttagcggctggccgtgttgacggcccagcacctgcgacgcgcggccattttccagcagcacccggtcaacttccacgtcagtcaacacggtcaggttgggccgctggcggactggcttgagaaatgccttggccgcattccagcgcacaccggccttttgattgacctggaagtagccgcaaccctcgttatcgccctggttgaagtcattgatattggcgatgccgctctgggctgccgcttcacgaaacgcatcgaggatcggccacgacaggcgctgttgttcgacacgccactcgccgccatcgctgtggaattcagaaccgccggcaaagtggttttcgctgtgcttgaacagcggcagaacgtccttccaggcccagccggggttgcctgccgccgcccagccgtcgtagtcctgggcctggccgcgcatgtagatcatgccgttgattgacgagcagccgccgagcaccttgccccttgggtaactcaaggcgcgcccttgcaggccggcctgggcttcggtcttgaagcaccagtcggtacgcgggttaccaatgcagaacaggtaaccgactggaatgtggatccaagggtaattgtcgcggccaccggcttccagcagcaggacgcggtgggcggggttggcggacagacgattggccagcaggcaaccggcggggccggcgccgaccacgatgtaatcgtattcagcagttgcaatgggcatctggggtctcgcttgtttttcttattgcccccatcctagttgttagttttcgtcttaaaaatgttagtttttacccagctgctgtgcgtttttaaacagcgtaggccgggttcaggcaagggaggcgacatgttcgactggaatgacctgcggttttttctcgagttgcagcgcagtggccgccttctcaccgccgcgcaacgcttgaagaccacgcatgccaccgtggcccggcatatcgaggctatcgagaaaagcctcggtactgcgctgttcgtgcagcatgcccagggttatgagctgacgccttccggcgaagcgctgctcaagcatgccgaagccatggaaaacctggcgctgctggccgaagacgaacttacccactccgctgcgcccctgggcaagatccgcctcggtgtcgccgaaggcctgggcgtgatgttccttgcgagccgcatgggtggattgttcgaacgttacccgggtttggaagtggagctggtcgcggtgccgcgctttgtcagcatcctcaaccgcgaagcggagatcagcatccacctggaacgccccagcgtcgatcaactggtgacgcgcaaactcaccgactaccgcctcgcgctatatgccagccgcgcttaccttgcgcgcaacccgcccatcgaaaaacgcgaagacctcgcggcccatgcctggatcgattacgtggatgatttgctgttcagccaggaactgaaatttctcagcagcttctgccgtaaccccaaggtggtgttccacagcaccagcgtcattgcccagcaccaggcggcgcgttcggggttgggcattgccgtgctgccgtgcttcatggcggctggcgatgcggacttggtgccattgctgccgggggagagcatccagcgcagctactggatcagctcgcgccgggagctgcacaagtcggtgcggttgcgggtgttgtgggattatgtggtggagttgtgtgcccgggagcagggtttgctgctcggcgaatccgactgacggaacggggaaaatgtgggagggggcttgccccctcccacatttgatctgagtttaactttagagcttcacgacttgatgcacctgctcggcacaggcccgagcctcttcaatcatcttgccgaacgcatcgctggtgacttcagcatgggtcagccagcgttttttctggctcaggcgagagtgataccgcagcgaaccctcctccagtttcccttccaggtcgaggtcgtaccatggcgagcgtaccttgcagccggggatggctttttccatgcgcccgcccgcgagggtgtaggtgtagtcataggtttcagggttacccaggtagaggtcggcctgttgtccgtggcggcgatagttgatgtagccctcccagcggtctttcaacgacgggtcggtgtagacgtagtcattggccagtttttccagggcccgctggtcgttcatccgtgcggtgacgctgtagccgtcatgcaccacaaaaccggtgggttcacgggtgatctggcagccgctgatgtcattgccgaagttggcgcagatgtcttggtcggtggcggtggcgccttgtcggcggtcggcggcgctcaattgcatcagccacaggcggctgaaggtcacggtggcctcgacagcgccatcgccttccttaccgaactgcacatgtttgtccaggcgcaccacgacctcggggcgctccagcgggatatgttcttcgcgcacctggccctgggcatcgttgaccagcacccagcggtcctggatatcgggcatggtctggccgggggcgaagaccgggttggtggggtcgagccaccacacttgcccatccacttcggcacgcacgatggcgtggtttggcgcctgggggccagggatcagcaaggcggctgctacatcgccacggctcacccatgcggtctcggccttgatgccactggccttgagcatggcggtcagcagggttgccaggtctttgcagtcgccgtaaccgtgctgctcgatttccgccaggctaaatggcacgtagccacgctcggtggcgcgccagtcacccaggtagcggtagtgatcattgatgtgctgcatcagcgcagccacttgttcggccggtgccaagctgcgtgcggcggtcacggcggcggcggcttgcgccggcaggctggcaccgaggatctggttgtagcgctgggcaaaatcaccgaaataggcttggcgatccaccgcgctgcccacttccagacgtggaatgcgcagcaatccggcggcggaagattcattgatgtagttgacgaagatcggcgctttgagcaccacatccagggtcttgccgttgctcgaaggagtgaccttgaaaccgtcgagcatctcactgcgccattggatcggccgttcggcggtgaagcgcgccttgaagcgatcgcggcggaccgcgcgggggccgaatttgagcacatagtggaactgggtcaccagcggcttggctgggtagtgctcgcgtacggtgtagcggatctgtgtgcccacccgcaggttggggaaggccagggaggtttgcttgtcgcggccgaagccctggtccgggttgggtgcggtgcgcgtgtcaatttgcgtgtcggccagggccaccggcttggcgccaggctgggtggactgcgcgctgatcactttgaaggtgtcaccttcggagtaatcgaagtcgatgcgcgagagcatttcgcggccgctgggcttgaggatggtgtagtgctcggtggtggtgcagtcggtgctggcgtcgcggttgaagtggcagtgcagctcggtgtcgctggccagcggagcttcggccatgggctgcagtgcagcacaaacagaatggctgaccagccccaggctgatcgcgatcaaagggcggtgaaacgaaaaacggtacatgggcgcctcgggtgacacattgaaacaactaccctgcgggtagcgagaaggcgccggatgataatggatctcaacggtgaaagccaggattgttcgacaatttatccggctgaaaggcccgtgctagagccttttgtttgattcagatcaaggttttagcagttcgaattgcgcgctggcgaggcgctcgccgttgatcaagacatgcacccgatgtatgccgggatagtgcttgcgcgtggtcaattcgcggatgtgctgctcgcggttgatgcgctgccgcgcgcctgcgcccaaggtaaaggctttgagcttgaacactttggacgcgctatggccagcacttttgacgtagtcgatggcgtaatccaccaccagtttttgcgcgtggggtgcggtggatgccaggttgaacgacagattgatgcgctcgcccaagcggatcgctgccggggtgacactcaactgatcaatcgtcacctcggccttggccccggcgcccatgatcgtcagtgcgcgggtgttgccttgcttgatcagactgcgcagcgcatggcgggcgatccaggcagtgtgcgggttgtccaggtcccagccttcgatcaggctgagcacccagcccggatggtccttggtgatgtcattgaggtggttggccaccgacttgcgcacgtagaggctgctgtcggccttgaggttatccaggaccgacgcacacagctgggggttggcttgcacgttggccaggcgaaacgaccagggcaggcgagggcgagagccttcgctggccaggcggcgtacgtgttcgttggcatccagcgaccattgctgcatcaccgccaacgtgcgctcgaagtcgtgcagcaagaaatggcgaatggcgaactcggccgagccaaaggtggtgaaaaatttcagcgccgccatggaacgcttgaagtcacctaggccatagctcgccacatagtgcggcaaaaacagactgacaaaaccactgttgatacgcggcgccaaggcgtgaaggagcttgagggtttgcgcgtaatccagcgggatcaccgcgtgcaggctctcgctgacccgcgccatgcgctgcatcaccgacagctcggccagtccggctgtggcgtgcgtgagaaagcccttggcgtcgaacgccgggtacaccgcgctcatctcgcaggcgatatgttgcaggcgttcgacgttgaagagttccttgagggccggggcgctttggtcggtcatcggtacttccgtggggttgagtcagagaaaccagcggtattcccgcgcatggatttcctgctgaaaggccaggtgatcctggcgtttgttttcgcaatacacatcgacaaattctgcgcccagcttatcgcgcaatagcggttgatgctgcatggcgcgcacggcatcgagcatttccaccgggaagtcggtgccgctgctgcggtcctcgttcagcggcgcgatgggttcacgcttggcttcgagcccatgctccagccccgccagaatcgctgccagtaccagataggggttggcatcggcgctggccaagcggtgttcgatacgcaggttgcgcgggtcagattcgggaatgcgcacgcaggcgtcacggtcttcaaagccccagctggcccgtgtcgcggcgttgacggtgccacccaggcgacggaaggcgttgtggttgggcgagaagattggcatgcagtggggcagcaactccaggcagccggccaccgcatggcgcaacgcctgctgttgatgagccgcgagcaggttattgcccgccgcgtcgtaaaggctgacatgcacgtgcatgccgctgccgggaaattgcaggtagggtttggccatgaagctggcgcggtaaccgtgcttgagcgccacgccacgggtgctgcggcagaacagggcggcccagtcggcggcgcgcaggccatcgtcgcagtggctgaaattgatctcgaactggccgggaccgatttcggcggtgatcaccgtgatgtcgatgccctgggccttggcggtttgcgccatgtcgtccagcacttcgctgaaacgcgaaagccgttcgatatgcaggttgggctggtcgtcggcgtcatcgctcagcggatcgcgggcaaattgtggcaggccgttgtcgagctttttatcgaacaggtagaactccagttcaaacgctactaccgggtgaatgcccttgtgctgcaagcgttccagcaccttggccaggacttcgcggggttcgaactcgatcggtgcctcggtgccgtccgaggtgatgagcatttgccccaatggctgcgactcccagctcaccggcttgagcgtaccgggcaccagtcgccggttggcatcggggtcaccatcgttgaagcagtagtcgccaatcttgaacaacccaccctgggcccccagcaacacggcgttctgtggcagcttcaacgggctgccggcggcgactttttcaagcatctccaccgggtagcgcttgccgtagaaatgcccggggatgtccagggcgatcaggtcgacatagcgcacgtcgggatggttctggcgaaagctccgtacttcggccagcaacgtggaggaatggcttttcacgggtgcagctcctagttgtagacccacaggacgcgggcgggcaggtcggtcaggttggcgtagcggcagtgggcaaaactggccaggtggaagctgtcgccggggccgagggtcaccgggtcggcctcaccgtccacccacagggtcaactcgccttccagcacaaagccggcctgttcggcgcggtcactcatgctttgttcgccgctgttggcgccgggggccaacaggctatcgagcatcgaaaacgcgccgttcatgctcggcgacaccaggatgtcggtgatgccattggcgtaatacaccgtgcgccgctcgttagggcgggtgacccagtccacggccttgggtttaggcaggctgtagaaataggtggtcggtacgtcaagggcgtggctgatggcagtcaagtcggccacggtcggacgcgacaggccgcgttcgacctgggacaggaaacccaccgaccgctcgattttttgcgcgagttgggccagggtgagcttcttgtgtttgcgcaggtcgtggatcagcgctgcgagggtggcgagttcttcttgtggggtcatgaaatttgtatcggataatttcatgaaaaattacaggattaatttcacggaggcaacggtgatggaacttgaagcgcatttattcgcgctggaacaggagcttcaggcgtatacgacgcgctctgatgcacaccggctggggcaactgcttgcggatgatttcgttgagtttggtgccagtggcactgtctggggtagcaaggccgaggtgattgccgggttgcaggatgaggtgttttccgagcggcgcatgactgaatttgcgctgaaaatgctcagcaccaacgtggcactggtgacctatcgcggtcatcgccaaggcgtagggagttcattgcgcagttcggtgtggcgcgaagagcaagggcagtggcggatggtctttcaccaaggcacacctgcgcagtgactcctgccttgtggtaggcgcttgctgcaaggtgagcaggctgaatgattctgtgtcgttgcggtcggacactgggtacgcaccattaattgaaggagcacccatgaagtctaaaaccctagccgcctgcctgctggtcgccgccggcctgtccaccgccagctttgtcgtgcaggccggtgatacaccccaggaaaccgtgcaaccttcaaacatcaatgcccgggacctgaaagaaggtgaccgcgccccggatatgctgatgcgcaaggagtcagcggtcagcgattggaaaaagcgcggtctgaaggctccgggggatgataatcagtgggcgcgggtaggcgacaagttcgtactgctcaagaccactaacggcacgatccttgagatcaccccggtgaagaaataatccaccaccacctgctgctttgcaggtgttctatttcatagccgcgtcgatgaaggcaaatcatcgagggtgagcttgccgacgttgttgctctgcagctcgtaacgcagctcatccaccatcttttccacttcttgtggggtctgcaggcggttagtgctgatgccggtaaccaccaggtcgacccggccggtctcggcgtcgtagaccttgagggtcaatgacgcatcccggcacaaggtgaattcgcacgtcagcggtgacaggccttcttcgatgcagttgcgcagttgggagagggtaaacatgcgggttccttcaaggcaaaagtacgatcccttgaaggttattgattgcaccgccgcccaataaggcgaattcgcactagctggactagtgcatttgtatgttcagcgcttgtttttaacccgcaattcgccggcaaacagcccgcgttcacgggcccagacgatggctgcactgcggctgtgcacccccagctttgaatacaccgtggccacatggttacgcacggtattgggtgccagtttcaggcgcgaggcgatctctttgtcggccagaccctcgcagatcagacccagcacatcacgctcccgggcggtcaggtcggtgaaggctacattgggcaggtttgggctattgacgcttttggcgttggccagtttttcgatcagggtctggctgaaccatgatgcgtcctgcatcacctcctcaatggccgctaccagctcaagctcagagcgtttgcgttcggtgatgttcatcagcaccatcaggtagcagggcacgtcctgaatgatcacggtatcggcggacaccacgcaatcgatcacctcgttgcctttcttgcgcaccttgaggtcctggccgtcgaggttgccggctttctccagtgtggcaaacagttgcgcaccggcctgggggctgtcgataaagttgatttcttcgatggatttgccgatcagttcctcactgatataaccggtgatcgtcatgaaggcttcgttgatatccactacttggcggttgacggcgctgcacaccagggtcggcactggcgtcaggcggaaggatttggcgaagcgctcttcactctggcgcagggcaatttccgctttgcgcctgggctccaggtcggtaaaggaaaacagcatgcagtcttcctcgttcatgtccaatggctgaccggccacaatcactagtttgctgccgccttcgggcagtttcagttcggcctgcatctgcgggatggtcgcgccttcgcccaggcgctcgatggccaggtccttgcgctctgcttgctccagcacatccagttcatacacggacttgccgatgacctggtcgcggttgtagccggtcatctccaggaagccctggttgaccttgatataacgcagatcgctcaagcgacagatcactgcaggcgccgggttggcgttgaaggttttctcgaagcgctgctcggcgctggcccattcggtggcgtcgctgagaatcagcaccagcagctccggctcgcccttggcgtcagtcaacaccaggctgcgcaaacgatgtacccagtgacgactttcatcggcggcgggggtgacctccaccaccacatcgctgaactcttcaccggctgctacgcggcttaaggggtagctgtccagctgtaacggatgattgttgcgatagcgcagagcgaaacgctcggcgtacgcctcggtgttcgcgccgagctcctcgacttcgctgactccatgcatggccagcgcggcctcattggcccagaggatggtctggtcgacctcggccagaatcacgccgtcggacagcccggagatgatctgctgcaattgacggcggttggtttctttggcgagaacatcctgggtcataacttctccgtgagggcgtgtctagggcgcatgggactacgacatccgggcttcaggatagtgcagagcaattaacccaggggcagtgcgaatgcaccacctggcctggtgcatatggcccacgactgaacgtatgtcgtttcgccacactcccactccacaaggcgcattgccttgctcctgaaactgaaaaggacctttgtatgaccactgtctatgaaaccaatcgatcgctattccgtgtgtcgtggagttcggtactggccggtagtgcaatcgcactggtgacctacctggtattgagtgtgttgggtacggctattggcgccagcgctgtggaccccatggaagcgggtaaccccttgaacggtttcggcaccggcgcgggcatctggctgtttgtctcgacgttggtggctgttgcgctgggtgccttcgtggccgggcgcaccgcaccggatcgtggtggcctgcacggcgtattgacctggaccctaaccactttgctcaccacctggctgctggctggtttggccgccagcgttgtcggcactgccggcaacgtagtgggcaaaggcctgtcagctgccggcagtggcattgccgccgctgcgccggggatcggcaacagcctcaagcagcagttgaacgagcaaggcatccagcttgactggaacagcctgcaaggccagttggacaccttgctcaagcagagtggcaaggctgaactggacccggctaatgtcgagcagaaagccgaccaggctggcgctgatggcaagcaatcggctaccgatgcagcgaccaaccctgcccaggccggcgatgagttgaagcagtggttcgaacgtgtcaaagcctccggcgaaccggcgctgaatgcggcggataaagaagcattggtcaacatcgttgctgcccgcaccggcaagagcaaagaagaagcgacgcagatcgttgataactatgcccaggcttatcagcaagccatgcagaaggtcgagcagctcaagcaacaggctgagcagaaagcccgtgaagccggtgaagtagcggccaagcaactgtcccgcgccgcctggagcaccttggccatgctgctgttgggcgcggccttaagcttctttatcggccgtatcgcgttgactacccgtcgcgtgccattggcttaaaactgtctgcggcaaggacgccgcctgtgtgaacgggtaaaatgctggcattttacccgtatcacgcaaaggtgcaccttgagcgcaggcaaagccgcaggactgttattactcacctctctgttggcggcgtgcggcacctcgccgccgcgcacgccgaacgatatctgcggcatctttcgcgaaaaggatgactggtacgacgccgccaaggtcacgcaaaagcgttggggcgtaccgatccaggtgccgctggccatcatgtatcaggaatcgggctttcgccacgacgccaagaccccgcgtaaatacctgctgtggatcatcccctggggccgcgtgtccaccgcttcgggctacgcccaggccaaggatgaagtgtggaacgactaccgcaaagccaccggccgcagcggcgctgatcgcgaagacttcgacgacgccatcgactttatcggctggtacatggacaagacctacaccatcaatggcgtctacaaatacgacgcttatggccaatacctgaactaccacgaaggctggggcggctaccgccagcgcacctacgccagcaaagcctggctgctaccggtggcgagcaaggtgcaggcgcgttcgcagatgtacgcacggcaatatgccgggtgcaagaatgagttggggcgcgggttctggagccggttctggcattggttgtaaaggccgacacagcgacctctggatgcaggcagattaaatgtgggagggggcttgctcccgatagcagggtgttagccaatgatgaggtggctgatgcgccgccatcgggagcaagccccctcccacagtagattgcggtacgacgctggatctgtggcgagactgttggcaacgaagactagccacgcaatgtgagcggcgcaagcggttgggattctctcggaaacgtccttcaagttaaagggaaatgtcattgttccgactgtacctacacttgccaaacccagccgattctgggaaaacctcagcctttcacgccttcaacgagccccctatgagcaacgacgaactgcagatcaccgacatccgcccgggcactggaaaaaccgtggtcaagggcgcgctgatcacgacccaatacaccggcaccctggaagatggcaccgtgttcgattcttcgtgggagcggggcaagccgttccagtgcgtgattggcaccggtcgcgtgatcaagggctgggaccagggtttgatggggatgcaggtcggcggggtacgtacattgtatgtgccagcgcacctggcctatggcgagcgttccatgggcgcgcatatcaaccccaacagtaatttgcgtttcgagattgaattgctggaagtgctgacgcgggatgattgaagagactgaacatggacgttgatccacaggtgttgcctggctgctccctcaaagacgttagggtggttgaactgcttggctgcgatgaggctgagctgcagcagttttttgaacaggcgccgggttacttcatcgcggtgaatggcgaaccggctaccccgagcgaagcacgggaagaattatacggccagttacccgctggctggcagtgcagccgcatgtactggctgggctaccgcgatacgcaggaccaattggtcgccgtggtgaatatcgccgcagatttgctcgccgcgggggtatggcatatcggcttgctgctggtgcatacgcgctggcacggcagcgggctggcgcagcgcttgcactcggaccttgaggcatgggcggcggcgaagggtgcccaatggctgcggttgacggtggtggtgggcaataccagggccgagcgtttttggcccgggcttgggtatgtacaggtgcgaactcgcgagggcatcaccatggggcgccaagtgaatagggtgtcgatccaggtcaagcctctcggcaacgggaccattgacggctacctggcgttggttgagcgggaccggcccatcagcctgtagcacctaccgctctcatgggcgcgcggcgcctgatttctccagctccttgctttcaaccatgatcccaaatctgcggtacagctcctttcgccctttgggcgtcaatgccaacgcacgactatcaaggtcctggatcacccatttgtggcttataacggcctgtagaacagcggcccccagtgcgccggcgaggtgagggcggcgcatgctccaatccaggcatgagcaagcgaaacgacgtcgctgtgcccttacggtttctatctcgacaccgagccccgtcatcgctttttcgccctccacgctgagctgatacgtaccgtcaccagcgaccggcatgctcaaccagccggcgtcgatgaaatagtcgtgcagttgtacagccagggatcctgccatgtggtcataacaggtccgcgccaactgcaatcgactgggggccgtcgaaacgaaccgggtctgcgcgtttcggctgatcaccatgagggcttcaatagcttgggccacgtgcgcgtctgccaggctgaagtagcggtgcctgccctgcgtgtgcagttttatcaaaccgtcctctttgagccttgccaagtgcgcgctcgccgtggatgcactgacgtcggcgatgacagccaattcggtactggtacgggcgtgaccgtccatcagcgaacaaagcattttcgtcctcgcgggctccgcaatggcgcctgcgacacgggaaatagcagtgtcattgctttgggaatccatatttcgttcctgagcgaattgtgggggtgaggattgctcgatagtagccgttctttgtgaaaaggactgccaaaatgacgccgtttgaagccgccacgcatgtcgatccctacgtttattactcacgcctcaggcagcaaagggaattgttattcgatgcagatcttggtgtatggattgccagtggcgccggcgttgtcgaggccattctggaacatcccgactgccttgtacgtccactgcacgagccgattccggctgcccttgcgcaaggcgccgcaggccatatttttggtcgtttgatgcgcatgaacgagggggcgcaacaccagtgtccacgcagggttatcgagcctatcttggcctcgatgggcacgcaaaacatcgcaggcctcgtggcgcaggttgtcgagacatttgagatctcgggcgataacccgaatgagtggatgttcacgttaccggtttcggtcattgcgaccttgataggtttcacatccaaccagctacaggaagtcgcgcagatgacacgggattttgttgcctgtctgtcgccgttaagtgacgaggctcaactcagtaaagcccattgcggggcagcacggctaagccagatgctgcaggcgctgctgagtaacgatgataaaggtaactgcgtgttgggccgtctttatagcgattacgacacttcagcctgggaagacgatgatgcattgatagcgaatctgatcggactattgtcacagacctgcgaagccactgccgggctgatcggcaacaccctcatagcgctccaacgaaaccctgagctgtttgaaggcatgcaagccacaccgacgcttgccgctgagtgggtggcagaggtagcgcgccacgattcaccggtacaaaacactcggcggtttgttgccaagcgatgcgcgataggcgacagcgttttagaggcgggcgataccattctgttattgctcgctgctgccaaccgagacccctgcgccaacccagaacccgacagcttcttgctcaagcgagcgcaacgacgaaccttcagcttcggctcaggaagacataaatgtccaggccagccattagcattggcaattgcttcagaggtggttttcgcgtttttgcatcgacagccaacctcaccagctcctgcttatcgctggcgttatttgccttcgcttaatggtcgtatcccgcagttctgccgtgatggggagattcagcaatgatcgccgttatttttgaagcctggccacacgaggagcaataccagcgctatctcgaccttgctgccgaactcaaacccctgcttgctcaactcgatggcttcatttcagttgagcgtttccagagtctgagtgagccaggaaaagtgctatctctgtcattttggcgtgacgaggaggctatccagcggtggcgacgccttgaactacatcgagccgcccaactaacaggtcgtaagcaggtttttgctgactaccacctgcgaattgcccatgtagtgcgcgattacagtctcgaggatcgtgttcaagcgccgaccgatagcagacaggctcatgagtgaaagcagcacaccgaattcttaggtgcagttgccttaatgcaagcctgttaagtggtcatcgtcttctgtaggagcgagcttgctcgcgaaaaatgttaataataacgcgtgcttgctgaatgaacgcggcgcctgtaagtttttcgcgagcaagctcgctcctacaaaagatccttaactgactggcattacctgaacccatcctgaagaattttcttattctccatgcgggcactttcctacggtttactctgccaacatcgcggcgtaagcttcgcgcgttttcatcaatagcggagaccctcagtgggtacttgttcgagtgacagttgtcggccggtctcggtaaccggcgcatacttggcaagataacgcgcatgttccagatgccgttgtctcgcctcaaaaagcgagaagcggcatcccggcagtggccagtcctggcgcctgcctgaatccctctcatcgacgctgaccagcatctgggtaacctcggatgctacggacgcgcctgccttttttacggtgggcgggccaggttcggctgtgcctgtgtgacgggcgcggtgcggatgggcagtacctgcacgacgggttttcctcgcgcaggagtaacaccatgaacctcacgctgctcaaagagttcttcgccggcttcctgcggacccggcatatcgcccggcattttcgccggctggcaatgctcgaaaccgttaccgacgccagcgtcagccgcgaagtcccgccaaacctggcgcacaccctggtggctgcggccaatggcagtgccgtgcagttgctgggtgtgctgggcagtcattcggcggggctcactatccaggaggccgacgccctgcgtgtgcaatacggcctcaacgaagtcgagcatgagcagccgctgccgtggtgggtgcacctgtggcactgctacaagaacccgttcaacctgctgctgacgttgctggcagtgatctcctggctgaccgaggacatgaaggccgccacggtgattttttccatggtggtgctgtcgaccctgttgcgcttttggcaggaggccaagtcgaacaaggcggccgacgccttgaaggccatggtgagcaacaccgccaccgtactgcgccgcgatgccgccaagcgtattgaactgccgatcaagcaactggtgccgggcgacctgattgtattgtcggccggtgacatgattcccgctgactgccgcgtgctcagcgccaaggacctgttcgtcagccaggcggcgatgaccggtgaatccatgccggtggagaaattcacccaccagcaggatgcccatacccgcaacccgctggagttggagaacatcctgttcatgggcaccaacgtggtgtccggcgccgctactgcggtggtcctggctaccggcaacaatacctatttcggtgcgttggcccaacgtgtcacggccactgatcgcgcgaccacttcgttccagcacggggtcaacaaggtcagctggttgctgatccgctttatgttcgtgatggcgccgctggtgttgttcatcaacggtttcaccaagggcgattggaccgaggcgctgttgtttgcgctgtcgatcgccgtcggcctgacccccgaaatgctgccgatgatcgtcacctcgaccttggccaagggcgcggtattcctgtcgcgcaagaaggtcatcgtcaagcgcctggacgcgatccagaacttcggcgccatggacgtgctgtgcaccgacaagaccggcacgctgacccaggacaagatattcctggcgcgccatgtggacgtgtggggtgaggagtccgacgacgtactggaaatggcctacctcaacagctactaccagaccggcctgaaaaacctactggacgtggcggtgcttgagcacgtggaaatccatcgcgagctgaaagtcggcaccgcgttccataaggtcgatgagatccccttcgacttcaaccgccgccgcatgtcagtggtggtggccgagcaggaccggccgcacctgttgatctgcaaaggtgcggtggaggagatcttgtcggtgtgcaccagcgtgcgccacgacgacgtcaatgaagctctgagcgaagaactactggcgcgcattcgccaagtgaccgcggcctttaacgaagaagggctgcgtgtggtggcggtggcggcgcagccgatgccggccgggcgtgacacctacagcctggcggatgaaaacaacctgaccctgatcggctacgtggcgtttctcgacccgcccaaggaaagcaccgcacccgccctcaaggccctgaaagcccatggggtagcggtgaaagtgctgaccggtgacaacgaactggtcacggcgaagatctgccgcgaagtgggcctggagcaacaaggcctgctgatgggcaacgatatcgaagccatggacgacgccgaactggcccaggccgtggaaaccaccaatgtgtttgccaagctcacgcccagccacaaggagcgcatcgtgcgcctgctcaaggtcaatgggcatgtggtggggtttatgggcgacggcatcaacgacgccccggcattgcgcacggccgatatcggtatttcggtggacagcgcggtggacatcgccaaggaagccgctgacatcatcctgctggaaaagagcctgatgattctggaggagggcgtgctggaaggtcggcgtaccttcgccaatatgctcaagtacatcaagatgacggccagctccaacttcggcaacgtgttctcggtgctggtggccagcgcgttcatcccgttcctgccgatgctgccgatgcatttgctggtgcagaacctgctgtatgacatctcccagattgcgattccgttcgataacgtcgatgacgaaatgctcgccacaccgcaacgctggcagccaggggaggtggggcgcttcatgctgtttttcgggccgatcagctcgatcttcgacatcaccacgttcgcactcatgtggtatgtgttcgatgccaacaccccggaccaccagaccctgttccaatccggctggttcgtggtggggctgctgacccagaccctgatcgtgcacatgatccgtaccccgaaaatccccttcctgcaaagccgcgcggcgctgccgttgatgctgatgaccggggtgatcatggccgtcgggattttcctgccgatggggccgctggcgcactatttcaaattgcaggcgctgccgtcgctgtatttcgtatttctgccggtgatcctgctggcgtacatggcgctgacccaggcggtgaagggcttttatatccgccggttcggctggcaataaccctgtaggagcgggcttgcccgcgagaatcgttaacgatgacgcgggccttctgacggaccgcgccgccctcaggtttttcgcgagcaagatcgctcctacaggtcatcaggtcatggagatctttttatgcaggcaatcaacaacatcaacctcaactccctggtcgacaccgtagtcagcctcagtgcggcgtttatcctcgggggcctgatcggcttcgagcgccagtaccgccagcgcaccgctggcttgcgcaccaacgtactggtggcggtcggcgcggcaatttttgtcgacatggccaaccgcctgggcggcgcggaaggcgcagtacgcgtggtcgcctacgtagtgtcgggcatcggcttcctcggcgccggcgtgatcatgcgtgaagaaggcaatgtgcgcgggctcaataccgccgccaccctttgggcctcggcggcagtgggtgcctgtgccggcgccgacctgatccttgaggcgttgctgggcacgttatttgtgctggcggccaacaccttgctgcggccgatcgtcaataacatcaaccgccagccgttggacgtggtgtcggcggaggttaccaacatcctctatgtgattgcgcggcgcagtcagcaacaggcggtgatggtgttgctggaagccgagttggcccgctgcaactacccggccagcgatgtcgacgtgcgaccgttcggcagcgaagaagtggaaatcgaggccaccctggcggcgacgtcagtcgatggcgacgagctggatgcgctggtggcgcgcatctcgacctcgactctggtggtacaggcattctggagcccgagtaccaccgactgagcgttatggatatgccgcgggtggctaaacttgatcgtggaaaaatcctacaagtagtcaggattatcccttcaatctaaatatttatgcattgttaaggttgggcacttacagctggagggcccacaaggcccggctgctgtgcgtgtggtgttgcaattgaatgggccaggcatcgcttggttatcttcctgagtttgcgcagtgccgttggtcggaactgttatttctcacaggtacccaggtccgatgtgatgtgtaagggtattttgtccgtatagggaagtttatgagcaaagcattaattgtggacgaccatccgtttatccgtgcaacggtcaagcatctgctgcagttggaagggttcgacaacatctatcaggcaggtgatggtgcagatgccatgcagttggcaagggaacagcgcccagatttgatcatcctcgacctggcgatgccaaagctgggtgggctggaagtgatccaccgcatcaagacccagggcctgccgtgccgcatcttggtgctcacctcttatcttgcggtgttcttttccacccgctgcatgcgcgccggagccatggggtttgtggccaagaccggcgagttggacgagttacaaaaggccattaaggcgatcatgtcgggctacagttgcttccccagtttgccgaccagctcggtacgccgtgacgacttgcaagaaacggagcgacagatgatcgaatgcctgtctgaccgtgaattgaccgtactgcaaaaactggccctggggctgggcaacaaggaaattgccgagcagatgctgttgagccacaagaccatcagcacttacaagactcgactcaaggagaagttgcgtatgtcctcggtagtgcatttatccaagtttgcccagcgcaaccatctgatctgaaatgatcaccaccgcgtttacgaggttcgccacgatcctttggatgagcctgttacccctgatcgcggtggcccttgacgagccccacgctttgcgactgctggggcattctcatattgaaacccccgaagtgacactggacgaggcagattggcgttggctgcgcgagcggcgcacgctgttgatgggggtttccgcccccgattacgcgccttttgacctgaccaataacaaccacgagctcgaaggcataactgccgattttgccgcactgatcggccaggctctgcatatcgccgtcgaagtccggcgctacgacacccgggatgaagtgatcgaagccctcaaacagggggccgtggattttctcgggtctgccaacggctacgaagcggccgacccgcaactgcatctgtctcgctcctacgccaatgatcaaccgaccctggtcacccgcaccggtgaaagccaggtgttgagtgacgacctggcgggcaagcgtgtggcgatgctgtaccactacatgcagcccgacgctgtacgcgccttttaccccgatgcccagttggagctgtttgcgtcgaccttcgaagccatcggcgccgtggcatttggtcgtgccgatgtgtatctgggggacgccatcagcaccaattacctgatcaaccgtaaccacctcaataatgtgcgcatggccgatttttcgaccctggaagtcaacccgtttgccttcgccgtggctcgggacaatacacgtctattgcccatcctcaacgccgcgctggaggcgattcctgccagtgagcagatggaaatcctgcgtcgttggagtgggggcaacctcggtatcgtcggcgttgatcggttgcaactgagtgccagtgagcagcgctgggtgcagaagcatccacgggtcaaggtcgcagtgctgaacaacttcctgccgctgtcattcatcaatgatcaagggcagttcgaagggttgagtgctgaggtgttggcgcgtatcagcttgcgtaccggcttgaagttcgatgtggtgccgggcacctcgttaccgcgccagatcaatatcgtcaatgcgggcacggcggatatgctggcggtcgtgacccccagtgtcgagcgcgccgagaaggtgcggtttacccgtccctacctcaccaacccctttgtgctggtgacacgtggcggagactacagcccggccaccctggaagatatgctcggcaaacgcctggcaatggtaaccggcaacggcctgcacgatgaaatcgcgcagaattttcccggcatcgcgtttgtggatgtggaaaacccggagcaagccatggcgttggtggccaaaggcgacgccgacggcgcggtaaactcgctgatcagtgcgcgctatgtgatagcccgggattatcgcgaccgtttgcgtatcgccagcactgtcggcaccgagccggcacgcgtgacattcggggtcaatcgcagtcaattggagctttattcgatcctggacaaggcgctgctgagcatcacgccgcaagaaatggacgagctgatcgggcattggcgcaatgagatcatcatcgaggacagctattggttgcgccatcgcaacgtcatcctccagggcttcgggctggcagcacttttgctggtgatcacgctgggttgggtcatctatctgcgcagcctgattcataagcgcgtgcaggccgagcgggcgttgagcgaccagatgcgtttcatgagcgtattgattgacggaaccccgcacccgatttatgtgcgcgaccgccaagggcggctgatggcctgcaataacgcttatctcgacgtttttgggtacaagctcgaagacgtgatcggcaggaccgtggtggaaaccgacaccagcaacctgccccaggcccagtcgtttcatgaggattatctgcgcctgatggccggtggcgagccgcagattcatgatcggatactcaaggtgcccagtggcgagatcctgacgatttaccagtggatgctgccgtaccgcgatggcgacgataaggtggtgggcatgattgccggctgggtggatgtgagcgagcggcagcgcttgcttcgccagttgcaggaagccaaggacgatgccgacgctgccagccgggccaagacgacctttctggcaaccatgagccatgagattcggacgccaatgaatgccgtgatcggcatgatcgagctggctctgaaaaatgccgagcaggggcgcgccgaccgggatgcgctggaggtggcatcggtggcctcgcgcggcatgctggaattgatcggcgatattctcgatatcgcgcgaatcgaggctgggcatttgtccctggcccttgaaccagccaacctgcaagaactgctggcatcgctggcacgtgtgttcgaagggttggcgcgggccaaggggctggcgctgcaggtggaacttgacccattgattgatcgggtggtgctggtcgacccgctacgcttcaagcaggtggtgtcgaacctgctgagcaatgcgattaaattcacggccaatggccaggtaacacttggggccaaggcaggcctggaaggcgagcgattgcgcttgcagttgtgggtgcaggacactggcattggtatcagtgtccaagaccagcagcgattgttcagcctctttatccagggcagcaacaacgagcagtcggcgcgcagcggttctgggctgggcttggtgatcagccgcaatttgtgcgaaatgatgggtggccaactgcatttgaacagtgtgctggggcagggcacccgggtggatgtgacgttggcattggccatgaccaatagagtgcccgcgcacgctgcgccaatggaagacttggcccccccgaaccgcgcgctgagcatcctggtggtcgatgactatccggccaaccgtttgttgctggcccggcaattgagcttcctcgggcaccgcatcatcaccgccgaggatggtgtacaggggctcgaacagtggcgcagtggtcagttcgattgcgtcattaccgattgcaatatgccctacaagaacggctatcagttggcacaggatatccgtgcacaagaacgcgagcggggattgtcgccttgcctgctgttggggttcaccgccaacgcacaaccggaagaaaccgaacgctgtcggcaagcaggcatggatggctgtctcttcaagcctaccgggcttgacgatttgcgatcagcgttggcgacgcgcgcgaccgagcctgctgccctgcacctggcggcttttgacttaagttcgctgattgtgttgacaggtgatgaccgccccgcgcttatcgagttgctggcgccgttgctcgagagcctgaaggccgatcgtgccttgctggccccgctgcaaagccacgcagacttcgccaagctccacgatctggcccatcgcgccaaaggcggcgctcggatggtcaaggctcaggggttgatcagctgttgtgaggcattggaacaggtgtgtgaacagcaggaccgtcagtcattggggccgacggtcgaggaagtgggtgaagcgattgataccttgcatcatggcctgagcgtttattgcaatcagccttgactgcggtggatcaccattcggagaatttgggagaactcctacgtgaacggggaatatgcctgattttgtcgtcggcatatgtctggaaaatgggtcgcgctcactgccgagcacagcctgtccaggggtttgccatgccgaacaaagcactgaccatcctgattgccgatgagcagcatctgcaacgtttatacatcgagaaaatgctcaaccagttggggtattaccggattgtgccggtgcaaacgctcgaggaggtgcagatcctgaccgccattccggccgagcccttcgatgtactgatcatcaacgcgaggctgatgacccctatctgtgagcctaaggcccaggtgcgccatgtattggtctatgaccacccgcaatcgaatacgcccacgggcctaatgccagggctgcgggtacgcctgcccggggtgccggataacctcaggctcgaacacttcatggacatcatcgacccacccgaggccagtcaaggcctgcgggtattgccgtggctgcgggagttgtcccgtatgccggtggccggggcctagtcccacttcggcgcgatgcccttggggctggtcaagcgatggccacgctccaggtcggcaatctgctggcgcgtcctgtaggagcgagcttgctcgcgaaaaaacgtcaacgataacgcgggctttctgaatgaacgcggcgccggtaagtttttcgcgagcaagctctccctacaaaaagctctaactgactgacatcagggcaagcctcacattttgccctgcgtcaatctgctgttttgtggtgttcgcgcaagcgctctgccgcagtgcgcagcagctgctcggtagcgtcccaccccaggcaaccatcggtcaccgatacgccgtatttcatcgacgcgctcaacggctggcaaccctcgaacaggtggctttcaagcatcatgccgatcagcgatgtatcgccctgcaagcgctgttccagtacctcgttgaatactgccggttgacgcaacgggtccttgccgctgttggcatggctgcaatcgaccatgatccgcgcagccaccttggacttggccaggtcatgcttgatatgggcgacgctttgcgcatcgtagttcggcccacgatgaccgccgcgcagcaccaagtgggtgtcggggttgcccggggtctggatgatcgccggatggccctggctgtcgacgccgaagtggcggtgggggtgtgaggcggagcgcatcgcatcacaggcaatcgcgacgcccccgtcggtgccgttcttgaaacccacaggcatgcccagcccgctggccatctcgcggtggatctgcgactcagtggtgcgtgcaccaatcgcgacccaactgagcaggtcatcgaagtagccggcggccatgggttgcagcagctcggtagcgaccggcaggcccaggcgcagcatttcgcgcatcagctcccgcgagagcctcaggccggcggccatgtcatcgctgccatccaggtgcggatcgtaggccaggcctttccaaccgatggtggtgcggggtttttcgacgtaggcacggattaccagcagcatctggtcgctgacttcaagcgcgagcttcttcaggttgcgtgcgtattccatggcagattccggatcgtggatcgagcacggtccgacaatcaccagtaagcgtgagtcttcgccattgaggatggcgcgcgtagcttggcgatgggcgtggatctgttcattgaggaacgggctgaggggcaactgatgcttgagctccagggagctgggcaggcgctgggtcaaggcttcattggcgctgttcagggcagagacgggcaaagcggcgacggaggagttcatattcaaggcttcctgggcaagcggcgggtgattcccgcacgcttggcctactggggtgttcgacaattggccgtatcggctgtacgtgttggcttgccaccaagaggtgaccggtcggaggcggcaggctgtcccgaacggagctggctaaatcgccatgcagtgcaagtgtcgtagcggtaataagtggtgtagttcatggcggggttcctttaagttcttgatcaaacaaaataaaaagaggctgaaaaaacaaaacccccggtcggggagccgaccgggggtttagatttctctggtaggcgaccccttgagtagtgggcgccgatttcaggtatcaggcgcgccagtggctaaaccaatacccaaaataaaagccagccagtgcgctcgaaccgttcacgcgggtagccgacaccgagcgcaaggcgctggcagcagggcaaacctgagtgtgggtgagttgcaacatgagtagctctccaaatgttggggggagcttactagaggcgtacggttggattcaatcagtaatttctattgcgtgggggacttacgactatgggtgtgtgccgatatgctgatgacacttaaacaatgattgccaggacgcgaccatgactgccttgacccttgctgcggcgcaaaccctttccattgcgggcgatgttgcggccaatatccaacggcacctggtcatgatgcaggctgcggccgagcacggtgtgcaatggttggtgtttccggaactgtcgttgacgggctatgaaccattcctggcggcggacctggctatcgcccccgagagtgacgtattggctccgttgcgtgaaatggcgcgggagttgcgtttgacagctgtggtgggcatgccggtgcagttggcgccacaagcgggtgtactgattggtgcgctcgtgctgggatcggacggttcaattggcgtctacaccaagcagcatctgcactctggagaagagctggcatttacggccgggcagggtggcgagattctgggatgggaagatgagcgcattgcgctggcggtgtgtgcggacttttcccacgccagtcacccacgcctggcggcggaatcgggcgccacggtatatgccgccggcgtgctggtcagcgagggtgggtacgcggcggacagcgcgctgcttcaaggctatgcggctgagcatggcatgctggtactgatggctaatcatggtggcccttcgggaggctgggtttgcgcaggccgcagtgcggtctggagcgcagatggcaatttgcttgccgctgcgcccggtgtcggcgacgcgttggtgatcgcccgtcgcgaaggcgggttgtggactggccaagtggtagccctctgaatgacgtttcacttgcgccaggcgacggaccaagacctgccctttgcccgaagcctcacctatgaagccatgaaccgctattacctgcagtacggcttgttgtggtccaacgccggcttcgatactgcatgggcgggtcgcgaaaactggctggtgtgcaacgatgatggcgtaatggggtttgtcagcctgagtcgcgacgagaaagctctgtatatccgcgagctgcacatgctggagcgctgccgcaagcagggggcgggcagttgggtgctggagcagatggcgctcaagacacataccgagggcctgggcttgttacgcttgacggtattcaagaccaacccggcaagagggctgtatcagcgccaggggttgagtatcgtgggtgaagaggactgcttctggcgcatggagcgtgagtgtcgggcactcacctcggactaaaacagtcacgccgtgcgaataagcgcatactgctgtcagttaacgccttgctgatcttgggttcgagcttctggctcatccacgataatcccttctttcatgcccaacaggaccgccaccttatgggcctctccacgccgtcccttttttcgcccagcgagcacttgataggtggttgccgggtccacgccatgctcccgggcaaacgcttgaactgactttccttggtgttcaagccaagccttggcttgtgcagcagtgcggataccgggcatagttcaaaaccgttcaagtttgtttaacgaagtgatggtgtgtcacctcttggggtgtgccaatctaggatcatacatccaaatgagtggaatcggttcgcgcttaaggcaagaaagagagcggcttggcctgtcgcagaaagtttttggtgaaataggaggcgtggaagccaacgcacaaggcaaatatgaaaatggcggtcgtgcacccaaggccgactatctgtctcgtgtcgccgaaagaggtgtggacctcctttacgtgttgaccggcagcccaacgccaatccaactggataacctcagccaggtcgaagaaaaagtattgggtaactaccgcgccatgttcaaggaagaccaggatgcaatccgtcgcttgaccagcacattggccgagcattcatccgtattgaacggaaaatccaagcctaccgccccggattcctgacctttcacccaggaaacaacgctgtttgcctcccggcaaacagccgcagcgcgtcaaaactctatatatatgccacttgcacctaggtctgcgccttggttttttgctaaggtgttcagcaatctataagaccatatcgcgaggtgtctgcttgattagggtgctagtagtcgatgaccatgatctcgttcgtacaggcattacacgaatgctggctgacatcgacggcctgcaagtagtcggccaggccgagtccggggaggaatccctgatcaaggcccgagagttgaaacccgatgtggtgttgatggacgtcaagatgccgggcatcggcggcctgggcgccacgaccaaattattgcgcagccatcccgacatcaaggtcgtggtggtgacggtgtgcgaggaagacccgtttccgactcgcctcttgcaggccggtgcagccggttatctcactaaaggcgcgggcctggcggagatggtgcaagccattcgcctggtgtttgccggccaacgctatatcagcccgcagattgcccagcaattggccatcaagtctttccagcccaccagcgattcgccgttcgatgcgctgtcggagcgggaaatccagattgccctgatgatcgtcggttgccagaaggtgcagacgatctccgacaagctgtgcctgtcgcccaagaccgtcaacacctaccgctatcgtatcttcgagaagctcgccatcagcagtgatgttgaattgaccctgctcgcggtgcgccacggcatggtggacgccagcgcctgacatgaccacaccgtttgatccaagtgcctttctctcgacctgcagtggccgccccggcgtgtatcgcatgttcgacagcgaggcacgcctgctgtacgtgggcaaagccaagaacctgaagaaccgtctggcgagctacttccgcaagaccggcctggcgccgaaaaccgccgctttggtggcgcgcatcgcccaggtggaaaccaccatcaccgccaatgaaaccgaggcgctgctgcttgagcagacgctgatcaaggaatggcggccgccctacaacatcctgctgcgcgacgataaatcctatccctatgtgtttctatcggacggcgatttcccacgcctgagcattcaccgtggggcgaagaagcagaagggcaagtacttcggcccctatcccagcgcgggcgcgattcgtgaaagcctgagcctgctgcaaaaaaccttttttgtgcgccagtgcgaagacagcttctacaagaaccgcacgcggccgtgcctgcaataccagatcaagcgctgcaaggcgccctgcgtaggcttggtggaaccggcagagtacgccgaggatgtgcgccactcggtaatgttcctcgaagggcgcagcaatgcgctcaccgatgagctgtccgtggccatggagcaagccgccagcactctggatttcgagaaggccgccgaactgcgcgaccagatctctttgctgcgccgggtccaggaccagcaaagcatggaaggcggcaccggcgacgtcgatgtgatcgccgccttcgtcaacccgggtggtgcctgcgtgcacctgatcagcgtgcgcgctggccgggtgctaggcagcaagaacttcttcccgcagaccggtatcgacgaagacgtcgctgaggtgatggccgcgttccttggtcagtactacgtcagcagccccgagcgcgacctgccgtcggaactgatcgtcaacgtggtacatgaagactttcccaccttgattgaggccatccacgagctgcgcggccgtgagctggacatcagccatcgcgtacgcggcacccgcgcgcgctggcagcaattggcggtgaccaacgccgaacaggccctgggcgcacgcctggccaatcgacagcacgttgccgcacgcttcgaagccttggccgaggtcctcaacctggacgagccgccccagcgcctggaatgctacgacatcagccactccagcggtgaggccacggtcgcctcttgcgtggtgttcgggccggaagggccgatcaaatccgactaccggcgctacaacatcgaagccgttaccgccggggacgattacgcggcgatgcaccaggccctcacgcggcgtttcagcaaattaaaggacggggagggcaagctgcccgatatcctgctggtagacggcggcaagggccagttatccatggcgcgagacgtgctcaacgaattggccgtgcccgacctgatcctgctcggcgtggccaagggcaccacgcgcaaggccggtttcgagacgttgtacttgaatgatgccgcccatgagttcactttgaagggcgactcacccgcgctgcacctgattcaacagatccgcgacgaagcccaccgtttcgccattaccggccaccgggcgcggcgtggcaaaacccggcgaacctcaaccctggaaggggttgccggggtaggtccgacacggcgtcgcgacttgcttaaacattttggtggcttgcaggagctgtcccgtgccagcattgacgagatagccaaagcacccggtatcagtaaaaagctcgctgagctgatttatgcaaacctgcacagcgaatagaatgccttctcacctcgtagccagttgtgccgatgaatatccctaatctgattaccgttctacgcgtcctgcttatcccgattttcatattgttgttttatttgccgtatgaatggagctatgtagcctcaagctccgtgttcgccttcgcagccgccaccgactggctcgacggctacctggcccgccgcctggaacagagcacgccctttggcgcgttcctcgacccggtggccgacaagctcatggtggcggtcgccctggtgctgctggtgcaggagcacggcaacctgtggctgaccctgccggctgcggtgatcatcggtcgcgagatcgtcgtctcggccctgcgcgaatggatggccgaaatcggcgcccgcgctcacgtcgccgtgtcgaacatgggcaaatggaaaaccgccgcgcagatgctcgcgctggtcatcctgctggccaacccatcggacttctcgttctgggtccttacgggctacgccttgctgctgatcgccgccggcttgaccctgtggtccatgctccaatacctgcgcgccgcctggccccacctacgtaccaccgttgaaaagaaataaaacttttttgaatcaagggcttgacgggtgctgaggattctatacaatgcgcatcaccaagcgggaatagctcagttggtagagcacgaccttgccaaggtcggggtcgcgagttcgagtctcgtttcccgctccaagcattaaagaaaaaagccactctaacgagtggctttttttgcccgtgatttgtgaaatagacgctttggcgtcttttttgttgttggagcaaaacgctcgttccggcagtaatgggcatcttactgtcagcggccttcgccgcgctggcggtgttcaataacctcaccgccagcacctcaaatttcaacttcgaccagcaattactgagcctggacgccactttctccggcagggtcgtcatgtcgcacgcgatgcccgcaccggatgtcgggcttacttcgtgcaggtcaggcgcgagtacgtcggcggctcaagcaggatgcccggggtcatgaatgtcgagcagttgaatacgcgtccttttgctgtcgtggctttaaacgtcagttcagcaccacctaggaagtcttccttgcctttggtcactgggcccatagtcagctcatccgttgaagcgaggccgatcgcctcggcggtgactttgtgcatctgcagaacattgggggtggtggagcagcctgttagcaggctggccagtacaaacagtaagagagtggttgaggttctggtcacgggtgtggctccttgcgagtggcggcggcagcgagcagggagttttgctacatgccgcttgttcgaatcttcgaagggacagggatttgccctacggctgcggagtctaggaacacgtaattgctcccacaatcacttggacgaaatcgagacggaacccacggcagatatttctggagctgtaggaaatcagctacagcagggtttagcggcccgttgttgcttatcggtcacgcggcggacgctgattgatcaagctatggaaacggcccatgtctgattgaaatgagcgcgttgtcatgttcaaccgacggggctttgcggcatagaaattgggctaggtgagcgtcgtgtttatacccagcgagcccgcatcgtgaacggggcaaaaaaagacagggagttacacaaggagcaaggaacggctcgcaacggttatcgacttctggacgggagggtgttggcgacaggctcccggcaacgtatccaaccccgcagatacttcatcgtccgccgctccatgacggcgtcactttttatgggtgagggcattcggacccgctggtttccctgaccgcaaacatcaggcatcgcaccgcttcacgatcctgttccgacaagcaacggtagttgcgcaccagttgctcttcctctcgagtgagctggtgggggtgcagggatgtaccgggggcagtacgcagtgtgggagagtgtggagtacttggcatgatcctgattcttcatgaggtgaatggagacgtgggcttcttgcccagtacaactgaatacataacgtttattttggaaaagagctcgttatttttcgtgactgttgggtatttcagatggggccgtcggaagtgcttggcaaagatgtaggagcgatctttcaatggaggtggaaaacacgcgatgagggggacgctaccgcagatcgggtcctatgcagtgcctgagaggtccgggtgatggctttcgatcaggtagccgcgggcgtcatcccgatagtgaatgtgctcgcaaccagcggatcttcttcccagagcaggttgccctgggcatcgtagctggagcgataggtacgcccggcagtgttggtgacttcgacaggcaatgcccagtgccgcaggtagcggatgtgttcgctacgccccaatggatcgcgcgtctcgatcaggcggccgatgtcatcatagctgtagtgccattcgccgccctgtggatcgacactcttcatcaattgcccggcgatgatttcctcctgccagcaattgccgaggggatcaatatgcttgtagatctcgtagaacgggccccaatagtaatggtcctgacgaccgaggttgtcggtgacgtaggtttcaccccgttccaggtcgtattcgaattggtactcttcgccgtcgctaccccaatggcgaatgacgcgccattcgtgatcgggttgtggctctaatagaagcggaagttggtacgggctgccgtctgcacgcttgggtgggtgctgatatacgcgatttggccgaccgcgctgctgtggaggatttccagcgagtagggcggcgccaggtcgtgagggatatagactgcttcgattgatggcttgtattcagggcgcggtgcgtgactcgaggtctatttcggctggccatcgcactttgggggccaagcgacgcgcgaggttgaaggtcacgttttcgttgttccagtcacgaggtgggcgggggaaggtaggcagggcttgcgggccctgttgcatgaacagttggaccatggcccagtacatttcgccttgttgaatttcgtgggcgaaatgaaaacgatctattacctggtgggtgccaggtttgaccacggcgagggtgacggtttcgatgaggccgccactgcccatggggccgtacacgttgcaggcttcggcacgcaggttatcccagtcatagacttcggcccgaacgccccaggcggtgcggctgaagggtctgaggccgtcgcggtaaaagcggtaaacatagactttgcgtcggaagcggttaaagcggatgggttcgtcgcggggaggggcaacgtccattcgccagaagtaacttcctagccataagccgatgcctatcgggataagctccaataatttggataacaaagacgaaggtgttggagaactggcgtgaatcattattaggaacattgttaaggacagtgtcattgcaaataggaatgcggcacaccaaatgcccacgccacgcattctcactgtagcgcgtgccagttcaagatatacatcgtcaacatgattgggcggattcgatagtacgggaggatacggttcattggagggcgactcgtttggtcccggcagatcgtgcttccagccaggagcaggtttgtcgagtaaaggtgttttaaataccatgatgagcagttccagttcggggtgatcgccgcttgtatctttagtcggtcgtcgtattaaggctgcttcggtggatggcttgtattcagggcgcggtgcgtgactccaggtctatttctgctggccatcgcactttgggggccaagcgacgcgcgagattgaaggtcacgtcttcgttgttccagtcgcgaggtgggtgggggaaggtgggcagggcttgcgggctttgttgcatgaacagttgggccatggcccagtacatttcgccttgttgaatttcgtgggcgaaatgaaaacgatctattacctggtgggtgccaggtttcaccacggcgagggtgacggtttcgatgaggccgccactgcccatggggccgtacacgctgcaagcttcggcacgcaggttatcccagtcatagacttcgactcgcacgccccaggcggtgcggctgaagggtctgaggccgttgtggtggaagcggtaaacatagactttgcgtcggaaacggttgaagcggatgggttcgtcgcggggggcttctacgtccattcgccaaaaaaacacgcctacccatatagggacgataaacgcgatgaggccgaagaagttaaatacaaaagaaggcacagctcgagttgttataaaaagggtaatccaagcgacgggaggaatgagagagaacaaaaaaagagacatcgccccccaaacggcgacaccccgaattcggaaggtcctacttggcaactcaaggtagatatcgtcaacatgattgggcggatttgagagtacgggagggtagggttcagtggagggcgactcgtttggccccggcagatcgcgcttccagccaggagcaggtttgtcgagtaaaggtgttttaaataccatgatgagcagttccagttcggggtgatcgccgcttgtatctttagtcggtcgtcgtattaaggctgcttcggttgatggcttgtattcagggcgcggtgcgtgactccaggtctagttcggctggccatcgcactttgggggcccagcgacgcgcgagattgaaggtcacgtcctcgttgttccagtcacgaggtgggcgggggaaagcgggcagggcttgcgggccttgttgcatgaacagttgggccatggcccagtacatttcgccttgttgaatttcgtgggcgaaatgaaagcgatcaattacctggtgggtgccaggtttcaccacggcgagggtgacggtttcgatgaggccgccactgcccatggggccgtacacgctgcaagcttcggcacgcaggttatcccagtcatagacttcgattcgcacgccccaggcggtgcggctgaagggtctgaggccgtcgcggtaaaagcggtatacatagactttgcgtcggaagcggttgaagcggatgggttcgtcacggggaggggcaacgtccattctccagatataaatgcctagccatatgccagtaataaatacgatggggcctagcaaacttagcactaagggaggaaggtgttgctccgtgacaacatagctaatcataccagcaggtgtaaccatggacagcagaaacataaaaggagctatccaaataccaatcccgcgagttcgcactgtggcgcgtgccaattcaagatatacatcgtcaacatgattgggcggattcgatagtacgggaggatacggttcattggagggcgactcgtttggtcccggcagatcgtgcttccagccaggagcaggtttgtcgagtaaaggtgttgtgaatagcattggagtagttccagttggggttgagagctgtttttttaccttcgcttcaagcgggcagcagtcaaccaataagcaggcacactgttgatgatcaacagcgattgttgctatgggaaaagtaggcaaatgcccatgccgagttcacccaaggctgtggtttacaagctatccatcaagatgagctcggcataggcatcgtgaatgtcgcgatcgggccagtaggttaccgacaaggtcgccgcttcaatgttgtgccgacggcggtcgggcaacagtacaaccgcgcctttgatatcgttgacctgcgaggtacggttatcgggcaacgagacggtgcgaacttcctgcgtgggcagggtgctgtcggcccggtagtcaggcttgttcggacgtttgggcacagccagcgccgctcggcgttcgctggcggcggttgccagggtggggggattcaactcgccttcggccagcacttcgccgccggtgtactcgttggccgagccatcgccgtgacgatgaaccgttagtgaccaacgataggccgaccggttggcgtcgaagaacggcagaaccaggcgatattcgaggtgctgttcatggacctgtgcgcccacactacccatggggccgccccagccatgcgacccgctatcgacgattcgcaagcggaagttgacgccagcctcaacgccaatggtcgcggcatttaggtcggcgatggcgatgtgggcgtgttctggtttgttccaatgaacaggtggaacttcgttgtgcattccaaagaaacaacggcgagcccagcggtcgagaggtgttgattcttctcgctcggcccatttgtacaaaccgtatcctgctaggccgagaagtatggctatgcccattggaccaagtagcgtactggtacctgcaacggcggcccaaatgctggcccccgctcccagacccgaggcaatggcagataggagataacctcctgctgctggagtatcccctccgttccgagtgcgattaaaagcaaaccccgctcgcgtcgcatcgtacaatcccgccacagcaccaatactccccccagctcgtactaatacgttgcccacccgtgcagtcgctcttgcggcagtcatcgcctgggcagacaagctgcccgccttctgcatctgcaccgcccccttttccagggcgatgcctacgatttccacccctccacccaacacccccaaactactgccatacaatgccaatctggcctcaacggccttttcgcccatggctttctccgcttccttgagacttttgttcagcgagtcgctaagcaggtacatcccgcccatcgccatcaaaaactcgctactgccgaccacgccacgcaacccggtaaagccggtgcgaacccaaccagccgccaggtacgaggacaccttgaccccctgcagcaccttgcgcgcctgcgggtccagggtgccaaccccgactgcgatttcgactagcgcagcgtgggcacctttgcccagctgatccacgccgaggttggcctggcgcatcaggctgtcctgcagttgggtgacctgaccttccacccaaacgctgatggtcacgctgaggttggctattttcgggtccagcaccgccaggctgagcaggccgccctgaatcaacgggcgcacctgtttgcgcaccttgcgggcctcttcgtcggttttgcccaactcgtccttgaggccttcccaagtgcggtcgatggcatcagcggctttgcgttgcacgttgcgcaggtgctcgcattgcagggcgtagtattcacctagcttcatcttcaccttgagttcggtcagatgaataccgttgtagagcagttggctggcactgttgatacgcgaaaccgcccgccccacgccagggccgagtgacggttgcaagcgggcggcagcggcattgagggcgccgagaagctgcgccatggcatgctgtagacgggggcggacatgcttcttgaagtcgtcgttggcgatgagcttggtaatggtggagtagagcttttcgctgtcgttccagtcgctatcacctgtggcattgaaactgggcaacagatcggccagcaagcctttgtcacgcaagagaagggcgcggtagatcgggctctgtgggtcgttcagccattcactccacagggaggcggtatggccgtcatctagagtcgcgggcgcttcactgataccaccttccaggcacagcgccatggcctggctgtaggcctgtcctgatgggcgatcatcgccgtcgtagtcattttgctcgacacatgcaaacagactggagcgacacgctgccgcgtaggcgtgtgcgctctggtcgatgtaacgctgataattggcccattcctgctcatatagttggtgaaacagggcacggctctgttcatcgtagcgctcttccagtttctggttgttggcgagtgtgcgcttctggacgattcgctcgcgttgctgctcagggctggaaaataccggtgggccatcaccggtcatgggctcgacagacgccggtaggggcgtctggccttctgcctgttcgcgatggacttcgcgaatggccaacagtaactgagaggtctggtaacgataagcccggtccgggtcgtttatccaggcctggcgctgttggatccagcggttgcgggtgtcgttgagctcctgcaccaggccgatgatgtcatccagtacaaatgcaaggacgccgtgttggagttgatgctgtgggatggcgttgcgcaggaagcccttcagtgcgctcaggcgatgggcccggctatggaaaccatgcacgctgtcgaatcttggcgctacctcttgcggcggatgctcataaaagcgccagtcggtttcggtagaaaggggcaatggactcttcgggtgttgttgatattcgtagacctgcttgtctacctgcaggttttcatccgtcatggccaggccaaggctggcggggttgtcgcgtgcactggcaaggtcgagcttgtggaatcgctctgaagcctgaccggccttgtaagcgtccagcacactggcaggccacgggtcattggcaaaggccagccacgcttgggtgtgtttgctggtgtcgatgttgaggaacgatgccgggcaatcgtgattggccgagacgcaagcatcggacagcggggtctcgttggcgggcgacggagcgtaggggttgaattgacgtagaacgcggttcaaaggcttccaccgaacgccggatatcggtgctgatggccaccaccagatcactgctggcctgggtgacgccgttgaaatcgcgcaggcccagctcagggttgctttgcgagcagccctggcgtgagttgagcacctgttccaagtggcgtttgatcgcctcgacacgctggcgcgcctgttcatccgcgctgtcggggcggtagcgcggtgcgtcgggttccaagcgttcgaacaggctggcacccacttattgggtgtccagccgaccgacgagggatatctcgaagttggcgcccatgtacttgaagtgcgggcgcacggccagcgacacctggtaccagcctggattgccttccacgtcctgcaccacgacttttgcggcgcgcaaggggcgacggctgcgcacatcggacgaagggttttcctggtcggcgatgtattgtttgagccagtcgttcagctcacgctccaggtcctggcgttccttccaactgccgatctgttcgcgttgcagcaccttgatgtagtgggccaggcgattgacgataaacaggtacggcaactgggtgccgagcttgtagttggtctgggcttcctggccttcgcgggtcttggggaagctcttcggtttctgtaccgagttggcagagaaaaacgccgcgttgtcactgtccttgcgcatggtcagcgggataaaaccggcttcggccagctcgaactccttgcggtcggagatcagcacttcggtaggaatcttggcctgcaattggccgagggattcatacaggtgcaccggcagatcatccaccgcgcctccggattgcgggccgatgatgttcgggcaccagcggtagcgggcgaagctgtcggtgatgcgcgaggccatcaggaacgcggtgttgccccacaggtaattgtcgtgattgccgtcgacggtttcgtcgtagccgaaactgcgggccgaattgtcgtcggtgctatagggcgcgcgcagcaaaaagcgcggcagggtcagtgcaaggtggcgggcgtcttctgattcgcgcagaccgcgccatttcgtgtggcgtgggccatcgaaaatgtcgctgacttccttgagatcaggcaggccttggaagccttccaggttgaacagctcaggcccggccgccgacacaaacggcgcatgggacatggcgccgatggaggcaacgtagctgagcagtttgatgtccggcgagctggggccaaaggtgtagttgccaacgatggcgcccaccggttcgccgccaaactggccatagccggcggtgtagacgtgcttgtacaagccgctgcgggtgatgtcgccagcgttgtcgaagtcgtccagtagttcctctttggtgacgtgcagcatttccagcttgatgttttcgcgaaagtccgtgcgatccaccagcagcttcagcccacgccacgccgattccagttgctggaactgcggctgatgcaggatcacgtccatctgcttacccagggcgcggtcgatttcagcaatcatctggtcgacgcggcgcttgttgactggttgctggtgatcaccgctttgcaggatctcgctgatgaacgcggccacgccttggcgggccacggcataaccttcctgggacggacgaatggtggtgttggccagcagttggtcgagcaacgacaggggttcgtcagccaccaatacttgggcggcggcgctttccataggcatggggagtactccgttgagaagggcgttcaagtcagttgttgggcgcgtcgagcaccaggttcagctcactggcaaggcgttgacgggcggtttcatcggtcagcaggttttgcaggtgtttacgaaaggccgggacattgcccatggggcccttgagcgcaactaaggcttcgcgcagttccagcaacttgttcaactccggtacttggcgggcgaccgcatcggggccgaagtcattgatgtttttgaattgaagttgcacgttcaagtcggtgtcttggtcgttgttaaaacagacggaaccgccatgtccagagcaacttcggctttgctgagtacttcattgaaggtgtcttgatctattcgaacggattgccggtcctcaagggcgcttagttcaccgtggcctttgaaatcacccgtgatcaacagcttcagtggtaactcgacttcggcttgttgatcacctgtggctgggacgtacttgatattgatgcgttctttaggcgcgacggaactttgagatttcgacatgggaaaagtccttttttgaaggtggcgctattaaaagcccatgtttcataaaaagtcatgtcggacgaagtcgattcatttcgtggtctcgggatgtaagaaaattccatgtttaatggttttattgttatggtgaaaattcgtacgctatttggttttattgtctgaggggtgcatctgatatttaagtgctttgcagaaaagtagtgcctctggcttgcctgtccgttatttaatagttcgcgaaattgctgtggtcgagggtgggttttatcttcgtcaatagtaaaagttgaatagttagagggaggcgctgatgcgcaaaggatggcaacgttggcgttggattgggggcctgtgtacggtactgattgccccgcaagtaaatgcacaagattgcccggcgatcgtgtctccactcaaacgcctggaatgctttgacctggctgccggcacgcccatctatcatccgcctgcaccgccgcgcaccctgagtcgggtgctgccgattgtcgatctggtgcagcgcaatgaggccaagcgcccgcccgaggaccagcgcttcttgttatcgtcattcccagcgccggacaacgctcagccaccccggctggtcatctcggcgcccgccttgggcgcattaccgccccggccctatttggccatcagctgcgagtcaaaaatttcgcggttgcaattggtgttggatgaaccggccaagcccaacaaaattcgcattcaattgttcaaggacgaacgtccggtttcggcagcttatcaatggcaggtgttggacgacgcgggcctggtagtcgatgccgggcgcggcctgcaggcgatttccttgttgcgcaacatgggcggtggccagcgcctgcgattggagagtgactatccgcggctgcacggcctggtattcgatgccgaggggcttggcgaactgatcgaacaggagcgtcaggcatgtcgctggtaatcgatgttccggtcgatattgtcgagcggctgttggcccccatcgacgccgagcagcctgctgggcatttcgatgtggaggacgagacctaccaggccatcgaccaggagatggtcaagctgggcggcttgcgcgagagcgatatcgactggccctacatcgacgaagcctcccgcgattacctggcgacccagtgcaagcactggcgcatcgtcggccatttgcaagtggtctggttgcgtacccgccagtgggtacgctgggccgatgctctcgggctgattgcaggtatggtcgaacagtattgggacaacgcctaccccaaacccggccccaccggttacctgaacaagcgcaagcaggttcaacgcttgctggaggatctgggtcaggtactgccgaccctggaacgcagcagttttgaaccggcctatcaagtggcggcgcaacgggcgctggctaacctgcaacagtgcgtcgacagcgccaagctcgacgccgcagcgttggacacgttgcaacggcagttggacaaatacagcgagccggccgtggtgaacgcgcctgcccgtacgcccactgccagcggcgctctggacgcggcctttttcagcccgcctaaaccgcaagcgccaagtaacgaacgtgaacaacgccgcaccgtgttgaacatggccgagcagatcaatcaacaagacccctacgaccccaccggctaccaactgcgccgcttcggcctgtggtcgcatttgcgcacagcgcctcccatcacccgcgaccgtcgcactgaattgaccgccgtgcccaaggacatcgtcgacggctatcaggacgcgctgaaccacaacgccattgagccgaacctgctgctgcgcatcgaaaaaagtgtctgcgcctcgccgtactggctgcgcggcagttacctggccgccgaggtcgcctcgcggctggcgatggaagaagtgggggccgcgattcgccagacctgcgagcggtttgtctgccgtttgccggccgtgctggagttgtgtttcagcgacggtacgccgttcgtggatgcgcaaacccaggcctggatcaccggcgccgatcaggcgcaagccaccggcagcccggtgcaggaatacgccgggctgcgtgacgaactggccagccagctcaatagcgaaggcgtggaagtggtgctgctgcgcctgcaggaactgcacgccacccatgacgccccgcgccagcgcagctacgccacggtgattgccgctgacctgctggcatcccgtggcctgtcgtggctggcggatgacctgtacgccagtgtggcgcggctgatgcgcgagaccacggcgcaggggtgggagccggagttgtatcggaaagtggcaaccattatcagtgaacgtaaggactagtcacgtgccccgccaaagcgatctgcgttttaccttcgaacccctgaaagacgacgccttcgacgttgtttcgttcaagctcgatgaaagcctgtcccagccgttcaagctcaccctggaactggccagccacaacgcagccattgacttcaataacgtgctcgacctggcggggctgttcacgatctggcgcggtgaaactccggtacgttacgtgcacggactggtcagcctattcactcagggcgataccggctttcgtcgtacccgctacagcgcggtcgtcgaacccaccttggcgcgcttcaacctgcgctccaactggcgcatcttccaggcccagaccgtgcccgacatcatcaccagcatgctggccgagcagaaactgaccgacattcgcagcgaaatctgcttcgaacaccaaccccgcgaatactgcgtgcaggccggcgaaaccgacctcgacttcatcgaccgcctcgccgccgaagaaggcctgctctacaccttcgaacaccgcgccgacggccacaccctggtcctcaccgaccgcgtcggcggcctgggcaccatctgcacgcacaccgattgtcccgtgatctaccagccaatggccggaggtgactcgatggaaccggccttgagccgcttccactacaccgaacaggtgcgcaccgccgtacaggtgcagcgcgactacaccttcactcacccgcgctataaccagcagcacaccgccaccggcgaccaggacctgaacaaccagcacaaggattacgagcgctacgactaccccggccgctataagcgcgatatctccggcaagccctttaccaagacacgcctggctgcgctgcgcaacgacgccaagctggcgcatctggaaggtgatgacgcccgcctgcaaccggggctggcgtttgatctcagcgatcacccacgcgaggacttcaatgatcgctggcgcactatcgccatcacccacgaaggcaaacaacacaccagcctgcaggaagaagcatttggcagtgacagtggcacgttctatgaactgaaggccacagccatccgctgggcctccgactggaaagcgccgataggcaacaaaccacgcatcgacggcccgcagatcgccaccgtggtcggcccgccgggtgaggagatctattgcgatgaatggggcagggtcaaggtgcagttcccgtgggaccgttcggacaaaaacaacgaccacagctcgtgctggatccgcgtcacccaaggctgggccggggcgacctggggctcgatggccatcccccgtgtggggcaggaattagtgatcagccatctggacggagatcccgatcagccgatcgccattggacgagcgtaccggcagaccaatttgccgccctatgagctacccaagctgaaagctatagcaacaaccaaaagccgcgagtttggcggcacccaagccaatgagttgcgtattgacgacactaccgggcaaatcagtgcggcattaatgagcgagcacacgcacagcgcgctgcacctgggttacctcacgcatccacgtcactatggtggtggccggccaaggggcgaaggctttgaattacgcacggatggtcatggagcgttgcgtgcagcaaaaggattgttgctgactgccgaggcgcaactgaaggccggtgcgggccagctagagcgccaggaggtgattgatgtattgcaagccgctctgacattggccaaacagctgggagcatctgccgaaaatgcccaggcaattgtcctgaatgcgcagccgcagcagtccctgactgatgccgtgaatgcgttgggccatggtgccaatgatcaggccaatggcaccggcaatggcgcgcaacccatcatcgcgttaagtgggcctgccggcatcgctgccgcgacgtcccgcagcatcgtcatgggcgcaggcgagcatatcgacagcgttgcccagcagaaccagcagctcaccgcgggtaaaaaagtggtcgtcaatgcgggcgacgaaatcggcctgttcgcccagggtggcgacatgcgccatatcgcccataaggggcaactgctgttgcaggcccaacacaacagcattcaggtgcaggcagaccagagcgtggaaatcagcgccagccagcaacatgtgttggtcactgccgacaagcacatcaccctgttgtgcggtggggcctatatcaagatgcagggcggtcatatcgagctgggcatgcctggcaatttcacggtgaaagccgcaaacaaatacttcgttgatccaagccatgccgcagcgcaactcaatagctggcccagcacctcgttcaacgaacgctttcagaccttcctcgccaacggccaacccatccgcaaccgtgcctacgcgctggtgcgcaaagacggcgcacggttcgaaggccgcaccgatggtgatggcttcgtcaccctgcaacagggcatgacgctggaagggcttgcactgcaatggcttgaaaacggagaacccgcatgaccgacaacccatcggcgcctcgtgttgcgcccatgacctacaacgctcggggcaatcccgtgcatacctggaccctgacgcccagccacatcaccgacccggtgcactgcatattgccgccggacgggattctgccggtgatttttgtgccggggattatggggtcgaatttgaagagtaagcctgataagcgcaataacaaggaaaaggccgttcctgtgtggcgcctggatgcggggctcatgggcaaaaatatgtggctggccctgaactggatcaacaaaaaagccggtatacgacaaaaacttttgcatccggccagggttgaggtggacaaccagggcgcagtgcctgaacgtgctgctggtacagttctggcacagccggggttggacaggaaaaataccctccaggccttgagaaaacgctatgaagaacgcggctggggcgaggtcagtgaaaccagctatcacgcttttcttctttggctggaagaaaccctgaacaaccatttcctgcctcaccaatggccgcaattcgacattcggcccgagcacctgcataccgtcgctgtcgagcctgggccgactcatatcacccggttaaaacccgaaacccccattgccatgccgggattgggagccaccctggccagccagttgccaccggttatctcggatgagttgttggcgcgcggtgactatcgaatgccggtgcatgcgtgtgggtataactggttggattccaacaaagtcgctgcacagcgcctggccgaacgcattgacgaactgatgcaccaatacggtcgaaactgtcagcaagtcattctggtcacccactccatgggcggattggtggctcgacgatgtgcgcagttgcccggcatgagtgcaaaaattgcgggcgtcgtgcatggggtaatgcccgccactggggctccggtcgcttaccgccgttgcaaggtcggtatgagcgatgaagatccgattgccggagcagtgattggtccgaccggccaggaagtgaccgccgttttcgcgcaggcgcctggtgctttgcagctgctgcctacacaggattatgcccctggctggctgaggctgatcgacaaccagggtatttcggcgatgccgcgccagcctgtaaaagacccttacgaagagatttatctacgccgcgaccgttggtggggattactgcgtgaagagtggctggcaccgaaggatggtgatccgattacgtggggaacatttgcggacaacattaaaaaggcaaaagcctttcatcaacgtatcagcggctcctatcaccctcaaacctacgtctactacggcagcgaagacaagcaccccagcttcgaatccatcacttggcaaatgcagcgcgggtctcgcctcaacgggccccacggctcgcaccccgacagcttcactgtttccaatctccagatgcatcaggtcagggatgatggccgcagccctgtgtatgtcggcggccacgagcaacccataccgcccctgcgtggcgatcccgatgcgcccgtcaaaaccgtgcagaccagctattgggagctgcattgcaagatgcaggatggctccggcgacggaactgtaccggtcagttcgggcggcgcaccggtaaaacaggcgcgcaacggtggcgtccgccagcaaatcaaggcgcccggctttgatcatgaagcgtcctacgccaacccgctaacacagcagttcaccctctattcgatcatcaaaattgcggcgaacgccaagaggcccctatgcgtcggctgatcattctttttgtctgcctggtgctgggctctctcgcagcatgtactgccttcaaacaacccagcgagcaggagaaacgtaacgtgagcgaaatgattacccacatgcgcacttgggcgctgggccgaggcttgattgatttgccggccaactggagtggcggcggtgacgtgaagctctactacgggctaggcgccgatcattcgtcggtagaggtgcgagtcttgggagagggagtgacgcagcagcggtttgatgccgcattgaacgagcgtgcgcaccgaatcgcggcggtcaagaacgatgaacagcagaacgcatctatgttggtttcagcaagtcgtgaaaccccgcagaagatatggctgcagtactttgagagcaccgaagtcccagacaccttcgtccacgaattccatctgctggtgggtgacgcctacgtcatgctccgcgccgaatcctatgacggtgatacagccccggttgaggcccgcctgttaaagctatccaaggaaatattcaaagtcgcacctgagaacgccggtgcaggcttcgccctggggccgattgtgatccgaagtcatcacgaccaagaaatcgccagcttcgatttcagccctcctgcttctgacgtatcgctgaacatctacatcaacgcgctctcacctgatgacgaagaacgcttgcacgtgcgcacccaaaaagacacgaagatttttctcgccggcgattaccaaaatctgcgctctggaaaaatcacactggccgacatgcaagctgaagagtccttgattggtttcagtgacgatactcaccgtcaaatactctttgtcagcgagaactatcgagacaacccctccctgagccgccctgccatgagcattcgcctttcagcaggaggtatgagcgcaggaccaatagaccccgatgaaccagaagaccttgtgcgctggacacttccccaattcgccaacaaaggctacgacctcccgctttggcaacagcccgccagtccggaccccgtcaatccctcactcaccgactacgaagccatggccgtgtgggacgcaatcctcaagtccgtgcgcatccgctacggctcggtcgcgcccaagccggatccctgggccaacattcgcgggcccagtgcagaggaagccgccgaaagcaaacgcatcctcgatgagttcatcgccagtttggaaaagcgcagggcgttaccaggggatagcgatcaatgaatagcgcccgccggcttttttttagccgccttcaccgtcaaccctcccaactccttttgtgcaggcggcgcctttttttgatgtgcctgacgtttgcgttgcttgcgggatgcgccgctttcaaacaacccagcgaacaggagaaacacaacgtgagcgaaatgactacccacatgcgcacctgggcgctgggccgaggcttgattgatttgccggccaactggagtggcggcggtgacgtgaagctctactacgggctaggcgccgatcattcgtcggtagaggtgcgagtcttgggagagggcgtgacgcagcagcggtttgatgccgcattgaacgagcgtgcgcaccgaatcgcggcggtcaagaacgatgaacagcagaacgcatctatgttggtttcagcaagtcgtgaaaccccgcagaagatatggctgcagtattttgagagcaccgaagtcccagacaccttcgtccacgaattccatctactggttggtgatgcttacgtcatgctccgcgcgtcatcctatgacggtgatacagcccccgttgaggcccgcctgttaaagctatccaaggaaatattcaaagttacacctgagaacgccggtgcaggctttgccctggggccgattgtgatccgaagtcatcacgatcaggagatcgccagcttctattttcgcccgccagcttcggatgtatcgctgaccatctacatcaatgcactctcgcctgatgacgaagagcgcttgcacgtgcgcacccaaaaagacacgaagatttttctcgccggcgattacgagaatctgcgtgctgggaaaatcacactggccgacatgcaagccgaagagtccttgatcggtttcagcgacgatactcaccgtcagatactctttgtcagcgagaactatcgaaacaatccctccctgagccgcccaggcatgagcatccgcttatcggcgggtggaaaaaaacgctccgccattgatcctgataagccaagagaccttgtccgctggaccctgcccgaattcgccaacaaaggctacaaactgccgctttggcagctcccagcacctgcagaacccgtcaacccctcactcaccgactacgaagccatggccgtgtgggatgcaatcctcaagtccgtgcgcatccgctacggctcggtcgcgcccaagccggatccctgggccaatattcgcgggcccagtgccgaggaaactgccgaaagcaaacgcatcctcgatgagttcatcgccagctttgcgcagcgcaagccatgacactgagaaggcctttaacgagagcaaaggggaccatgtctgtgggtaacgaattctacaaacacgctaggagcgattcatgaaaacggtctggggttacctcaaacgctggggcctgccggtgctgcggcagttcaaccaggcggtgccggtactggtgctgctgggcgtggtgtttttgttgatcgccatctggtggctgggcccgcagtggacctggcgcgagcgtcagccgctgggtgaattggcgatgcgcgtgtcggccagtgtcgtggtgttggtggtgccgctgctgatctgggcgtggcgggtgcgtaatcgttaccagattctgcaggttgaacgtcaacatgaggcggcggtgcaggccgatccttgcctgccgtatgtcgaggcgcaggagagggccttggatcggagtctgggcaacctgctgaacaatatggagcgccgccgttcgctgtatcagctgccgtggtacctggtgctgggcgaggaaaatgccggcaagaccagcctgatcacgcgttccaaccagagcttcgctttgtcccatgtgaccaaggcgggggtcagggcccatcaggaagagcaactggcctatccggtggattggtggatcggtgacgaggcggtgttgattgatccaccgggtgaatttctcagccacccgacttcaccggctgaacacgtcgagcagcagggcaaggtcaaatcggtgctgcctacgggcacccacgcgcgcctttggtcgcatctgcttgactggctaacgcgcaaccgcagccgtcgagcattgaacggcgtggtgctggtgatcgatgtacaggccttgctggcgcaacgtcccgaacaacgcaaggcccacgccaacctgctgcgcacccggctatttgagctgacacgacagttgggcacgcgcttgccggtgtacatcacgctgagcaagttcgacctgctggaaggcttcgaagaattcttctcccggttatcgcgcagcgggcgcgaagacctgctgggcttcactttcagcctggatgcggtggatgatttcgatgcctggctggcggagctgacccgcgaataccaaacctttgtcgactgcctgaccgagcaggttttcaatagcgccagggagtcgcgcacattggatgagtgtgatcgcttgcaggcgctgatgcatcagatggggggcttgcgcccggccctgttcggcttcctcagcgaaatactcggcagcgatagtttcaccacgccggcgttggtgcgcgggctgtatttctcctcggtgctgcagcagggcaccctaggcaacgctttcgttaaagaagcggggcaagcctatcaactgccgccaccgccacccgaagtcaaacccgctggtggcacggcgatctactttgcccagcaactgttccagcgggtgatctaccccgaagcaggcttggcgggcgacaacatcaaggtggcccgcagcaagcggcggttgctgatcgccgggttcagcgtcgcatccttgggctgtttggtcgtcatcggcacctggcagttttagttcaatatcaaccgcgacaaggcggccaatgtattggccaagagccaggagttcagtgagcgggacatcggacgccaaggtcgaccccaccgggcgcaacctgttgttgcccctggaccagatccgtgatgcggtgctggtctacggcgactatcgccaagcctggccgttgctgtcggatatggggttgtatcaggggagggtgattggccctaccgtggatgaggcctacctgaatctgttgtccaagcgcttcttgccggcgattgccagcggtgtattggataccatcaataccgctcccgccggcagcaatcagcaactggcggccctgcgcgtctaccgcatgctcgaagaacgccaaaaccgccgcccgaccatcgtcgaagaatgggtcgccaagcagtggcagcgcgcctatccaggccagggccggttgcaggccgacttgatggggcacctgggctacgcactgaaatatgccgacgccgacctgccgcactaccgtgaacgcattactcaggtacagcagcaattgcgccagttgcccatggccgaacgggtctatatgagcctgaaacaggatgccctggagcgcttgcatcgccccctggacctgcgcaatgaggtcggccccgcgttcgatatcgtctatagcccgctcaacaccgatcaacagggcagcggcctgcagttgccgccgctactcaccgccaagggcttcaaggattacttcgagcccggcaccgagggcatcatcgaactggccatgatcgaccagtgggtgctcggcgagcgacaacgcctggactactccgacgaagaccgcaaagtgctgacccaacgcattcgcgccctgtacaacgccgactacgtggacagctggcggcgggcgctgaatcagttcgcggtcaccgacttcgacgacctcagccacggcgtggcggtattggaacaagtcaccggtccggccgcaccgctacgacggttgctggaaaccctgcgtgacaacagcgtgatctacccggccgtgcccttggctgaagggcaagcgccgctcaagctggacaaggtgccagaggggcaacaacaagcagcagggattcggcgcgcattctccagtctgtcagagctgatcaccgcacgaggcgagcagccgtcttactacgaagaaaccctgcgctcggtcagtgccgtctacgattacgccaaaaccgtgcacgacaaccccgatcccggcaaagcggcgctgaaaaccgtacttaaccgcttctctctggacggcgctgacccgattgccaacctgcaacgcgtcgccgtaggcctgcccgaaccgctgaaccagcacgtcaaaaaactcgccgaccagacttcacaagtgttggtcatttcggctttgcgcgagttggaaaaacgctgggacagcgaaatctacagcttctaccgcgaccgtctggcaggccgctacccgttcaaggccagcggcgaggacgcttcgctggaagacttcgaagccttcttcggcccacaagggcgcctgcagcagttccacgatcagtacctgaacgtattcctcaaggacaacctcgacgccctgtactccgatagcctcggcggctacctggtgcgcagcgacgtgctggaacagctgaaaaaggtcgagcgcatccgcgacaccttcttcaaccatcgcggccacctggccgtgcaacttaccatcgaacccctggctctgagcgccacccgcctgagcagcatgctcagcgtcgacggccaactgatcccctaccagcacggcgcgccgcaacgcaccgggctggtgtggcccaacagcctgggcaacaccaatggcagccaactgaccttggtacatagcaccggcaacaccgccagcatgagctatcgcgggccgtggtcgttgttccggctacttagccgcgggcacctcaatggccgcaccgacactagcgtggacctgactttctcagtcgccgatgggctaatgcgttatcgaatcggcgcggagaaggccaacaacccgatcacccagcgcagttttgaggggtttgtgctgccgagaacactgctggaagagcgtcaaacgaagagagacgtaaacaaggttgggggtgttgccgcaacagcactcagcgatgcacgcccataagtcagcgatgactgaatacgaaataaatacacacaaaacaggactgtttagatggcaatcaagctgcaaatgttgaccgaagatcctaaagaaattgagctgatcgagcgttactgggctgtcgatgaatcagggcagtaccttgaaaaggtgagtgcactgacggacgttattgaaatggcaccaggcgttacactcgccagcttcatacggcaacgttgcaatgcattcgatgacaatcaggtctgtcctaagtgtgcagaactgatcgaaatcaaaaatcgctccgaggctaaaaaggtccctcaacgttacaccaagctttgtacgctgtgtcagaacgatcaagacgcgatttcgcttgcggccaaaaaggcgaaagccgcagaacttgaacggcagttggccgaatacgtaggcaagcagttaacccgcacggtggattactcagcgctaccggatgctcaggtactgcttttgctggcgttggacagggccgttaccccgagattgaccaatggcggcttcagattaggtgattgtcgagggctgacgcctcggtatgtcggtgacttcatgctgcaattgcgtgaggctgggcttgtccttgatgacccgagtaaagcaagtccggggacctactattggaaagacgatgagatttgggtattgggggaccaggttgtctatcggttggcgccagatgctgcatcaaggagtgcggacgaagtcattcgtagtctgccggatagggtttacaccgatgctgacgggctattcaacctgtggcttgattacgcagttgctgatgtcatgcattatttgggcactgagtgcgaactctataaccatgatctgtcggaacaagagctggcagaaattaaaagtacgatccgcgcggcattgcacacctacagcgtttcacagctctggtcggtggcctggaaggttgtcagggacgctgcaagtttagcgaatcgcgagtactacaaccgttccaaagcggcagcaaccatcccagggaagattcggcgcaacttggagaaggtgcagcgggagtcgattgaactcaaggagtggagccgcccggagcaccaccccgtgggcacattggggatggtgttgggagagattttgggggttgatgaaaacacctctggtcatagagtctcttcccttattgcctggctcacagggcaggcctgttcacctgctatcgaagcagcgctagacgagccgatacgggaattgatgaccttggcgttgtcccaagacatcggcgcttcagtaatgctgcggttcgcagagatgattcgtgccggtcatgatgtcggttttgctattgaagaaattggtgaagcgcttcggtcttaaagcgggcagggtacacccgagaatagaagtggcagcaagccctcagcctacatagggagacgcccaacgcaaacgagcccgccagtgcctctggctggcgtggcagagccgtggcggctgatgcgcataaaccaatcacaaagcatccgccctacacgcgccgtcgaaattaccggttctatttcgaatgtaccgagtaatgccttgcaacaactgggcaaaacgttgggcatagatatcccccaccgatggaagcaaccaagtgctgttgatttccagctgaacgctgggaacgccgagggaagaagcaaaccgtgtcagcgtctgattcttagtggcggggaagtagttgtctgagaagttcagaagtccttccttgcgtagcgcttcgctcagggtggggacgatgtcagtgtgccctagtaaagacgcgccattcatggtgccgaagtcgacgtcgtaggggcgcgaggtgctgctgccgtgagggtcaatcaataactgcggcttctgctgtttgatcagttcggcgacttgtgccttgaaggcattgtcgtcgtagtagttgggatctgaggggctgcggtattgggtataaatgacggtcgcgcaggtcaggctatggagcagtttggccagtgcggcggtagccgccccgtcagaatagcgatagtcgccttctcgatagggctgcgtagcgtgaggcgcggtgatgaggacaggcgtcgtgcccttgagcaccacataccaagcggtgtcggtgggggcggcggtggcactttgagcctcaatcgttgtttcaagcgttatcgcttcttgtatctgcgccggctggatgagggcgcgttctgcctgcgccagcccggtggtggtgaacaagccgatagccagcgttacgcggatggcacgtgataggcctgcgacgttcactgctcgatcaggatcaatgactcggcaggcggattgatcgggcacaactgaccgcaaagcacacgcgggcgtcgagcattcatcggctgctgtagtgtcgagatgatcttttctgaggcgaggcattcagtaatctccatgactgatcctcatcgattacgacaggcaagggtgctagcccaatcagagaccagtgattctcatgtagcgctcatttttagctgggcaatcgcaggcgtctactgtcatacctgacagtttttcaaacgcttgtgcgctcctgcccgaatactccctgcccaagacctgcacgttccggcatggtagtagcgcattaccgccgccgtatccacctgcgtggtactcctttttgcccagctcccccacatcgggtttcggagcctccacggacaaaaaggacgttttccatgcccatcaacccacctgacgccattcccgataacctcatcgccagagccgtcggcgtgcagttcatgcatcaccccaccttgatctccgtcgtcggccaatggctggacaggggcatcaaacaagcctatccaaccctggactttgacctcgtcaccaccaagcttgccgtacccaatgcactaggggggtgggacttacgagttttgctcaatgtggcgctcgatcacctggggaatggcacttcgctggatttctcaacgcgagacactcgggatcatttcctgaccaacagcgcaccaacaccgctggctcccacaggttcagatgcgcctgccgtagatatgagtgtgattgagcaagtcatccgcgagttgcctagcattgtcccgattgcttttcagcaggcactgattgcgtattgggaccaaagcgcagaagacggatctacccgttggcgctggctcagtgagttgctgcgcggcaacctgatcaacaccgccatcgccccatcattcgctaagccggcccgtggcgtactccaacaggtaacggactacccggatcgactcgaccgtctggcggcgttgaaggcgaaggctgttcacgtctatgtcatggaaacgatgctgacccgggcgggagcctcgttcacgctgttatcgcccgacctgttggtggtcaacgcctcgttggtcctgctgtgttctttagcgggagacgtcatgtcatttgcttcccaggatgagtttgatcgctactgggcgtcgaagatcgacggcgcatttgttgcggaccagatcgcgtggaagcgttacgagcccaatggcaatgtgttcgacgtccaggcggctgcggtgcttaatcagcagttgcaggacctggcggctatccctttaccctctcatcaggggcttcataagctggagcagcagtatgacgccgtgagcgatcccacccttttatttgttactccaacgcctaccaaagtgcctatggccgcccaactgcccgactggttgaaaagcgcctcggatactcaacgcctggcctatcgcacccatctattggagctcgccgctgctaaagctcaggctcaagggctgtctttcctggacggggtgagtgatatcagaaccttcgcagcaagcgccctgcatgcgcagatgttgatcgatcaaccgatagcgcccggctacaaccctgacgaactggagctgacattcgcagtggccacaggctatccaggcggtgcggggattattcagcgcaaaacactgtcattgactgatctcgccttgagcaatctggttggtaagcccaaaggtccgatgaccatagggcacactggcggtcaattgatccaggactggaccacccccgattacctgactgatctggtcctgcgtgtggacatcggcaaaacctacccggaatacctcaagcgcctgctgctgtccgatagcgacgaaaccctgcagcgccaacggctgttcggcgagcagttgcgagcgcagctaccgttgcgggcgttggagctggcgatccaggggcaacagggtttcacggtgcagggctatcggtatgtcgctgcgctgatgcaactcagtgacgctgaacgtgttgtcgaggaccgccacatcgttatccgttcgctggcactgctgcgcaaaccgggtgcccagtcggacaaggtcgacaatatgttcgtgatcgaagcgcaggacctccagcctggcccggttattctttatcgtccgctttatccgcagttgttgactcagtacgctaaccgcgaagccttgttggcggcgatggccctgcctggcgcactgcaggacagcgtattgatgtggcttagcgaacctgcgcgagtggtgtatgcgaacggtggcttcaatgagccgcatattatccggtttggcatggggtctgagttcgaccgtctggagacacccgttcctgcaacgttggctgccgatgagggcagtgaggagttgctgcaacatctgcgcaatggccgcttactgccgtacctgtttggcgaacatgcacgggcactggtggacttggcggatcgcgagtcggtgtccaatgctgagagccgttgggcactgctcctggaaggcggcgggctgttgctcaacaccttgctattgcccctgctgcaaggctctgccatgtcgatcgcgtggttgctgctgctgacccaaagcttgaaccaggacattcctgcactgcagagcagcgatcccgttacgcgagagctggcctgggtcgacctgttgagcagcctcagcctggcattgttgcatgtcacccggggcacgccgcccagtaaacccttgatcgccgccgggcccggcgatgcggcattggtgttgaccccggtgcgccgtcccgccgggagcctacccagcggggccaggccggcggcgagcagcgtagcgttgcctgacgtaccgattgcagagggccgaacggtcttcgattttgccttttccaacgccttgaaccacctcagtaccagccagcgtgcttatgtcgagggtttcaaagtgcctcgtcccgcccacctgccgatgccgatcatgaccgggccgctccaaggtctttaccgccttgatgaaggtttgcatgcgctgattggccatgacttgtatcgcataggccaggcgtcgagtcgtgtgtttatcgttgacgcgctggactcatcccgcaccgggccgtggttgaaaagcgatggcggcggtcgctggaccttggatcttgcgccaaagctgcgcggtggtgcgccgggtgatcagatcaaggcacaacaagagaaaaatcgtaaagcgaagaggcaaatgaaagccgaacacgtccggctcgagctggaaacagcacgtgaggcggatgtgatgaccagccgcttcgaggacgtgaaagcacaaagggatctgtacctctcagccagaaaaaaactcagaaactggtggacgctgctcgaccaaaataacgatgaacgcaaagtcgccttcctgaaaaaaaaacacgaagacgaacaagcccactgtcagacactgctgcatacgttcagtctggccttggaggcattcgtcgcacaggccggccgtttgatcgaaacacgtcgggtgctgatcaaagcgatcaaacccataacggcggcgctggaaaccagcgacttcgagaaagcccgttccaacgagtatggcgccatcagcgctacgcaattgcttatccataatctgcatttggcgctggccatggacagcagcttttcaccaaagggtgagtcggcgggggagatcgcccaacgtatcgacgcgaatgcgccggtccgaacgcctgaggcctatcaggatttgatctcccgcctggtggagatgaaccagagggagcagcaactgcttgaggacacctacgccctggaggccaccctgaatgagcaggcgcaggactccagccggggcttgggtgagagtcgggcgttcatccagtcgctgcccacccaggagatggccgacccgttcaacgtggcgctgaacaatctcaacttgcttagaaccttaagcatcgacaacctcgcgctgaccgacgcccctgcggttcagcatttttaccaattgctcaacgagcagaacctgcgattggcgacgtcctcccacattgcactgaggacctatgcgcatttttcggccagcgagcgcaaggcggtgctggcgaccttgatcaaccagtatgcgcgcttggcgagtgcctctgacgcgctgcatgagcttgatccggcgctgagccgcccggtctatcaggcgcgcttcctggagcggctgaaccaggcgcgtcagagtgccgagtccgagctggcggcgctggtgcgagaggaggagggcatcgccgtgccaacccgcgcaccttcacttcgagcgtccaggcgttccagccaccgggcctttaaaacccagcgacgcggtacgttgatcggcgatgcccgagcgacgcaatcggctgagcaggtggtgatcatggagattctcgacccgttcaatcaacaagcggttgccagttttgtcgagcatcccagcgagggggtgtggaaggagttggtggtcgccagcccaggaaggccgacgtctgtgccgccccaacgctcattggcaaatttgaagcgtgccgccgatcaactgaccgcgcaaaaacaggacatccggcgctcgatccatttccagatgaaaaaactgcaggatccgacacgccgcgaacacgtcgacccaagggattgggaggtcatgctcacgcaacaagccaataagctcaacgcgatcatccaggaaattgaagcggcccacgcggacaagcccggtgtggcggcgttgctcggcgagtacagtagcgaggttgccagcctactcgaagaagggcgcgattaccgcagcacaggctacaaggcgcaacgcccgtcccaggaaaatgttgactacctgtggacccaccgcaaggtcgatatcaatttggtgcatcggcgccaacccactgccagtggtgactacgtcgctgaattttcagttcgggaaaagcaccagccgcacgtgctctggtatgcgcactttcactatgccgacaccgaggtggcggacgatgcctaccgcgtcgcccacctcaaattggcccaccagcgcttcctgctgcagaaagatctggtgcgagactccggcgccaacgacagcgcggtgttgaaggtgatctatgctgatgtgacgccgccgttggatcacaagctgtttcttgggttactggcgagcgtgcggtagtagtgcctgcctggcccccgccgcgggcagggcggacgcgggggcctagccagccgccgtgaagcggtacgaggcaatcagcttttggcggctatcggcgtggcattaactctgcgcgcaaacgtctggcagcgcaccgcttcacgagcctgtcccgacaagcaacggtagtaacgcaccaactgctccttatgattgaaccggccggggcgcagggatgtactgcgctgaaagccggagttacaacgggagttgccgaaaccataataggctcgcccagtgactgacagccccggctgacaccgaagacaatcttttttcaattcatcccctcccgcaaagctctcatccgttcgcgcaaagacctcggcagctctgcacctcgataatctcctttcactcaaccctgccgctgcaaccgagcaccgcgtaccatgaacctgcgcaccttcatccgtcgctactgcctgaactccaggctcgccacgcatgcactgacccgtctgcacaaatcgctctctttgctggtctcctacctggcccagctaggcttcgattccagcacctggccgaccagccgtgaagaaggcgcttacgagcgtcgcctcaacagcctgtgcccggagttggccgccaccgtgttcagccacgcgcgcgacggcattatcctcgtcgacccgttcggccgggttatcgcggtgaacgaggcgttcacccggctcaccggctacgggcaggacgaagtgctggggcgggagttgaatgcccatcgcctggtgcgtcggctcgcgacgttttatacgccaatgaagaacgcgctggatttccacgggcattggtccggtgagatccaaagcagccataagaacggccgggagatgacctcccgtatcagcatcagtgcggtgcatgaccggcacgggaatgtgcagcactatgtagcgctgttcagcgatgtgacgcagatgaagcagcgcctccagttgctggagcgtgatgcccggtatgacgcgctcacgcaattgcccaatcggctgctgttggccgagcggatgcgccaggcgctgggcaaggcgcgtctgcatcagcagaaagtggccatcgcgtttattgacctcgatgggttcaaggcgcttaacgacagttatgggcatgattggggcgatcgggtcctggagattgtcgcggcacggatcaatgcgacgttgcgtgaaggcgatacgctggcgcggctggggggcgatgagtttgtggcggggctggtaggtttacaggccgtggaagacagcgagcctttgctcaagcggatgctgcaggcggccaatgccccgattgtgattggcgcgcagacggttgagattgcggcgagtatcggggtggcgttttatcctgagcatggggtggagatcgatgggttgatcagcaaggcggatcaggccatgtacctgtcgaaaaaggccggcggtaaccgtttggcgttttgtccgacgcggttcatttcgctcaatagcgaagcctgacggtggtgccgagggtgcgttcgctgccggtcatgacgccgtagtcaccggcgccgagcagtgaatacacggcggtgatgtagtggcgatcgaagaggttgcgcacccagccttccacctcccaggcacggtcctggctgcgcagccccaggcgcagatgggtgaggccgtagctgggttgataactgccttcgccgccttcgagggtgccgtagtagccggacctgaagctgtaatcgatgccgctgtaggcttccagcccatgcggcagcgggtggctgtggtcgaggctgctgctgaggttccattgcggcgcgttgtagaggcgatcgccactgaggtcgcaggtccattggcccgaggcgggtgggcatggcgcgttggggaagctgcggtagcgcgcatcgctccaggccaggcccaggcgccaggtgaattgaggctgcagttgccaggcggaatccagttcgatgccgcgcaggcggactttgccgacgttgatcaggttgtcgcgcagcgggggcgcgaatagcgatgtcggcgggctataggtcaacgcttgatagttgtcgacgtcggtctggtagacggcgaggtcgagcatcgcgcgctcgtcccagaagcgcgttttaatgcccagttccagagacgtggcgcgctccggctcgaaagtaggggcggtgaacgggccaaccacatcgaaattgatgccgccggccttgtacccccgcgacccgctgacatagcccatcacggcatcattgaagcggtagctggcactgagcaaacttgagacgttgtgctcttcaatcgcatcttcacggtaataaccaccgcccagggcgatgccgcgcaacaattgccctcccgcttggaaaaccgcgggcaagccatttagcggggcgaggttgctgacgtcgcgggagatccagccgtctttgcgatcctggctgtagcgcaggccgccggtgagttccagcgcgtcaatcgggcgccaggaaagctggccgaaaatggcccggctgtcgcccctttgctcgccgtcgtaacgttgtcgggcgccttcgagcagcatggccggcacctgctttggatcggtgaagttgatgccgtagagttttttcagcggctccagttgatcgccgacgaaccagggcgcggcgtccttgccgaattcgacgtcgatcttacggtcgagctgctgacgcaaataatagagcccggcgacatagtcgatggacgagccggcggtgccggacaggcgccattcctggctgaactggcggtgacccagctcggtttcggactcggccaccgatagcgcagtgctgtcgccgtcgcgagcggcgcggtagtcccagtcgcggtaggcggtgatgctggtcaagcgcagcgccgcgtcgaggtcccagttcaactccagtgagacaccgctctgcaaggtgcgcggacgccccggcgcgtcaatgcgggtctcgcgcttgtagggggcgggttctgccagcggatagccgaggaacttggcgcgctgacgagtctggtcgctgtagtgattgaccagcagcacgttgccggcctcgttttgctcggcatggtcagcgatcaggcgcgcgctgaagtccgggtttggcgtccacaataattgcccacgcaggccctggctgtcggcgtcgccgaggcgggtgccatcttgcagattgtccactgaaccatcgaccgaactgttgaagacgttcaggcgcccggccaatacgtcgtcctgcagggggccggaaatcgccccgcgatattcccgcaaaccgtgctcgccgtagcgtgcttcaaagttggcctcgggttgaaaggtcggctggcgggtgatgatgttcagtgccccggcggtggtgttcttgccgaacagggtgccctgtggcccgcgcagaatttcgaggcgttcgatgtccatcaattcagtgaaggccatgccctggcgcgcctggtaaacgccgtcgacgtaggtgccaacgctgccttccaggccatcgttgtaggcggtggcgccgaagccgcgcaggccgaacccggcgaaccgcgcatcgtgaccggacaccaccaggccgggcacccgttgttggatgtcctgcagccgatgcaggccggtctcgtccagttgctcgccgtaaagcacgctcatcggaatcggcacgtcttgtggggcttcctcgcggcgtcgggcggtgacggtcgtgtcgtcgagcgtgagggtgctgggcgcctgctgtccggcattcaccgacgcccagggccaagccgcaaggcaaagcaagagcagccgataacccgagcccggcatgctagaactcccgagccattgcgcggcgcactgtatccgtgcaggccagcatcttgacccaagccagcaattctcggctatcgacgggcttgagcagtactgcatcgaataccagattgtctggataatcctgcggccggcgtggcgggaccgcggaatacagcatcaccggcaagtggccccagcgctcgcgtacttgccgcaacagttcccagccgtccatgccgggcatcatctggtcgctgatcagcaggtcgaccgattgtctggccaggcaggccaaggcgtcttcgccgttcgccgccatgctcacgtcaaaaccgtagccggccagcaggtcatacagccactcgctgttctgctcgacgtcatcgaccagcagaacgtgcttgccctggccatcgagcggcgtggcgtagttgtcgacgaggccgagttccatgtcttgttcctcagcgcatctgagccgcaggcgaaaactgaagtggctgccgccttgctcggtggcctggggttcgagccggctgtccatgcgctccagcagttgggtgacgatcgacaagcccagcccgctgccgtcgtagcgctgcgcattgcggccgcggcggaagggttgcagcagttgttcgaactcttgcggatcaacgccaatgccggtgtcgatcacgctgaaacgcaattccacctcatcggcatttgcccccgggtaaccgctcacttcgaaaccgatctggccgttgtgggtgaattttgccgcgttagccagcaggttcatgagaatttgccgaaggcgtttgaagtcggcctcgaccagtggcggcaggtcatcggccagcaccgcttcgaagctgttgccctgacgcgcggcgagaaagccgccttcgtcgacgatctccttgaggaaaccgtacaaataccccggcgcgagggccagttgcatttgctccagctcgccacgggagaattcgagcatctcatcgatcagctccagctgctggcgggcattgcgttcgattgtggctgggtagtcgcggtttggcccggcgtgcaacaggcgcgcgtagtcgataatgcgtaccagcggcgagcgcaggtcgtggctgattcgcgccatcaacgcactgcgagccgcgagggagtcgcgcaattgcgcggtgcgcagtgcaacggtgctttccaggcgttcgtgctcggcctggcgctgttgttcgaggctggacagcgcgtgcttctcgcggtcgcggctgcgggccacttccatgattaaagtgcacaccagcaacgccacgcctgccaacgtggacgataagctgtatttgctttgcgccgactgccagggcagctgttcctgagggaagaaaatccgcatcagcaattggcccagcaagagccctggcaccagccaggccatccagctgtagctcaggcgccggcgccaggccatgaataatgtcgcgagcagcactgcgtagaagctcatcagcgatacttggaccagctgcgcgccctggactgcatcgactttcagccaccagagtcggccgaggatgcagcccgacagcggcacccaatagctccagccaatgatgcggggcaggcgggacacctgcaacaacacgcgcatgtaggccagaaacagaacgaacgagaccgcgctggcgcaggtcagcaactcgcgtgtccagcccagtgcggtgggccaatagaccaggtagccgttcagaatgcaggtgagcaggatgtagctcagcaccgcgcctgcgttcacggtcagcaatcgggagcgcaggatccagccgacgatcaggccgaacggcacgaccagcaggacaatgccgagggtgagtccatcgctcaggtaggtctgttgctgactgcgcagcagcgccggttcggaccacagttgaggttccagcagcatttggaaattgctcgccactcggacgaacaccgtgacgctttcccgcgccgccagcgagaccgggaacgccggctggcgcgcaggtagctggggccattcggccagggggtgagcgcttcccgcatgcatatcactccaacgtccgccggtggactgatagacgcggatgtcctccaggcgcggcgccccaaccaccagcaggcgcgaacaggccgcatcgcttgaattggtgagctgcatttttaaccagaacgcggagcggctatagccttggggcggccagtctggggtcggggtgttgaaacgcgctgcgggcaatccagccacttcgtccaggctcaggctggcctgggtatcctcgaaaacttgcagcgtgggcatcaggtccagctgctcggcctggcaactttgcacaggggcggcgcgcagcaggcctgcggataacaacgcaagcgtcagtaacatgagctgtagaagccgcatcaggtgcgtccggccagctctgcatcctcaaggcccagggtttgccgacgaaactgactgggcgtcatgccgattcgctggcgcaaggcggtggcgaagttgcaggcattgcgaaagcccaccagctcggcgacgtcttgcacgctcatggcgctttcgccgagcagttcctggccgcgacgcagccgggcatcgcgtatataggcgaacacggtcagccccaggtgctcacggaagatcgcggtgagacgtttttcatgggtgccgactttttgggccagccagggcagggagggtatatcgtccagctggttttcaatcaatcgcatcgccgccctcagcacgatttcatcaccttgtggttgcggatcgaccgggccgtcctgaatggccggcggcgctcgccaagtcaattgcaggtgaatcttgatgcgtgccagcacttcttcgggggcgtaggacttggggatgtagtcgaccgcgccgaccgccaacccctcgaggcgctccagtggcgtattggccgacgacagaaacaggatcggagtaagccgggtggccggtgcctcgcgtaatagccggcacaggctgaaaccatccatctgtggcatgtgaacatccagcacgatcagatccgggcgcaggctgagtgcccgttgatagccctgatgggcgtcgctggccagcgaaaggcgccaaggctgggtctttagcagaacgagcgtggcacggatatcttcaggaacatcgtcgatcagcagaatatgcggcaacgcgtcggacaccgccgtcgctgcccgccttgcgtattgtccattgtccattggccacgttctcttatggtgtttcgccaggtcattgcggcgacattgccagcgagccccccggagactcgcagcaggagttcactcaagagttctgcctgccggattgccttgtcgacagtttgcaagataaggcacgttacggacggcgacaaatcgatatagcaatagcggcaggtgaagcgagaactgaagctatcaaatttttactcggcgataaatggtcggcctcgttcgagatggctgcggttgcaaatatctaccatagacactgcggtttgaatcttcagctcccgcaacagccggtttcgaccagggcttagctgccgccatcgtcaacgaacatctggcgatgtccggcttgcctccagcactgatcgcgtcggcaaacagcctcccgacagcacccgctgtgctcaggtcagccggcaacgccaaggctagggccccgcaatggccttgtctggattacttgattgatgtcaaccgcaggcgtcggcctgctctgtatcctgctgaaacccactctgcaggcttgaacctgaatgttggcgcggcggtgttgcttgtgcatccacccggcatgaccgcaaaggtgttggccaagatcgccgacgaagcacggcctgacggttccctcgccgtaagtcaatcgtgtccagctcaaatgagagcgagtaccccatgctctatccgctgtttctgacgttgcatctgtttgccgcgctgattttcatcggcacggtgttcttcgaagtcctgttcctggaaagtattcgtaaacagctgccggtcaaggtcatgctgctggtcgaacagggtatcggccgacgcgcgcgcaccctggttccatgggttttgctggtgttgtttggggccggggcggggatggtctggttgcgctatttgccgacccttgccacaccattggcctcatcgttcggcacattgttgatgttgaagatcgcagtcgccgtcagcgtgctgctgcacttcctggccgccatgtatctgttcagaagtgaccggatgactgctcgatacctgcatttcatccatgccagcctgttctgccacatgatcgtcatcgtgctgctggccaaagggatgttttacttgacctggtgaccaggtttgcccggcggtctgttgcgccaccagcattggcttgcgcttgatacaaatcaagacgcattgatcgccaggccctgacactggtagtgcgcagccagtctcggagacccgtcatgctcaatccatctcacaaccgcggcgagctgaacgttcggtacgatcaaggcgtgctcgatcccgactgccctgttggcactgaaaagttccatgaagggatcggttccctggatttgcttcgcgctttacgtgtcagccgccaaaaatgccgtccgctgtcgctgaacgtgcaactgccggctaacccgaggcctgccttgtgttccccgggcgatgtttcatgcgagcacagggacggtgaaaactaccttcggcgtctgcagcacgagattgacctcgtcagttgtcacctgggcacggggcagcgggtcgagcagtttcatctggggggcggtatacccgcaatcgcccagctcaaaaggctgatgagccatcttcgtggccgattcaaccttctggggcatgagtgcggtgagtacagcattgacgttgacctgcaccacaccgactggtcgaccatgggcgtgctgcgcgaccttggattcaaccatgtcagcattggcgttccggacatcggtgccgacagtgatatgtcggtggactgctaccagaacccggcccccatccattcgcttatcgatgccgcgcgtacctttggttatcgttccatcaatgtggatctggggtatggccgtgcctggcagacgccggaaagcttcgcattgaaattggccacccttatcgaactggagccggaccggctgctggtatttgactactcacggccaccccaacgctatcgggcgatggccggggacgaaatcagagcgctgtgcagcctggatgataaaagcgcgatgcgccagagctgttttgaacagttgctcggcggggggtatcactacatcggcctggggcaatttgtccggcccgacgatgatttggcgatagcgcaggagcgcggccggttacgtcgcaccagtgaaggttttacccgccacgggtattgcgatcaaatcgggttcggtttgggcgccatcagtcagattgacgaactgtacgcgcaaaacaccgaccaattgcaacggtatcagcaatgcctggacatcgatcaattgccgacgagtcgtggctggcggtgcgagccacgcagccagatcaggctcatggtcatggaacgcctggcgtgtgatttggagctggatatccaggccatcgagacgcgttgcggactgatctttcgccagtacttttacgccgcctggcctgtgctggagcaattggccggtgacgggttgattgagctgtctgcgcgtttcatcagtatccttccggccggtcggccgcacgtagatgccatctgcaacctgtttgaaaaggactcgagcggcgcgggacgggaaccctatagcgagtggattgatcatgacaccttcatttgatttcaatcgcgccctggtccaaaaatatgaccgaccggggccgcgctatacctcctacccaaccgcaccgcaatttcatcaggcgttcgccgtcgatgactatcatcgtgccgtcaccgatagcaacctggcgcctgtgcccaagcccctgtcggtgtacattcacattccgttctgcaagagcctttgttactactgtgcctgcaacaaaatcattacgcagaaaacccaccgtgccgtcgaaccaggatgttcggttggatcgagtacatatccattgtttaggtgacggccgctattggttccgcccttacggcgggtcacttttgaaaagcgcaaagtaaccaaacgctcttgccccaccactcggcacctcgcccaggctcggtgtgcccgtaatccgacagggatttggggggccgccgccacgcgccatccatggcgcggggcggctaaaccggcatccctgccggtttaccccccaaatccctgtcgaattccggccagcgtggtttaacggggcgcctaggatcaaaagcaagatcaagagcggctcgcttcgcatcgtggttactgacggtcgcatgtcagagttgtgtagatacccatggttgcagatgggcaaccagccgcattgcgcgcaacggccgcccacagcacgggggtgctcacgcaatctcgacagcagcgcatccggctgatccagccagagcgttcgaaagggcatgtgccggacattgcccaccgagtgctgccaccaataggtgtccgggtgcacttcgccggtattgtcgatattggcgataccgctgcccgaggcattgccgccccaggcgcgaagcatgttttccaggtgcgggtagtgcgcaggcaagcggctcgcggcccattgcagcaagagaatggcgtcggcatcgttgttgccagaagcagatcgaggctttcattaagtacccgatgcttgagcaagacgcgggccatgcctggaggcctttatttatggggatgggaaggcacgggggtaaaaatgaccctggccgatagggtctgaatgaccgcgtcagggttatttttaccctgacctgttcaccgttgcagccgcgcaggcccgcaccggcaataagtcgcctcagggcacggcccttgcactcttgatctgcgacaacggcgactgatcgcctatacccgatgatgcatccggatttacctcggcactggcgactaagtgtcaggtcggcaacaggttagaggagtggcgttatgcaagtgcttgagcggcgtaaagcgatggcgatcccgccgctgttacggctggccttccggccttttttccttgccggctgcctgtttgcggtgttggccattgcgctgtgggtggcagccttcggcggttcgatttcccactggactcccgcaggcggttggctgggctggcatcggcatgaactgctgttcggcttcgggctggcgatcattgcaggttttttgctgacggcggtgcagacctggaccagtcgccccgggctcagcggcaagccgctggctgccctggcgctgttgtggctgtgcgcacgggcggcctggttgctcaatgcgccctggccgctgctcatggtgctggaattggcattcccactggcggtggcgttgctcatggggttgagcctgtggaaggtgcgacagaaacgtaactatccgattgtgatggtgttgctgttgttagccgtggccgatgggttgtcgctttatggcgtacgcgaaggccatgaaggctggcagcgccaaggcgtactggcgggcatctggctggtggcagcgatgatgggcttggtcggcgggcgggtcattccgtttttcacccagcgtggtctcggtcgggtcgagggggttgctccatggccttggctggacggggtgttgttgatcggtgcgccgctggttgcgttgctgtatgcagcgggtccggccctcaaccccaatgtctgggtgggcctgctgtttgcggtgttggcggcggggcatctggtgcgcctggttcgctggcatgatcgggcgctctggcgtgtgccgttgttgtggtcgctgcacctggcctatggctggttggcagtggcgtgcctgggcatggcgctgtggcatttcggcgtgccggtcaacccgagcctggcggtgcattgcctgacgatcggtgccatgggggggttggtgctggcgatgattgcacgggtcagcctggggcataccggtcggccacttgagccgccctcgggcatgaccctggcgttcatcttgctcaatctggcgtgtctcagccgggttgtgttgattgtgttcctgcccttgccggcgctgtggctggccggcctgtgctgggcgctggcgtttgcgttgtacgcctggcgttacgggccgatgctgctgcgcactcgggttgacggtcatccgggttgagccggcgaatgtatggaggtggacagtgatatacccctttttgctggtgacccacttgctcgcggcaatcgccttcattggtacgttgtttttcgaagtggtgatctggcatcacgcccgccagcagttgccggatgcgccacggtcgacggccgatcaggccattgccctgcgctcgcgcaaggtcctgcatggcgtggtggtgctgttgtatggcgccggcatcagtctggcgtggcagtaccggggcgccttgagccagccgctggccagcagtcttggcacgttgttgagcctgaagatcctgttggccctgagcatcatcgggcattatttgctgttggcttattggctgaaaaacgctcggctgagcgctcagcgggcaaactggattcgccgcagcatcctcgggcacatggtgttgatcgtgatcctcgccaaggccatgttttattggcatagctgatcgataaaagtgcccggcagacaaaacccgcggcaaccgatgggctggcgcgggtgggttgcaagcggcaatcgatcagtgcctgggggtcagggcgtttacgaacagcacattgttttccaggtggatgtgttgcatcaggtcgtcgcgaaactccagcagcccgcgatacaaggcacgccaggtgttacaggcatccgctggcggggtgatgttgttggtcagggccagcagttcctccagttggatttcaacggttccccagcctcgctgcatccggcatgccatgtttaatggattgataaataacgattaattattaggtgtggtgatagttaccctgacgctctagggtgaatgccaccatagagggtgatgactaccatgctgcgagaaagcctggccgccgacttgatcgtcgagttgcccaatgccgtacggttccagcgcctggtccagaccctgcgcgaatatttcaacagcggtgccgtgggattgctgcgcctggatgaagacagcctcaggcctgtcgcgacagtggggttggtccacgaagcgttggggcgccgatttgtcatcgctcaacatcctcgactggctgcgatcatggcgtcgcgcgagccgacgtggttcgagccggacagccgcctgccggacccctacgacggcttgctcgacaaccacgtgggagaaccgttgccggtgcatgactgcatgggtgtgagcctttacgtggagggacgcatctggggcgccattaccctcgatgcgttgcatgccggcaccttcgacagccaggcgcgggaggaactcaagcgttgcaccttgcagatcgaagccgccgtgcgcgtcacccgtcttgaacaggaaaaccgcagcttgcgcttgtcccgcagcggccttcaagacgttcgcttgcccgccgatgaaggcgaaatcctcggccagagcgaggcgttgcaccagttgctcaatgagctggatgtactggccgattccgacctgccggtattgctgttgggcgagaccggtgtcggcaaagagttgttcgcccggcgcctgcatcgtttgtcggggcgcagccacaagccgttgatacaggtcaattgcgccgccttgccggaatccttggcagaaagcgagttgttcgggcacgtcaagggcgccttttccggcgccaccagtgaccgcgccggacgtttcgatgcggccaacggcggcacactgtttcttgatgaagtcggtgagttgccgctaagcgtgcaggccaagctgttgcgcgcattgcaaaacggcgagatccagcggctgggggcggataaaccgttgcacgtggatgtacggatcatcgccgcgaccaaccggcacctgcccgacagcatccgcgatggcctgttcagggctgacctgtatcaccggctctcggtgtacccggtgccgattccgcctctgcgcgagcgcggtaacgatgtgctgatgctcgccgggcatttcctcgagctcaatcgggcacggctcggcttgcgcggtttgcgcttgtcgcccgcggccgagcgggccttgctggcctatacctggccgggcaatgtgcgcgagctggaacatgtgatcagtcgcgctgcgttgaagcaactcagccgcggcaccagtcgcgcgctgatcatgacgctggaggcgcaaatcctcgatcttgacagtgcgatgggggcgtcgggaatgcttgtcgagcgctcgctggagctgatgcctgatgcgccgttccaggccttgggcgctgcggtggatgactgtcagcgagaaaaaattcttcacgccctgagtctttctgcccagaattgggcgggcgccgcacggctgctggacgtcgaccccagcaacctgcacaaattggcccggcgtcttggcttgaagtaagccgtggcggcgccgcctgttgatggcgatcaaggtgaggtcagccagtggcttgcacactgggacaaacccccacggagatcaccgttatgccactttccctggctcagatgcgccgtaactacaccctcaacggtctgctggatgaggcagcgccggacgatccactggccatgttccgccaatggctgcagcaagcgcgtgacaccgaatgcgcgcctgtcgaggccaacagcatgatgttggcaacggtcgacggtgacgggcaaccgcactgccgggtcctgctgctcaagggcttgagcgacgatggcttcacgtttttcggcaattaccagagcgacaaaggcctgcaactggccgctaacccgaatgccgccatgacgtttttctggccaggtctggagcgtcaggtgcgcattgaaggccaggtatccaggctcgatccgcaactctcggatgcctacttcgactcccgctcagtagcaagccgcctgggcgcctgggcttcaccgcaaagccagccgctggccagccgggcagcgctggattcgcgtttggccgaaaccatcaagcgtttcgttggccaggccgtgccgcgaccgcagcactggggtggttactgcctgcgcccggcacgcctggagttctggcaggggcgtgccgatcgcctgcatgatcgactcgactaccgtttgcagaacggcgaatggtgtcgccgccgcctggcgccatgagtctgtattcgccctgtggaggtacctcgttggaggaataggccgggcggcgattccggttcaggcttggccaaaccctcatctacgggaaggcttttatatggcccatttggcgcaacgcacctttattcccctgaacatcgccgtgctgaccatcagcgatacacgcacctttgacaccgatacctcggggcagaccctggctggcttgctgcagaccgccggccatgtgctgatcgaccgggcgctggtcaaggacgacatttatcagattcgcgccattgtttcctggtggatcgccgacccccaggttcaagtggtactgatgaccggcggcaccggtttcaccgcgcgcgacaacacgccgcaagcggtcctgccattgctcgacaaacaggttgaaggctttggcgaactgttccgccaggtctccctggcggaaatcggcatgtccagcttgcaatcgcgggccctggctggaatgagcaatggggttctggtgtgttgcgtcccgggttcgccaggtgcatgccggacagcctggaacatgatcctgctgggacagctggacagccgcaccggcccctgcaatttcgccccgcatttgaaaccgcagccgcaacgaggcaatgatgcctgcgagacgcgctcatgaccggtggagtgtgcgacctcggtcatctgatgccggtggacgaggccatccagcgtttgttggatcaggccccgacacctccgttggcgcaaatgatcggccttgatcaagccttgggacgagtgctggcaaccgacattcattccctggtgaacctgccggcctgggacaacagcgccatggacggctatgcgctccgggcagccgacctgccatcccaggggggttacttgcccattggtgggcgaattgctgccggggatcaagccggctcgccgttgctcgcccagcaggtggtgcagattttcaccggcgcgccattgcctgcgggcgccgatacagtggtgccgcaagagcgctgccggatcgacgacgagcgcgtctggttcccgtccgtcagtgcgggcgatcacgtgcgcaaggagggtgaagaggttcgccgtggggacctgttgctcaaggccggcaaacgcctgcgtgcacaagaattgggcttgctggctggcgcaggcgtggcgcgggtcgcggttcatcgaccgttgcaagtgtgcttgctcagcagcggcaatgagctgcgcgagccgggcgataccttggcgcggggtcagatttacaacagcaaccgctattgcctgtctgcgttgctgcgcggctggggcatggaggtgcacgactatggcgtcatggcagatgagttggcggccagccgcgatgccttgagcctggcgtcgtcggagtgcgatttgctgctcagttccggtggtgtatcggtcggcgaggaggaccatctcaaacgggcgattgaggagctgggtagcctggatttctggcggctggccattcagccgggtaaacccctggcctttggcgaagtcgccggcaaaccctgggtcggcatgccgggcaatccttcggcggcactgattaccgcgttggtggtcgtgcggccgtttctgctccgggcgcagggcgtcacggacgtgatgcctgtgccattggccgtaccggccgggttcgactggttgcaacgcaacaaacgccgtcagtacctgcgggccaggctgacgcccggtgccgacggccaattgagcgtggcgctgcaccctcagcaaagctcggcgatgttgaccgctgcgtgctgggccgacgggttggccgtgatcgagtgcgagcagcaagtgttcaagcacgacaccgtgatgttcctgtccttcgccgacctgatgcattgatcgcaattgattgtcgtcaaggccatggctgctggtctggctagactggcagcgcctttctgatcgctgcactaccgatcccgggcgaggggcaagacgcgtttttcatgaggattacccatgcaactggtttgtccggcagggaatctgcctgcgcttaaagcggcggtgcgcgaaggcgcggatgccgtctatgtcggttttcgcgatgacaccaacgcccggcattttgccggcctgaatatggatgacaagcagttcgacgctgcggtcgcccacatccgtcagcaccaacgcaaactctacgtcgcggtgaatacctacccgcaacccaagggctgggaacgctggcagcgggcagtcgaccgggctgccgatttcggcgtggacgcgctgatcgccgccgatcccggggtgctcaactatgccagccagcggcacccgcaactggcgttgcacctgtcggtccagggctcggccacccacgctgcggcgctgcagttttacgcccagcgctacggtatccggcgtgcggtgctgccacgggtgctgtcgttggcgcaggtgcgtcaggtcgccgcctccagcccagtgccgatcgaagtgtttggctttggcagcttgtgcatcatggccgaagggcgttgccacctgtcctcctacatcaccggcgagtcgccgaacctgtgcggtgtctgttcgccggccaaggctgtgcgctggagcgaagacgcccaaggcttgagtgcgcggctcagtgaagtactgattgatcgttacaccccagacgagccggccggttacccaacgttgtgcaagggccgcttcctggtcgacggcaaacgctttcatgcgctggaggagcccaccagcctcgacaccctcgacttactccctgagctgagcgccattggcgtcgaggcggtaaaaatcgaaggtcgccaacgcagcccggcctatgtcgagcaagtcacccgtgtctggcgggccgcactcgatgcccatcgcggctcaccgggcagttttcaggtcaaggcgcaatggcgccaggtgctggctggtttgtccgaaggcagccagaccaccctgggtgcttatcatcgatcgtggcaatgagggacgaaacatgcagctcagccttggaccggtcctgttttactgggacaaagagcaactcagcaacttttacgccgagatgtcggccttgcccctggatgtgatttatctaggggaaaccgtgtgctcgaaacgccgggctttttcactggatcaatggctggggttggggcgcgagttgcaggcctgcagccaggcgcaattggtgatctccagcttgacgctgatcgaagccgcgtccgaactttccagcctgcggcggctctgcgacaacggccagctgctggtggaagccaatgacatgggcgcggtgcagtttctggctgaacgcaagttgccgttcgtgggtggcccggcgctcaacctgtacaacgggcatgcgctggcgcaattgctcgactgcggcatgacccgttgggtaccgccggtggaatgttcagctgcgttgatcagcgatgtgatcgcgcaggtccgcgagcttggccgtgacgtgccggaagtggaaatcttcgcctacgggcatttgcccttggcctattccgcccgctgctttacggcccgcgcggaagatcgaccgaaggacgactgccagttctgttgcatcaactaccccgatggcctggcgctggccagccaggaaggccagccgttgttcacccttaacggcattcaaacgatgtcggcgcaggtgaccaatctgctggccgattattccgggttggtggcctgcggggccgatctgctgcgcctgagtccacgagcccagggcatgagcgaggtgatcgaggcgtaccaacgggttcgcctgggccagacaccgccgctgttcgtcgagggttgcaatggttactggcatggccaggccggcatgctgcgcgttgaggaggtcggcctgtgttgaaccgcaaagcgtggctattgaaaggcgctgatcgcttactgccgctggtacgccgagtaccctttgcggtgcagcgcctggcgctgcagcaggcgctgaatcgctgcctcgccgagccgttgcgcgacggtgaattcgaagtgctgcgcgggcgttggctgtgcctgcgaattgccgatctggggttgtcctggtacctgaccctgggccgcgagggcttgcaaattgcccgtcaggcccaggctcatgtgaccatcagcggcaattggcgagagttcctgctcctggccagtcgccaggaagatccggacacgctgttttttcgacggcgtctggtgattcagggcgataccgagttggggttggcgctgaaaaacctgatcgacagcctggaccctgacgtcttgccggtctggttgtggcgcaatcttgagcgggcgggcaaggggctggcggtgcaatagaggcataggtatctacaccactttgccacgccgctgctccctgacaatttatcgctgtctactgatgcacgcggtccaaatgtgggaggggcggtgcgacgattcgacttgctcccgatggcggcctgacagccgaccagggtcttggatcagaccgagtacatatccattatttaggtaacggccactattggttccgcttttacagcgggtcactttgaaaagcgcaaagtaaccaaacgctcttgccccaccactcggcacctcgcttaggctcggtgtgcccgtaatccgacagggatttggggggccgccgccacgcgccatccatggcgcggggcggctaaaccggcatccctgccggtttaccccccaaatccctgtcgaattccggccagcgtggtttaacggggcgcctaagatcaagatcaaaagcagatcaagagcaaaagcggctcgctacgcatcgtggttaccgtcggctgccacacagttgtgctggtatcgcgcattgatcgcagccaatcgtgcctattggaacgcagccagatccttttcggcgaggatgctgatgttgcgtcgttgcatctggatcagtccgcactcgaccaggcgatgcaaaatccgcgaaaaggtttccggttgaatccccagcttcgacgccaccaggcgtttggatacctgcaagacaatctgtccggtaaccgggtggcgttcctggagcagaaaactgattacccgacggctcgcgctcgccatggtcaaggtgtcgatgtcccgcaggcgcaggtgcagatggacgctcatgctcgccaggatagccaggcagacttttggctggtcttccagcgccttgcggtaatggtggccctcgatactgaccaacacgctgtccttgagggcggtgccgctgaccgggtaaagccgggcctggctgaagagcagggcttcggcgaaggtctggccgggctgaatgatttccaccaggttttcctggccttcaccgttgaggcggtagagtttgatctggccgctgaccagcaggaaaaagcgcttggccggatcgccctggtacatcagcgtggcgtggcacggcaggcgcttgagcatggccaggccgcagacttgctcgaaaacgttctccggcaattggctgaacagatgatgacgacgcagcgtcaagacgatggaagggtgggtcagcatggcgtacctccgctgacggtcattgtagagcgcgcaggggggttgacctatgcctctgccggcctacctccaaggaggcatgcctcagcccgtaatgcgcagatgctccatggcccataccgccgcttcgacccgtgaacgcaagccgagtttgtgcagcaggttcttgacgtggaccttgaccgttccttcggtgatgcccagcttgtgtccgataaccttgttgctgtagccgctggcgatggtcttcaacacctggcgttcacgctcggtcagttctaccaccgcttgacgcggcggtgagcgcaacgcctgggccatgacctgcgtcaggccagggctgatgaccaatgcgccgtcgagggcatcgcggatgtactggatcagcagctcgggctccatgtccttgagcaggtaaccgtcggcatccaggcgcagcgcatcgcgaatgtcgtcttcggcatccgacacggtaaacagcagtaccttgccggtgtaatgcatggcccgtaatcggcgcagggtctcaatgccattcatctgcggcatgttgttgtcgagtagtaccaggtccggttgcagtggctcgatcagggtgagtgcttcttcgccatggttggcttcgccgacgatcaggaaatcatcttcgagttcaagcatctggcgaatgccgtgacgcatcattggatgatcgtctaccagcaggattctatggtggggggacggggtcatgcgacgctaccttctgtttgccgttcgagaaactcgggatgaaactccagttggacgcgggtcccttgcggcgtcctggaaaatatctgcaactggccgcgcaggctgcgcgcacgttcatccatgatgttcaggccgtggtgttcgcgttggtcgacagtgccgctgaagccgcgcccgtcatcttcgaccgagagcctgacggtttcgccgtcctggcgcagttgcagccagacgttttgcgcatgggcatggcgcagacagttggaaagcgcctcgcgggtgatctgcaagatgtggatttgctcgctggcgcagagctggaaggccagcgcatcgacgtgcaggtggaccttgaactcgccgcgatgggagaactcctcggcggtgtccttgagctcctgcaccaggcctgcatcattgatctgcaaacgaaaagtggtcagcagttcgcgtagctggcggtaggcattgttcaggccctcgcgcaactcagcggtgacggtttccagggtttcgaccggttcgccgcggcgcatcagggtttgcatgcggctgacttgcagcttcatgtaggacagggcctgcgccagtgaatcgtgcaattcgcgggcgatgatcgtgcgctcttcaagtagcagcaggcgatggtcctgttcccgttggcgtttgagcgaaagcgaggtgccaatcaggttggcgagggcctggatcagttgggtttcccaggcttgcgcgcagtggccgtcgacaaagtgggccttgagctcgcccagttcgctgccctggttgctgatgctgaaggtttgcgggctggttttgtggtgtttctggcacgtggcgcaatcgctgctggcgcagacatcccgactgttggcaccgtgcagggcgagtaattgctgggccggtgcctgcaagtgtccttgcaggcacaacgacaggcgcaagccgggcaggcgttgctggaagcgccggatcaactcgtccagcccctcggcattggccaggcgcgtggccaggcttcggctgctttgatagagcagttccagcgccgcgttggcttgctgcaggttcaaggttttttgctggacctggctttcaagcgtgcgatgcgactcctcgatcgtctcggccatggcgttgaaactggtggccaactggcccagttcgtcatgggactgatggttgacccgcacctggaactcgccgcgacgaaagcgctgagtggcggccaccaactcttgcagcggcgagacgacgccatactgcagttcgtagagcccgagcagcaagacgatcagcgtggtgaacaaggccaggccttgaatgacctgttgccagccttgcttttgctcgctctggcgctgcagcaggctgacgaactggttcagttgttcgacgaagggcagggccatggcctgaaaagcatttgcatcgctacgttgaagtgccgggtgcaaatcatccttccagcgttgctggatctgcccatagctggtttgcaaatcggtggtcgggccatcttccagcaccgctttgagggaatggctattgaggcgggtttgcaggctgtcggtgatggcagcgatttcttcgcggggagcgccagcggccagtttccagctcaggtggtaagtctccatgcgcaccgagccagcggtattgatggcggcggcatcgccttggctgaaccaggcgatcaatccggcgctcaacgagctggccagggcgaggatggcgatgaggatcaccgccagcccggcgcgagcgggcagggagctgcgcaaccagcgcatcatcagcgctgaccctgggcaaagccacgaaaactgagcatacggcgtcccggaacacggttttgcatcccgtcccgggtgcgctacctctaaagagttgccgaccgctccctgtcagtaaaggtggggctggaaaaccttaagaggctgataaataaaggctttccaggtgtccatgctctacctccttagaggtagacaggctaagcataggcctatgcccccttgggcttcgttgacatgggtcaagtttttgcagggttggcgtctctagtctgccggcatggttagctgactggagaacattgtgacccaaccccgtgtacgacaaggcttggtgcttggcatgagcacactggccttcaccgtgtgttttatggtctggatgatgttcgccgtgctcggcgtgccgatcaaggaactgctccagctcaacgaaacgcaatttggcctgctggccgccaccccggtgctgaccggctcactggcgcgtctgcccctgggcctgctgaccgaccgctttggtgggcgcagcgtgttcctggtgctgatgctgacctgcgtcgcaccgttgtacctgatcagccacgccactgcttactggcagttcctggtgctgggcctgttcgtcggcctggccggcggctcgttttcggtggggattgcctacgtcgccaaatggttcgacaaagagaaccagggctttgcgatgggcatctttggcgccggcaacgcgggggctgcggtgaccaagtttctcgcgccggccctgatcgccgcgggtagctggcaactggtaccgaaagtctttagcgccatcctctttgtcacggcgttgctgttctggtttctcagtgcagaaaacaaggaccatcgcagtgcgaccggcgccagtttgcgtgagcaattgagcgccctgaaagaccctgcggtgtggcgctactgccagtactactcgatcgtcttcggcggctatgtggccctcgcattatggatgacccaatactacgtgcgcgaatacggtttcagcctgcaaagcgccgcgttgctggccgcctgtttctccctgcctggcggtgtattgcgtgccgtcggcggctggatgtcggatcgctggggcgcgcaaagcgtgacctggtgggtgttgtgggtcagttggatctgcctgttcctgctttcgtacccacagacccagttgcaagtgcagtcgatcaacggcccggtcagtttccacatcggcctcacacccacgctgttcaccgtgctgctgtttgtcatgggcatcgccttcgcatttggcaaggcctcggtcttcaaatacatcgccaatgactacccgcaaaacatgggcgcggtgtcgggcattgtcggcctcgcgggcggcctgggcggctttgtgttgccgatcctgttcggcgccctggtggacctcaccggcgtgcgctcttcctgcttcatgttgatgtacggcgtggtctgggtctccctcacctggatgtacttcagcgaaatacgcaagcgcccgctgctgggcaaacagccgccagcgacgtcgtccccgttttccagcattgcccaaggagaagaacatgtccgttctgcaaaagcctgacaaaggcccggtcatccatgactggcgccccgaagaccctgcgttctggggaagcagcggcaaacagaccgccacccgcaacctgtggatctccattcctgcactgctgctggcctttgcggtgtggatggtctggagcacggtgatcgtgcggttgaacgccatcgggttcagcttcaccaccgaccagttgttctggctggcggcattgccgggattgtccggggcgaccctgcgcgtcttctattcgttcatggtgccgatcttcgggggccggcgctggaccgccgtgagcaccgcgtcactgctgttgccgtcgatctggatgggcttggcggtgcaagacccgagcacctcgtacagcgtgttcgtgttgatcgcgttgctctgcggctttggtggcggcaactttgcctcgagcatgtccaacatcagcttcttctatcccaagtctcagcagggtacagcccttggtctcaacgccgggctcggcaacctgggtgtttcggtgatgcagttctgcgtgccgctggtgattacttttggcgtgttcggtttcctgggcggccagccgcaagtgctgcaggacggcgctcagttgtggttgcagaacgccgggttcatttgggtgccattcattgtgttggtgacagtgttggcctggtttggcatgaatgacttgtccagtgcccgcgcctcgttcagcgagcaggcggtgatcttcaagcgcaagcacaactggttgatgtgctggttgtacctggcgaccttcggttcgttcatcggcttctccgcggcgtttccgctgctgatcaagacctcctttccggacgtcatcgccttgaaattcgcgttcctcggcccgctggtcggcgcattggttcgtccgttgggcggctggctggcggacaagctcggcggcgcgaaagtaaccctgtggaacttcgtgctgatgatcgtgatggtcttcggtgtactgcactttttgccccaggacggatcgggcggcaacttctacggtttcctcggcatgttcatgctgctgttcatcaccaccggcgtgggcaacggctccaccttccggatgatcccggtgatcttccgcaccctgcatgaaagatccgctgctggaaaacccgccgccgtgcgcgaacaagcgctcaaggatgccggtaaggaatcggccgccgtcctgggtttcagttcggccatgggcgcctttggtgcgttcttcattcccaaatccttcggcacttcgatggcccagaccggcggcccggagatggccttctacatgttcgtcggcttttacctgagctgcatcctggtgacctggtggtggtacgcgcgcaaaggcgccgcgacaccctgctgagtcgagcccgaatccaaccattgcgtgggcggggcacagaaccccgcagcaagcctgagaggtgtacaccgtgagtcatttactggaccaattgcggtttttcaatcgcaagcaaaacgagttttccgacggtcatggagagacccgcaaagagtctcgcgactgggaaaacgtctaccgttcccgctggcagtacgacaagatcgtgcgctccacccacggggtgaactgcaccgggtcctgctcgtggaaaatctacgtcaagaacggcttgatcacctgggaaacccaacagaccgactacccgcgcacccgcaacgatctgcctaaccatgaaccccgtggttgcccgcgtggcgccagttatagctggtacatctacagcgcgaaccggctcaagtacccgaaaatccgcaagccgttgctgaaactgtggcgcgatgcgcgccagaccctggcgccggtcgaagcctgggcgagcatcgtcgaggacaaggccaaggccgagtcctataaaagcaagcgcggcatgggtggcttcattcgttccaactgggaagaagtcaacgagatcatcgcggcggccaacgtctacaccatcaagcaatatgggcccgaccgcattgtcggcttctcgccgatcccggccatgtcgatggtcagctacgccgccggctcgcgttacctgtcgctgatcggcggcgcatgcctgagcttctatgactggtactgcgacttgccgccggcttcgccgatggtctggggcgagcagaccgacgtgccggaatcggccgactggtacaactccaactacatcattgcctggggctccaacgtccctcagacccggaccccggacgcgcacttctttaccgaagtgcgttacaagggcaccaagacggtcgccattacccccgactattcggaagtcgccaagctcaccgatctgtggctgaaccccaaacaaggcaccgatgcggcactggcgcaggcgttcaaccatgtcatcttcaaagaattccacctggacaaaccgagcgcctatttcaccgaatacgccaagcgcttcaccgatttgccggtgctggtgctgctcaagcaaatggtcgacaaggcaccgggtgcaggctatcagccggaccgtttcctgcgcgccagtgacctgaccgacaacctcggccaggaaaacaacccggaatggaaaaccatcgccctcgacgtcgacggtgaactggtgtcccctcaggggtccatcggttatcgctggggagagaagggcaagtggaacattcttgcccgtgaaggtggcgaaggtcgcgagatcgatctgaaactgagcctgatgggcgatgacgtcgccgaagtggcgttcccatattttgccggtgagtcccacgaacacttccagcacgtcgccggcgatgccgtgcaataccgccgggtgccggtgcataacgtggtgctggccgatggtagcgtcgctaaagtggccaccgtgttcgacctgtcggcggccaacctggcgattgatcgtggcctgggcggcgaaaacgtcgccaaggattatgacgacgcctcggtgcccggcaccccggcctggcaggagaaaatcaccggcgtgagccgcgaaaaagccatccagatcgctcgtgagtttgccgataacgccgacaagaccaagggccgctcgatgattatcgtcggcgcggcgatgaatcactggtaccacatggacatgaactaccgcgggctgatcaacatgctcatgctctgcgggtgtgtcggccagaccggtggcggttgggcgcactacgtcggccaggaaaaactgcgcccacaatgcggttggctgcccctggcgttcggcctggactggaaccgtccaccgcggcaaatgaacggcaccagctttttctacgcccacagctcgcaatggcgccacgagaaaatgagcatgcacgacgtgctctcgccgttggccgataaatcccaatttcccgaacatgccctggactacaacatccgcgccgaacgggccggctggctgcccagcgcgccgcaactcaataccaacccgctgcacatctgccgcgatgcggccgccgccggcatggacccgaaagactatgtggtcaagtcgttgcaggacggttcgttgcgcttctcctgcgagcagccggacagcccggtgaacttcccgcgcaacatgtttatctggcgttccaacctgctgggctcctcgggcaagggccacgagtacatgctcaagtacctgctcggcaccaagaacggcgtgatgaacgaagacatcggccaggtcggcgactgcaaacccgaagaagccgaatgggtcgacgagggcgccatcggcaagctcgacctggtgaccacgctggactttcgcatgtcctcgacctgcgtgtattccgacatcgtcttgccgaccgcgacctggtacgaaaaagacgacatgaacacctcggacatgcacccgttcattcaccccttgtcggccgccatcgaccccgcgtgggagtcgcgttccgactgggagatctacaagggcattgccaaggcgttttccagcatgtccgaagggcacctgggcgtcgaacaggacctggtgaccctgccactgatgcacgacagcgttggcgaactggctcagccgtttggcggcaccgactggaaaagtgacggagtggcgccagtgccggggaaaaacgcaccgaacctgcatgtggtcgagcgtgattatccgaacatctacaagcagttctcgtccctggggccattgctggaaaaacacggcaacggcggcaagggcatcaactggaacaccgaagacgaagtgaaattcctcggtgaactgaaccaccacgaaggcgatgccggcatcagccacggtcggccgaaaatcgacacggctatcgacgccgctgaggtgatcctgtccctggcgccggaaaccaacggccaggttgccgtgaaagcctgggccgcgctgtcggaattcaccggcatcgaccacagccacctggcgctgtccaaggcccacgaggcgattcgtttccgcgacatccaggcccagccgcgcaagatcatttccagcccgacctggtcggggctcgaagacgatcacgtcagctacaacgccggctacaccaacgtgcacgaggcgatcccatggcgcaccatcaccggccgccagcagttctaccaggatcacccgtggatgcaggcgttcggcgaacagctgatgagttatcgcccaccggtcaacacccgcaccattgaaggggtgaagggcaagcgcagcaatggcgagatcgagatcgtcctgaactggatcaccccgcaccagaaatggggtatccacagtacctacagcgacaacctgctgatgctgaccctaagccgtggcgggccgattgtctggctctcggagaatgatgcgaaaagcgccggtattgaagacaacgactggatcgagtgtttcaacgtcaacggtgcgctgaccgcccgtgcggtggtcagccagcgggtcaaggacggcatggtgatgatgtaccacgcccaggaacgaatcgtgaacgtgcccggttccgaaaccaccaagacccgtggcggccaccataactcggtgacccgcgtcgtgctcaagccgacccacatgatcggtggctatgcccagcaagcctacggtttcaactattacggcaccgtcggctgcaaccgcgatgagtttgtcgtggtgcgcaaaatgtccaaagtcgactggctcgatggttcgtccggtgatgacctgccgcgtccgctgccgaccgatatcgaggagaactgagatgaagattcgctcacaaatcggcatggttctgaacctggacaaatgcatcggttgccacacgtgttcgatcacctgcaaaaacgtctggaccagccgcgaaggcatggaatacgcctggttcaacaacgttgaatcgaagccgggcatcggctatccgaaggaatgggaaaaccaggacaagtggaagggcggctggattcgcaacgccaacggcacgatcaacccacgcatcggcggtaaatttcgcgtattggcgaacatttttgccaacccggacctgccgagcctcgacgactactacgagccgttcgacttcgactaccagcacctgcacaccgctccgctgggtgagcaccagcccaccgcgcgcccgcgttcgctgatctccggcaaacgcatggaaaaaatcgaatggggcccgaactgggaagaaatcctcggtaccgaattcgccaagcgtcgcaaggacaagaactttgacaagatccaggcggacatctacggcgagtacgaaaacaccttcatgatgtatctgccgcgcctgtgcgagcactgcctcaacccgacctgcgcggcgtcgtgccccagcggggcgatctacaagcgcgaagaggacggcatcgtcctgatcgaccaggaaaaatgccgtggctggcggatgtgcatcagtggctgcccgtacaagaagatctacttcaactggaaaagcggcaaatccgagaaatgcatcttctgctacccgcgtatcgaagccgggatgccgacggtttgcgccgaaacctgtgtcggccgtatccgctacctcggggtgctgctgtatgacgccgaccgtatcagcgaagtcgccagcaccgccgacgagcaggacctgtacgaaaaacaactggagatcttcctcgatccgaacgatccagcagtcatccgccaggccttggccgatggtgttccgcagtcggtgatcgactcggcacaacgctcgccggtctacaagatggccgtggactggaagctcgcgctgccgctgcacccggaataccgcaccttgccgatggtttggtatgtgccgccgctctcgccgatccagaacgcctccaccgccggcaccgtgggcatgaacggggtgatcccggatgtggacagcctgcgcattcccctcaagtacctggccaacctgctgacggcgggcgatgaaaaaccggtcaagcgtgcgctcaaacgcttgctggcgatgcgcgcctacaaacgttccgagcaagtcgatggcgtgcaggacttgcaagtgctggcggatgtcggcttgagcgtggcccaggtcgaagagatgtatcgctacctggcgattgccaactatgaagaccgcttcgtggtaccgagtgcgcaccgtgaagacgccatgagcgacgccttcgccgagcgctccggttgcggcttcagtttcggcagcggttgcagcggcagttccgacaccaacctgtttggggcgaagaaagccaaccgccgcgacatcctcaaaaccgtgcaggtgtgggagcaatgagcatgcaaattctcaaagtgatttcgctgctgctcgactacccgaccgaggcactgacgggcggtcgcgacgaactggaacaagcaattgtccagtcccgggaaatcagcccgacgcaacgtggcgcattgttcgagttgctggaactgatctgcgccaatgacctgatggacgggcaggagcactacggtgcgctgttcggccgcgggcgctcgctgtcgctgctgttgtttgagcacgtgcacggtgagtcccgtgaccgtggccaggcgatggtcgacatgatggcccagtacgaagccgccggttttgccattggcgtcaaggagctgccggactatatcccgctgtacctggagttcctctcgacccgcgaagacattgaggcccgcgaaggcctggcggatgtggcgcatttgctggccttgctggcggcgcgcctggaggagcgtgaaagcgcttacgccagttgcttccgggcgttgctgcagatcgccggggccgagccccatcaagcggtggctgacctgcgcgaacaggtcgccgcagaaccgcgcgatgactccctcgaagccctcgacaagatctgggaagaagaggccgtggactttctgcaggccgaacagcaggaccgttgcagttcgctgccaagcgcgccgggcaaggcccgggaagaaagcgcggtgccgctgcactgggtcgattttcagcatgaagggctggccgctgtgccagccaaggaggtgggtaatgtctaaatggaatcttttgctgttcggggtttacccttatgtggccctggcgatttgcctgcttggcagttgggcacgcttcgatctgtcgcagtacacctggaaggccggctccagccagatgctcaaccagcgtggcatgcgcgtggcgagtaactttttccatatcggcgtgttgttcgtgctggccgggcacttcgtcggcctgctgacgccggcatcggtctaccaccatgtgatcagcacgcagaacaagcagttactggcgatggtttccggtggggtcttcggcctgttatgcctggtggggttgctgatgctgatcaagcggcggctgaccgacccacgggttcgcgccacttccagcccgtcggacatcttggtcctgctggtgctgctcgcgcaattgctgctcggcctgctgacgatcgtcgcgtccaccgaccacatggacggctcggtgatggtgatgctcgccgactgggcgcagaacactgtgctgctgcggccaatggaagcggcggcgtctatcgcacccgtcgggctgacctacaagctgcatgtgtttctcggcttgaccttgttcgtgctgtttcccttcacccgtctcgtacacatgatcagcgcaccgatctggtacttggggcgtcgctatcaaatcgttcggcagaaattctgaggagacaatcatgtcaggtggatgtggatgtggcggcggtaacgggggcagcggtggctgcggttcttcaaaaaaactcgaggccgatgtagtagatatcgcgccgaccggtgtggtgcaggttgatgagctgccggttgcgccagcagccgatgacaccccggcgcagttgatcgccagcagcgagcaggagtggccgatcatcagcgtcaatgaggtgtcgatcaccccacaggcgctggcccaggagttgcaatatcacccggcgccaacccgcgaggaggcggtctaccaggccgctcgagcgctggtgatccgtgagttgttgcagcaacgcattgccgaactcggtgtgtcgctgcagatcggcgccggtgagaacgaagaagaagcagccacgcgcttgttgcttgagcgtgaggtgcatgtgccgcagtgcgacgaagaaaccagcctgcgttattacgaaaataaccgcgggcgctttcacagcgcgccgttgctggccgtgcggcacatcctgcttgaatgtgcgccggacgatgtcgaggcccgtgcacttgcgcatgcccaggctgaaatcctgctgcaacggctggcggacctccccggcagttttgccgagctggcggtgaagtattcggcctgcccgtcgaaggctcagggcggctccttagggcagatcagcaagggccagaccgtgcccgaactggaacgccagctgttcaccctggcaccggggctggccagtaaacctttggaaagccgttacggctggcacgtggtcagtgtcgatcagcggatcgaaggcatgccgttgccctacgaagtggtgtcgacggcgatccgcacgcagttgcagcaaggcgtctggcaaaaagccctggtgcaatacctgcaaaccctgatcggtgcggcggatattcgcggcatccatttgcagggtgccgactcgccgctggtgcagtgagccttgggggcaacgggagaagtgatgaacgcggtcatgcaggatggttttggacggcagattgactatctgcgaatgtcggtgacggaccgttgtgattttcgctgtgtgtattgcatggcgaaaaacatgacgttcctgccgcgtcagcaggtcctgacgctggaggagttgcagcgtctggcgacgctgttcgtcggcctcggtgtacgcaagattcgcctgaccggtggtgagccgctgatccgtcccggcattgtcgatttatgccgcaatatcgccgcgttgccgggtttgcgggaactggtgatgaccagcaacggctcgcaactcggccggttggcccggccgttggcggaggcgggcgtcaagcgcatgaacatcagcctcgatagcctggacgcgcagaaatttcgcgcgatcacccgcaacggcgatctcgaccaagtgctgggcggcattgaagcggcgcgcggcgcggggtttgagcgggtcaagctcaactgcgtggtgatgaaggggcgcaacttcgatgaagtgctggggctggtgcagtacgccatccggcaacgcatcgacatcagtttcatcgaagaaatgcccttgggcgacgtagggcgctcacggggcgaagcgttttgctccagcgatgaggtgcgaacgctgatcgccagccggcaccggttgctcgacagcgccgaaaacagtggggggccggcgcgttacgtgcgcctggagagccatcccgatactcgcatcggcttcatctcacccaacagtcacaacttttgtggcagttgcaaccgggtacggatgaccgttgaggggaagctgttgctgtgcctggggcaggacgacgcgctggatttgcgtggcttgctgcgccgctatccgctggacgatcaaccgctgatcgacgccgtgcacaaagccctgcacggcaagccattgcgccacgacttcaaccctggcggcgaggtgcaagtagtgcgctttatgaacatgagtggcggctgaacgggatacgccgagccaccgtggaccctcgttggccatgtatttgtcatcggtcctgggggcgtttttttgcctcacaatcttgatattgatcaattgcaaaagcacctattgcccgtagtcttcactgcatattgtgttttttgtttattaaatacctatatgtagtgtttggaggcttaatgcagagcacgctggtttcagtgggatttacccgtttgcacaagcgcgacggcaacctggtcgccttcgatgcggacaaaatccgtcaggcattgatcgcggcgggcaaggccaccggggaatataccgaggtagaagccgaaggattgctgcaggcggtactggcccggctggaaggcttgtccaggctgcatgtcgagcaaatccaggaccgcgttgaaagggtgctgatggacgccggttatttcctttccatgcgggcctacatcgtctatcgcgaacaacacgggcgtttgcgccgtgaccggcggaccctggtcgaagtggcggcgtcgatgaacgaatacctggaccgtgaagactggcgggtccaggccaatgccaatcagggctactccctgggtgggctggtgctgaatgtatcgggtaaggtcactgccaactactggctggacgaggtgtacagcgaagccattggccaggcacatcgcgaggctgatctgcatgtgcacgacctggacatgctggccggatattgcgccggctggtcgctgcggaccttgttgcacgaggggctcaacggcgtgccagggcgtgtcgaagccgggccgccaaagcacttgagcagtgccctggggcagatggtgaattttctcggcacgctgcaaaacgaatgggccggcgcccaggctttcagctcgttcgatacctacctggcgccgtacctgcgtaaggatcaattgagctatgcgcaggttcgccaggcgatccaggaattcatctacaacctcaacgtaccgtcgcgctggggcacccagaccccgttcaccaatctgaccttcgactgggtgtgcccgcaggatctacgcgagcagatccctgtcatcggtggtgaggaaatgccgtttgcctacggcgacctgcaagttgaaatggatatgctcaaccgtgcctacatcgaggtgatgcaggccggtgatgcaaaagggcgggtatttaccttcccgatcccgacctacaacattacccatgactttccgtgggacagcgagaacgctgatcgcctgttcgaaatgacggcccgttatggcctgccgtatttccagaacttcctcaattccgatctgcaacccaaccaggtgcggtccatgtgctgcaggttgcagctggatgtacgcgaattgctcaagcgcggcggcggtttgtttggctcggcggaacagaccggatcgctgggcgtggtaaccatcaactgcgcgcgcctgggttatgtattcaagggcgacaccagcggtctgctcaagcggctggactcgctgatggaattggcgatggagagcctggaagtcaaacgcaaggtcatccagcaccatatggatgccggtttgtacccttacaccaagcgttacctgggtaccttgcgcaaccatttctccaccatcggcctcaatggcctgcatgaaatgctgcgcaacttcaccgctgacaaagagggcacgcacaccgaacagggccgccagttcgccctgaagctgctggaccatgtgcgcgccacgttgctgcgtttccaggaagaaaccgggcacctctacaacctggaagcgaccccggcggaaggcactacctatcgtttcgccaaggaagacctcaagcgttaccccgacatcctccaggccggctcgctgcaagcgccgtattacaccaactcctcgcaactgccggtgggctacaccgacgacccctttgaagccctgcaactgcaagacgaactgcaatgcaaatacaccgggggcacggtcttgcatctgtacatggccgagcggatttcctcgacccaagcctgcaagcaactggtgcgcaaagccctcggacgcttccgcctgccgtacctgaccgtgaccccgacgttctccatctgcccggtgcacggttacctcgatggcgagcacgagttctgtcccaaatgtgacgaggttctgctgttgaaagaacagcaacccggcaccgctcattgatttcgattcactcaatcgcaaggagcttcaccatgactgcatcgcaaacactgccccaggctcaacgtcaacgctgcgaagtctggactcgggtaatgggttatcaccgtccggtatcggcgttcaatccgggcaaacaatccgagcaccgcgagcggatgcacttcactgaaagcgcggcgctggccgctcgccaatgagtcgaacgctgcgggttgggggcatggtgcccctgaccaccatcgactatccagggctgctcgcctgtgtgttgttttgccaggggtgcgcctggcgttgtcgttactgccataacccgcagttgatcccgcctcgcggcaccgacgaagtcgattggcggcgggtattggcgttcctgcaacgccggcaggacctgctcgatgcggtggtgttcagcggcggtgagccaaccttgcaagagggtttactgggcgccatggacgaagtgcgggcgatgggctttcgcatcggtcttcacagtgccggcatcaagccaacagcctttgccagggcgctgaccggtgccgattgggtcggtttcgatgtcaaggccttgcccgaggattgccaggcaatcactcgggtccaaggcagtggagcggcgaactggcgtagccttgagcatcttctggccagcggtgtggactacgaatgccgtaccaccgtgcattggcatctgttcaagccggcaggtctgttgaccctggcgcagcgcttgggtgaactgggggtcaaacgctttgccgtgcaactggtacgcaccgagcagatgtttgatcctcagctgccgagtgtgctggcacctgccttgcttacggatctttgggcggccatgcgcgagttgtttccagcgttcgttttgcgggggtaatcgaggctacggataaaacctttattcgaggttgatagcttgatatccgtcaaggatggcttcgcacggaagctgtaggttgtaaaaacgcctctcaatgattggagatcggcatggccaagcacttccccgtcaaccccagccaccccgaacgaatctgttgggggtgcgaccgctattgcccggccaagtcattggcgtgcggcaatggctccgagcgtacgatgcacccagccgaactgtttggtgaagattggtgcgtgcccggtgactggggaatcgagcgacctatcgtcaccgacaaggcggcggatgaacgccagtcgtaggtcaccgctctcggcaaccctcggaccgcaggcttttttacgatggtctcagcttgcttttcatctgcagggcaagtatgccgatggccaccaacgcagcacctacgcccgcaatcggtataaaggcgagcccgaaacgggtaatgatccagcctgcgccgatgccacccaatgcggttcctaagttgaacgaagcaatattgagtcctgaagccacgctactggattgcggaacatagtggtgtgccaggcgcagcaggcgcagggttgacatggtcactatggcgaagaacaccacacccaataaccccaccagcattaacgtggcgatcagcgaatcgccccacacgtacaagctcaacaggttaagcatcaacgccgtcaacccaccgagcaaacatcgatcggcgtcgaaggcatcgacgagatagccgccaagcaaattgccgagaatggagcagacaccgaacaccagcattgccaggctcaggatctgcggctgcacacgggtgatatccagcaggaacggcgacacgaaggtaaagaatgaaaaagtcgccacgctcaccagcatcgcgatcgtggccgccaccaacagttcgcggtgcaatagggccgcgaggctttgtttcaggtctgtggcttggtgagtcgagcaaagggggcgctgacgcatcagaagcgccaggccagcggtgctgatgagtcccaggccaccgatggccaggaacactatgcgccatgaccagtagctgccgaggaaggtgccgataggcacgccaaaggcgatcgaaagggtcagtcccatccacaccagcgatagcgctcgccctgcgcgcagcgggtcgaccagtttgaccgcggcgttggaggccacggccatgaataccccatgggccaggccgataatgaaacgtacgccatgcagggtcagaatatcaggcgccaggctgatgaccacgctgccagcggcaagcacgccgagggtcagcagcagtacggttttgtcgcgccaattggccaacagggccgtgatgatcggggcgccaatggcggcgcccaaggcataggccgcgatggctgagccgacgtgcgagatggactcatgcagatccaccgatatggccgacaccaggccggccacgacgaactcggacaagccgaatgtaaaagtgcagagcgaaaaaatgtagatgacggctggcattcagcgtctccttgtcggtgcatgaatcggggatcctgccggtgcgagtgcactaagttggcgtcgtcatgaaccgactgccatggtggtgcccggaactcgttcttgcaaaagtggcggtgatagtgcggtgctgacagggagatgagaaatactataaaagtctctgtttaagactattggcgggcattagtcacgtgttgatgacaggagtatcaatcccgggtgaacggtttggttagttgtaatacgtagcagggtggtgtatcgcggggaggggggcacgaatataactaactaagatcctccccctcaacctgggaaacggcattgaaatcgagcatggaaatgaaactgtccatcaacggtgattcgttgtgggtgttccagctcatgtacaggccgattgccgggttgggggaggtggtcacgggggtgatcctgcggaacaggaccttgtcgcgcatgattgagttggcaatcgactcaggtaccagggcgacgccgaaaccacaggccaccaggccgatcagggtatggatctgtgcggcctcctgcacgaccttggggtaaaaaccagcggcttcacacaaggcgataagctgactgtgataaccggtacccagggcttctggggtgaatacgaagtcttccccggcaaaatccctcaagtcgatctgaccttccttggccttggggtgatgggcgggcagcgccatcacgatctcttcatccagtaacaggcgtgactcgacgttttctgccgagatcggcaacttgcgcatgaaggcaatatccgcttctcccgacagaatggccttggcctggctggaagagggcatctccttgatgatcaactggactttggggtaggtctcgcggaactggcgcagggtactgagcagtgactcgtagtaggcgatcgacaccgcagtcaccgtgagtttgccggcaatcccctcggacacctggcgggcatgttctatgcccagctccaactccttcaaggtgctgtaggccgcgctcaggaatgcgccgccggccggggtcagcttgaccccgcgtttattgcgggtgaacagactgaaccccagtttgtcttccaggcgctggatcgcctggctcaatggcggctgggccatgtgcaggcgaatggcggccttgtggaaatgcaactcttcagccacggcgataaattggcgcagcaggcgggtttcgatcatttcttctgttccttcatttgaactgatcagtggactggggctgcaatggtacctcatcaaggattacacggatttcacatcaacttgatatgcgccgagtatcaacttgcgccgccgttagtattaaacagcgtagatagaccttgttaaggtgagggggcactcgagaggaaacagccaatgaactttacaggaaagactgccgttgtaaccggcgctggccgggggttgggttttagttacgcgcaagcgttagcctcgctggacgccaatgtggtgatcagtgatatcggcgcggataagctcggcgcagggggcgatggctccatcgccatgcaggcggcaaaaaacctcagtgaccagggtttcaacgtgatagggcaccaaggtgacctgtccagcgaacaaggttgcgagcaactggtggcaaccgccatcgaggcgtatggccaactcgatattttgattcacaacgccggttgggtcggctaccaatctattgaagaggctgatgccactttcataggccgtgcggtggatatcaatatctatacccccgtgtggctatgcaaacatgcctggaaatacctcaaacagtctagtgccgcgcgggtcgtgctgacgtcatccgaccgtgcgatgtaccagcaatatgcccaaccgggcctggtggcgtatgccgccggcaagatggcacaactgggtatcatgaatgcgctgagcatggaaggcgcgcaagcaggcatcctggtcaatgcggtatccccagtagccaagacccgcatgtggggcgtgacgggcgaaccggagaacctcaagcctgaatgggtcacgcctggcgtggtgttcctggcgtcgcagcattgccaggactccgcttatgtgttgcgcgccagcaatggtcagtttacggcgacgcggtttgttgaaaacccaggcgtcgactaccccgtcgacctggcccgagtgaaggccaccagcgccgaacaagttgcccagctttgggatcaaatcaaggcgtgttgaatatgtctgctcaggaagagctccatctgtattcaccgtgccaggccgatctgggtgaaagcccggcctgggatgacatccatcgctgtaaacgcggaaccctaagttgccgctaccgcagcaatggatatgtactgggtgtgatccaagatcccggtcggctgtcaggccgccatcgggggcaagccccctcccacatttgactgaggtgtgtcacgtagatgcctgtcaattataaggccgtcaggggagcaagctccctcgccacaggcccagatacccagtcatatagaggctacaacgcctgttcctgtatgaagcgcacagtgtagccaatacaatcggtggctttctgacctgaagactttaaaagcacagaatcaccagggatacgactgttggataatgaattggatatcgctaaacgttatggactgttctgggcattaagcctagtgacggaggacgatgggacgccaatagcagacggtacttatatttaccagcctgagcgattctctgagaccttctgggttctcttcgaaaaacttcagcagctcaatgactactgcttcctgaagctcgtgacagtcgatcagcaccactcgacactcgtcgatcagcgcgagtcgtacatggcggattcgggaaccggcgctgaagcgctggactggctcgatgaccagattccacgctgggaagacaatctgaccgtagtcactcaggcgacctccattgtattgctatgcagctttgtggagtggggtttgaagcgtgtggtgaaggatctgtatggagctattgcgcgcaaaccttccgggtctcgcgtgagcgatatccagttcctcttggagcaccttgaatcctcaggactgtcttatgtggtagatgcgcaagtcctgcataccgttcacagctttcgaggcattagaaatgattttgctcatggtgagtgggccgctatcgaagagcagctagccaatgtttcgctacgcgactgtttcgaaaacgtttcacaactgtttgcgtgtttagaggcagcctcgtgggaaggtccctggaggagcgacgtcttgtcgtcatccaagcctcctgctccgtagccagttgcttatggcttcaaccagttccctcttgcactccaccggcaaccaatgcccgccgggtaggctggtaacggtgagatctgcgcaggccgcccgcattggatcgcccagccgattaccctcaatggtattcatctggtcgtaatcgccattcacaaacagcacgggcaatgacaaaaggccgccatcgggcgcccgttgggcatactcaatgttggcagcgtcgtttaaataccacgcgcagggagcgcggaaaccatgcgcctcgaaactgcgcaccaattgcgcgaagtctgtctgtggccagagcgcaaggtctggttgggtaggtggggcccggtgcgcctggccaaaccgtccgcctttgcgggtcacttcggcattggctgcaaccttgccgatactcgccgggtcgcctcgtcgataaatcgacgccagcgatgcagctttatccgcatcaaggtcagcaatagcgggttcaaagtgtgtgttgtagtagcggtaataatcccattgaccgtccggatacgtgtccgccggatagatcgagcggtcaaccagtgggacgagtgttggcagggcgttggtagtgggaaagtacgggaccgaaatcaatacaaccccgcggctgcgctggggttcatgggcgaccagttcacccgccacgacgctgccccaatcgtggcccacccagatggcgggcctgccaccgagatggtcgtgaagttctgccatgtcggccacgacgttttcaagggtgtacgcatgagtggtggctggtgcagaagagctgccataaccgcgcatgtcgggtgcaacgcagtgccagccttgtgcagcgaatgcttctatctgtgcgcgccatatcaggctgagctccggccaaccgtgcaggaacagcatcaatggcccatcggccggtcccatctctacatagtgagttatatggcgcggggtattgaggacacgcgaggtcagcttggaagtggacacagtctctcctcatgctacgtcggctgataaactcgaagcggcaacactataatgagcgttagttgcatgtttcgttcccatttagtctcccagtgcctatagctacccgggcaacgtcttgcgtgtgaatgaaatttaaccaaggtgaaatgccatctcagcacatacactcagggaagagctgaaggcggcaatagcaggcgcgttttcaacacaggtgcattgaggatgaagtatgttgaatgttgacccgtcccccagagccacacgcgaacccagtgagtacgagagcctggtcgcgatgggaactcgcttgctcgatgtcattccgggggcgatttacctctgtgaccgcgacgggtggctcgtcaggttcaacagcgacgcggttgatttgtggggacgaacacctgccctgggtaagcatggggaccgctattgcggctcatatcgactttatacgacagacggcgcgccattggcggtcgacgaatgtccgatggcgtcgacgctcaacgcaggcctgtgtgcgcgtaaccaggaagtcatgatcgagcgcccggacgggtcgcgattcgtcgcgctcatgaatatccgcaccctcagagaccggcatggagaaatccaaggcgcgatcaattgctttcaggacgtctcggcgcaccacgcaatagccgaagaattgcggcgcaaaagctccgatctcgaagactttttcgaaaacagcgcggtgggcctgcatattgtcagtggcgagggcatcatcctgcgcgccaataaagccgagttgtcgctgctgggctattgcgccgacgaatacatcggccgtcatatcactgagtttcatgtggatgaaccggtcatcggcgacatcctgcataaactcggcagcggtgattgcctgaacagttacccggcgcgcctgcgggccaaggacggcaccatcaggcacgtcgcgattacctcgaatgggcgattcgaagacggtaagttcttcaacacgcgttgcttcaccatcgacgtgacccgcgtgcacgatgctgaaaccgggcgtcaggagagcgatgaccggctggcggcgacctacgaggcggcgaccatcggcattgccgaggcgggcgaggacggccgtctgctgcgggtcaatgatgccctttgcaccatgctcggtcgctctcgtgagcaattgctggcgatgaccttcctggactacacccacccagacagtgtcgagcaggacgcggcgttatacgcccggcaagtagcgggtgaactggacaactacgtgctgcgcaaacgggcggtgaagctcgatggccaggcgctttacctggatgtgcatagctcgtcggtcagggcgcccgatggccggttccgctatggtgtgcgggtcatccaggacgtcacgctggcccgagaaatggaaaaccgcgtgcgtgaaagcgagcggcacatgcgcgatctgctcgaggccatgccggcggcggtctacaccaccgacgccgaggggcgtatcaccttctttaaccgtgcggccgtcgagttgtcgggacgcacgccgcaactgggcgacctgtggtgtgtcacctggaaactgttcaacaccgacggctcttttctgcctcacgaccaatgcccgatggccgtggcgctcaaggaaaatcgcgctatacgcggcgtcgaggccgtcgccgagcgtccggatggcacccgcgtgcctttcacgccttatcccaccccgctgcatgacgccgatggcaacctgatcggcgcgatcaacatgctcgtggatattaccgagcgaaagcaggccgaagaccgacaaaagaatttgatcgacgaactcaatcatcgggtcaagaacaccctggctacggtccagtccctggcgtcccagaccgcacgcaacgcgcaggatgccaaggacggctacacccggttcgaagcccggctgctggccttgtcgcgtgcccacgacctgctgacgaagcggcactggggccttacgccgctgggagtgttggcccaggaagtgttggtgccggtgtttggccatgattccggtcgcgtggtgatcgccggtgatgccatcgaggtcgacacccgcgtcgccctgaacctgaccatgacgctcaatgaactggcgatcaacgcccttaaatacggggcgatgtctaccgacgcggggacactctcggtgagctggagcgttcggcctcagccgagcggcgcgctacttgccgtggattggcgcgaacaaggcgggcctgcggtgtccacgccggagcgcgaaggcttggggtcgcggttgatgaagcggtgcatagagcgtgatctaggcggttcgttcgaactcgacttcgcccgtgagggtgttcactgccgcttctcgtttatgctcgctgagaaccagacatgaccacgttcccaggcactaaagtgctcttggttgaagacgaaggcaccattgccatgttgatcgaggaaatgctcgaagacctggaatgtacgctagtcgcttccgtagcccaactcgagaaggcgatgcaagtagcacgtgtggtggatgtcgacttggcgatcctggacgtgaacctggctggagagcgcgttttccctgtcgcccagattctacgtagacgccatattccgtttttgttcagtacgggctacggcaacagcggcctgccggaagagttcaaggactgtcaggtgctgcataagccgtttgcggaaaaagaccttcggttgaaaattgcgcagacgctggagtcttaagtaaaacccacgaccctgtcgcgaacaacatcgccgttttccgtaaggctgagccacttacgaacagcaatcaaccgacaaaaaaagtccgggcaagcgcagcggcgctcccggaccaaaggttgctacatgctcatcagactcctctaatcaaaacctcggcttgaccgccttccacgtcgggtcataacgctgcatctgccgcacatcgtcgcgctggcgaatgccacaggtcaggtattgatcatgcagcttgccgagctgatcgtggtccagctccaggcccagccccggggcccgggtaattttcacgcagccgtcgacaatcggcaccttgccgcccttgatcacttcttcgtccggttcctgccaggggtagtgggtgtcgcaggcgtaatcgaggttgggcaccgaggcggcgacgtgggccatggccatcaggctgatacccaggtgcgaattggaatgcatggacacccccaggccaaagacctcgcacatttttgccagcacttgggtgtcgcgcaggccgccccagtagtggtggtcggcgaggacgatctgcacgctgtcttgcgccacgctgcggcgcaactcttcgaaatcggtcaccaccatgttggtcgccagtgccaggccggtgcgtttatgcaactgggccatgccctccaggcccggtgtcgggtcttcgtaatattgcaggtcatcaccgagcagttcggccatgcggatcgaggtttccagcgaccagttaccatttggatcgatgcgcagcggatagccgggaaacgcccttttcaaggccttgatgcacgccacttcatgctccggtggcaaggtaccggccttgagcttgatgctcttgaagccataggcgtcgatcatccgccgcgcttgggcaacgatctgctcttcgttcagcgcctcgccccagctgtccggcttgtagggtgaatccacgtgttgcgcatatttgaagaacaaataagcgctgaacggaatctcgtcgcgtatcgccccgcccagcagatccaccaagggtaggttcagggcgtgcgcctgcaagtcgaggaacgccacttcgaacgccgaataggcattgctcaccgctttgctcgcgtgggagcccggcgccagttcggcgccggccagggtcggcgatttgttcgccgccaccgtggcttggacaatggcccgcagttgattgagattgaacgggtcaaggccgatcagctgactttgcaactgctgctggatcgccagcgccggtgcatcgccgtagctttcaccgaggccgatgtagccggtgtcgctttcgatttcgatgatcgagcgcagggcaaagggttcgtgaatgccgctggcattgagcaaaggcggatcacggaaggcgatgggggtgacggtgacgcgagtgattttcaagaggctgctcccgttgcatcagttttcagggctgggtgactcatcggcggcttctttggcgcagtgtctttgcacggcgtgttcggaacgtcgccacgcggcgcggttcgggcaaaaaagatcaccacggcagccaccagcgaaacgccggccaaaccgtacagcccgccctcgatggacccggtggtctgctccagcaagccgaacgtggtcggggccacgaagccgccgaggttgccgatggagttgatcagggcgatcaccgccgccgcgatgcgcgcatccaggtagccttgcggaattggccagaacagcgccgaggcggccttgaagccgatcgcggcgaaacagatggcgacgaaggcgaagaccggcccgccgaaggtggacatgaacatgccgaacgaggcgatcaacagcgtcagcgcgacccatgcctgctggaatttccacctgctggccatggcagcgaagccgtacatggcgacgatggagatgatccatgggatcgagttgaacagcccgacctggaagtcacccagattgcccatcttcttgatcatgctcggcagccagaacgtggcgccgtagatggtcagggcaatggaaaagtagatgaagcagaacagcgcgatctgtttgtcggccagcaacttgaacatcgagggcttgaccgtctgcgtggcttcccgggcccgctgctcctggtcgatggcggcgatcagtgcggctttttcttcttcgctgagccacttggcctcccgtgggtgggattgcagccagaaccagacgaaaccgcagagggcgatggacgcaaagccttcgaccaggaacatccactgccagccgtgcaggttcaagccatcgatgtgcagcaacgcgccggacaccgggccggagatcaccgaggcgatggccgagccactgaggaaaatcgccatggccttgccgcgttcggtcgagggcagccattgggtgaaatagtaaatgatgccgggaaagaagccggcttccgcggcgccgaggacaaagcgcagcacatagaagctggtttcgccctggacgaaggccatggccatcgcggcggtgccccaggtgaacatgatgcgcgtcagccaggcgcgggcgccgtagcgttgcagcagcagattggagggcacttcgaagatcgcataaccgacgaagaatagccccgcgcccaggccataggcggcagcgccgatgcccaggtcggtttccatatggctgcgcacaaagccgatattgacccggtcgatgtagttgacgatgaacatgatcacgaataacggcaggacgtggcgcttgaccttggcggcagcccgggcaagcacgttcgggtctggtggactctgcagggtattcaatgagcgactcccgatattgtttttttgggggattgctggtgacgtaggtcgatcatggacgcgggtattgatcccgtctaatctaacttggcattcgattgatacctggattagatcaatgttcgagctgagccatctgcgctgtttcaccaccgtcgccactgaactgaatttccgccgcgccgccgaacggctgaacatgacccagccaccgctcagccggcagatccagttgctggagcatcacttgggcgtcgagctgttcacccgcaacacccgtaacgtcgcccttaccgcggccggccgggcgtttttcatcgaggcgcagaacctgctcgagcgcgcccagcaggccgcagtgaccgcccggcgttttgcccagggcgacatcggctcggtgaatatcggcttcgtcggcagcgcggtgtacgagttcctgcccaaggtcatagccgagacacgcatcacccagccccacgtgcgaatcgacctatcggaaatgaacacctaccagcagcacgaggccttgcgcgctcgacgtatcgacctgggcattgcccgcgcgccgttgctggaacccggttacgccaccgaatgcctggtccgcgagccctttgtgctggccgtccccaacacccatccactggctgatgccaaaaccgtatcggtcaaggacctcgacggtcagccgttcctgatgtattcccacgccgcctatccgccgttcaacgaactgctgaccggcatgctgcgctctgcccgcgtcgccccagattatgtgcagtggctcggctcgtccctgaccatcctcgccctggttaacgccgccatgggcctggcgctggtgccccgttgcgccaccagcgtagtgttcaagaacgtggtgttccgcgatatcgacctgggcgaaggcgtacaaagcgagcttcatctgatctggcgcgagaacaacgacaacccggcgttcgcgatgctgctggaagggattcggcatgcggtgcgcgaggggtggggaggagggtgaggggcctggtcttggctaaagccgtgccccctggatatgtactcggtctgatccaagatcacggtcggccctgagtccgccatcgggggcaagccccctcccacatttgcaccgctcggcatcagttggatacctgtcgtccaccaggccgtcgcgggagcaggttcagggccatgccaaagttgtgtagatacccatgcccccagggggccaggcacccgggtccgtcacctgatggtcataaaacagacggaaggcacatcagaatcctaaagttgcgaggtactgggcagataccccctatatccgcaacactgttcaaggatcgaactcatgacccagcgtcaatccgaccgcattgcccttcctgattatccgcgtttttactggtttgcccttataccggtcgtgcctgctgtcgtgtggctgctggtgcaatcagcttccttggccaatctgctggcctgcgcggtactggtgctgacgggcttgggtgcttgtgcctggagcacacattcgcaacgcaacgctgtgctgcatgcgaccgcgcgggcgcaggcggatcagtcggcggtggacgcagcgcaccacggcatggcttctcgcgcacagctcgatgaagtgctgctcggcgccatgccgatctgggccaagcaggtggaaagctcgcggcaccagaccgaagaagcgattgtgagcctggccaaccgtttcaccgggatcgccgcgcgattgcaggagacggtacaggcctcgcagcaggctgccggcgaactggatgggcagtcggccgacggcgcgctcgaggtgctggcacgcagcgacagcgagctgagccaggtgatcaattcgctcaaggccacacagaccagccgtgaccagaccctggtccaggtccgcagcctcactgcctacaccaaggaactgcgcgccatggccgccgacgtggcggcgattgccgcgcaaaccaacctgttggccctcaacgccgccatcgaggcggcgcgtgccggtgaggccgggcgcggctttgcggtggtggccgatgcggtgcgcagcctgtcgaacaagtccagtgaaaccggccagcagatgtcggccaaggtcgacatcatcaataacgccatcacgcaattggtgcaggccgcgtccagcagtgccgacgaggacagccactcggtggccgagtccgaaaacagtattcaaaaggtgctcgagcgcttccagaacatcactgggcgcctggccgaatccgccgacctgctcaagcaggaaagctacggcatccgcgatgagatgaccgaagtgctggtcagcctgcaattccaggaccgcgtcagccagatcctcagccacgtgcgcgacaacatgcacgccttgcacgaccacctcctgcaagccagccaggcgccggaccaggcggtgggcgtcgacgcccggcagtggctggcgcgcatggaagccacctatgccaccgacgagcaacggcgcctccatcacggagtggccgccgcgcagccgaattcccaagacatcacctttttttaggagtacaccatggcgaagaatgtattagtggtcgacgactccagcagcgtacgacaagtggtcggcattgccttgaaaagcgccggctacgacgtgatcgaggccagcgatggcaaggatgccctgagcaagctcaccgggcagaaagtgcacctgatcatcagcgacgtgaacatgcccaacatggacggcatcaccttcgtcaaggaggtcaagaagctggccaattacaagttcacgcctatcatcatgctgaccaccgagtcccaggaatcgaagaaggccgagggccaggccgccggcgccaaggcctgggtggtcaagccgttccagccggcgcaaatgctcgcagccgtttccaagctgatcctgccttgatcctctggcgccagggaggctgccatgccaatcagtactgaaacattcgacggcaccacctgcgtgcgcattgacggcgagctgacgatctacaccgtggcggaactggcggctgcgctgctgccgcagatgggcgccactccgcgcctggagctggacctgtcacaggtcacggaaatggatggcgccggtttgcagttgcttgcagttgtccagcgtgaggcgggcgttgccggtacagccttgagtgtgaccggccaaagccaggcggtcatgcacgcactgcaactgtgccgtagcgcaggcttgtagtcgccacttcccatatttttttgatcgacaaggacagtccaggtgagcatcaatctcgatcaggcacagcagacattcatcgttgaggcacgcgagctgttgcaggccatggagcaatccctgctgcaattggaaagcgagcccggcgaccaggacgccatcggcgcgattttccgcgccgcgcacaccatcaagggttcggcgggccttttcggtctggcgtcgatcgtggggttcacgcatatcgtcgaagacgtgcttgaccgcctgcgcgaaggcaatgtggtggtggacgccgcattgatcgctctgctgctcaaatgcggcgaccacatgctcgaactggtcgaagtggtcgccaaccgcggtgagacgccgacgcctgccgttctggagcgcggtgaggcgttgcgcgaggcgctgagtgcctatcagccgatgcgaaccgtcactgccagcgttgaaaccgctgaggtggccgacgacacggcggtcgaagtgctctggcacatctccctgcgcttcggcgtggacgtgttccgtaatggcatggacccgctgtcatttttgcgctacctcgagaccttggggcaggtgctgcaggtcaccaccctgaccgacagcatcccgcccatagaccgctgggacccggaaagctgctacctggggttcgaaatcggcctgcgttcgacggccagtcacgccactctcaacgaagtgttcgactttgtgcgtgacgattgcgaggtgcacatccgtgccgtcgacgaagcgcctgaaagcactgcggtcgttgccggcgaccgtgtcgcccaggcagagcagggcgtcgtggcggcgacaccgcagcgttctgcgccagccaccgagacgaagccccgtgacggcaattacgtgcgggtcaacgccgacaagctcgacgagctgatcaacctggtcggcgaactggtgatcgccagtgccggctcaagcctgctggcccgctcctgtgacaacgaccccctgcaagaggcgacctcgacggtatcggccctggtggaggagatcctcgatggcgccctgcacctgcgcatgatccccattggtgacacgttcaaccgctttcgccgagtggtgcgcgatatcagccaggaactgggcaaggacatcgaactgatcatcagtggcgcggaaaccgaactggacaagaccgtggtcgagaaaatcggcgacccactgatgcacctgctgcgcaatgccatggaccacggtatcgaaagcgccgatgcgcggcaggcggcgggcaagccgggcaagggccatctgagcctcaatgcctaccatgactccgggagcatcgtcattgaaatcgccgacgacggcgccgggctcaaccgcgagcgcatcctgcaaaaagcccaggaacgcgggctggtggcaagcggtgcggtgttgaccgaccaggagatttacaacctgatcttcgaagcggggttctccaccgccgaggcggtgaccaacctgtccgggcgcggcgtcggcatggacgtggtcaagcgcaatatcaccttgttgcgcggcaccgtcgacctggacagccgccccggcgaaggcaccgtggtgcgcattcgcttgccgctgaccctggcgatcatcaatgggtttttggtcgccatcgaccagtccacctatgtgatccccttggacatggtccaggaatgcattgaactggatgaacgccagcgccagtccagccgcgacgacggctatctggacctgcgtggcgaggtgttgccgctggtggacctgcgcgaacacttcagccacgaagggcccgcttcacggcgccagaacgtggtggtggtgcgctacgccgaacacaaggccgggctggtggtggatgacctgctcggcgagttccagaccgtgatcaaaccgctgggcaagctgttcggcgcactgcgcggcatcagcggctcgaccatattgggcagcggcgcggtggccctgatcctcgatgtaccggcactgctcaaccaaatcgtacaactggaagcccgcacgccccaggcgcctcaatcgccgccggtcgtcgctcgctgatgtttttgcaattccatggaggttccccgatgaaatggttctacgatctcaagatttccaccaagttgatcagctcattcctggtggtcctggcgctcactgcggccatgggtggcttcgccatccaccagctcggcgccgtcaaccaggcagcccaggacatcaagggcaactggatgccttccatgcgcgcagcggcaggcatgcgtttttttgccgccaactatcgcttgaaggaaaaccgccacctcgcgaccgagatcgccgaggaaaaggcccaggccgaacgtgaagccgccgacgcgcgccaacagttcgaaacccgcatgggcacctatgagcagttgctgtcgaacgatgaagatcgccaactgctggccagcgtaaaaagcgcgtgggacgcgtacctggcgagcagcaagcaattgctcgagttttcccggcagaaccaggaagtccaggcgcgcggtttgctcagaggggagtccaaggggcatttcgatgaggtgaccagccgcctgcagaaaatgatcgagctcaatgatgtcggtgcaacggtcgcgggtgataagggctcggcgctgtatgaaaacgcacgcctgtcgatcatcgcggtactggtcgcggccttgctgatcggcctgagcctggcggtattcatcgcccgcatcatttcccgcccactgcgccaagccgcaaccgccgccgagcaattggccgaaggcaacctcaatgcccacatcgagccgggtgccaaagatgaaaccggcatggtgctcaacgccatgcgcaatatggtcggcaagctggcgcatatcatcggcgaagtgcgcaacgccgccgataacctcgccagcgcctccgagcaggtcagtgccaccgcgcaatcgatgagccaggccaccagtgaacaggccgccagcgtcgaggaaaccagcgcctcggtggagcagatgagcgccagcatcaaccagaacaccgaaaacgccaaggtcaccgatggcatggccagcaaggctgccaaggaggccaccgaaggcggtgagtcagtacagcagaccgtggtggcgatgaagaaaatcgcccagcgcatcagcatcatcgatgacattgcctaccagaccaacctgcttgccctcaatgccgccatcgaggccgctcgggctggcgagcatggcaagggctttgccgtggtggccgccgaagtgcgcaagctggccgaacgcagccaggtcgccgcccaggaaatcggcgagctgtcctccagcagcgtggacatggctgagaaggccggcaagctgctcgacgaaatggtgccctccatcaacaagacctccgaccttgtgcaggaaatcagcgccgcctccgaagaacaggccgcgggtgtcgggcagatcaacacggccatgacccagctcaaccaggtgacccaacaaaatgcttcgagcagcgaggagctggcggccacggccgaagagatgagcagccaggccgagcaactgcaacaggccatgagcttcttcgtgctggattcaacccccagggccgcggttcaagacaacagcgtcgacagccccggcagcaagcccaaccgtcagcctccgcggccgaaaccacaggcaccgcgcaaggccttcgcctacagcctggccagcgccccggatgaatcggaattcacccgcttctgatcccacgatcgatgcgggcctacaaggagagtgacatgggcgcagtgatgacgactcggcataccgcggttgcggtggatgaggatgcgcaatacctgaccttcatgcttggcggcgaaatgttcgccatcgccattctggggatcaaggagattattgaatacggcagcctgactgtggtgccgatgatgccggcgttcgtgcgtggggtgatcaacctgcgcggcgcggtggtgccggtggtggacttgtcggcgcgctttgggcgggccaattcggcgatcacccggcgctcctgcgtgatcatcatcgaggcgagtagcgaagagggcaggccacaggatatcggcttgctggtcgacaccgtgtcggcggtgcaggagatcccggccgcgcagatcgagccaccgcccagcttcggggcgcggattcgcgccgacttcatcggtggcatggccaaggtcgacggcaagttcgtgatcgtgctggaggtggacaaggtgctgtccatcgatgagatgtccagccttgccgagggcggccaagcacccctcgacctcgatccgcgttgagtgccgaccatgccagataccgcttccatcgacgatcgtgaattcggccagttccagagctggctataccgtgcggccggcatcaacctgtcaccggccaagaaggccctggtggccgggcgcctgttcaagcgcctcaagcactatgagctgcacagctatggtgaatacttcaagctgatcatgaatgaccagcgcaagggcgaactgcaggttgcgctggatttgctcaccaccaacgaaacctattttttccgcgaacccaagcacttcgacttcctgcgccagcaggtgctgcccaaggcggcgccgggcaaggtctttcgcgtgtggagcgcggccagttcatcgggcgaagaaccctacagcctggcgatgaccctggccgagagcctgggcaccaccccctgggaagtgatcggctcggacatcagcacccaggtgctggccaaggcgcgcaacggccattacgccatggagcgcgccgggacgctgccccagccgttgctgagcaagtactgcctcaagggtattggccgccaggagggcaccttcctgatcgacaaggccttgcgtagccgggtcaattttgtccaggtcaaccttaatgaagcgctgccggccctgggcgagttcgaggtgatcttcctgcgcaacgtgatgatctatttcgaccagcagaccaagagccaggtggtcgcgcgtctgctgccgctgctcaagcccggcggttatttcatcatcagccactcggaaagcctcaacggtgtaaacgacaccttgaagctggtggcgccgtcgatttaccgcaagccatgaaaaaaccagtcgatgcgaacgaagtggtcttagcgcctggccaggtcagctttgcgacgcggccgacgcgcctgcgcaccttgctcggttcctgcgtggcgatcaccttttggcacccgcaacggcggatcggcggcatgtgtcacttcatgctgccggcacgcctgcgcgatcatcagcccctggatggccgctatggcgacgaagccatggaattgttgctgcgccacgcccaggtcaatggcacccatgcacgggattaccaggtcaagttgttcggcggcggcgagatgtttcccgatcagccgcgccgcttgccgacccaggacgtggccagcctgaatattcgcgcagcgctggccctcgccgagcgctatcacctgcacctgacggcccaggacatgggcagtaccggttaccgcacggtcatgttcgacctgtggaacggcaacgtctgggtccggcaccaaccaatgggaacacttcaacaagatgcctaccaaaaaaatcagtgtgctgctggtcgatgactcggccgtggtgcgccaggtactgctggcgattctcgccgacacgccggatatccacgtcatgggtgccgcctccgacccgattttcgccatggacaaactcacccgggaatggccggatgtgatcgtgttggatgtggagatgccgcgcatggacggcatcacctttctcaagaaaatcatgagcgaacggccgacaccggtggtgatctgctcgtcgctgacccagaaaggcgcggaaacctccctgcaagcgctggcagcgggcgccgtggaaatcatcaccaagccgaccaccggcttgaagaacttcctgatcgaatcggcggccgaattggtgacagcgatccgtgccgcagcgaactccaacgtcaggaacctgggcaagcgcagcgtcagcccgtcgccattggccccggccagcaagctcagtgcggatgcgatcctgcccgccgccaacggccatgccatggcgcagaccaccgaacgtatcgtcgccatcggcacctccaccggcggcacccaagcgttggaggcggtgttgacggcgctgccgcgggtgtgcccgggcatggtgatcgtgcagcacatgccggaaaaattcaccgcctcgtttgccgagcgtctgaacagcgtctgcgagatcgaggtgcgcgaagcacgcaacaatgaccgcatcctgcctggcctggccctgatcgcccctggcggcaagcacctgatggtcacccgcagcggtgcctactaccacgcccaggttatcgacggcccgctggtcaaccggcatcggccgtcagtggacgtgctgtttcgttcggtggccaagttcgccggcaagaacgccaccggcatcatcatgaccggcatgggcgacgacggcgcgcgcgggctcaaggagatgctcgaggccggtgccgccacggtggcccaggacgaggccagttgcgtggtgttcggcatgcccaaggaagcgatcaagctcaacgctgcccagcgggtcatggcgctggaagatattcatcgggcgattttgcataagtgaacctattgatctgggtcaataaggtgggcgcgtgcagggtgtaattagggctgttgactgcacggcctgacgtactcaagagtacgtgtgtggggcgatacgcctttcgattctttgcgctgtttaaggttttcaagacgtttaactgtcttgaaacccatcccgctattgccaagtgttttgcacatccgaggtatagggaacatgaatcgccacgcacaggttatggctgacgaggaagaggcgcgcaccctcgagagtgtgctcggctgcctttcaggtgcggttgcggcgctggatcgagcggcacgggtggtaacgggcaaccctgcgttctcaagcctgctggttgaagacggcgtttcttctgctgtcggctgcgagtttgtctcactcttgcgtgccgaggaccattggcttttttacctcgccctggagaaagcggggacaaataatcgcgcattttttgcggcggagggcgaggggcagggcatgctcgatgtctgcctgacgctgtggcgcgacgcttattttatcgttgaagtgatttgcgcgccaggcttcatcgacgccgccacccgcggtcgaaagttatgcgcagatcccgctcaggtcgattttcgacgcctccggcaccggcttggcgctggtgtcactggagggccgttggctgcgtgccaatggtgtcatctgcacgatgcttggctacagcgaagcgcagttgcaacgcaccacattcatggcgctgacccaccccgacgatatgcaggtcggcaaacagctgatcgaagagttgaagtgcggtgcaagggcgggagcgacaatgcacaagcgctatattcaccgcgacgggcacgtggtgtgggtgcgcttgaccgtgggcttggtccgtgacgaccaggggcaaccgacctgtttcgtgtctcaactggaagacatcaccgagaattggcagctgcgcgaaacattgatgggcagcgagctcaagtttctcaccctggcggaaaactcccccaatatcattgtccgttacgaccgcaacctgttacgcacctacgtcaacccggcctatctgcgtttgactggcaagacgtgtgacgcggcgataggcgtcagcccggatgaggaagccagtgactacctcaatcagttgcgccgagtggtagcaacgggcgagaccgcgcaattcgtcgacagctggagcatcgccaacggtcttggttacgtgagttgtgcggtcagcctgatggccgaacgcagcaacaccggcgaagtggtcggtgtgctctcgttggcccacgacattaccgaactgcgcaggcaacagctgctggaagatgcgcgtttgggcatcttcgaaaaaatggcgacgggtgcctccctggaggaaacgctggcactgctcgtggggtatctacaattggccttgccccatcggtcttgccgcgtacagctggtagagccgcacggcactggcctggcgaagtaccagggaccagcttcggcaattgcaggcaactcgcgggcgtgctggtccgaaccgatcatggacaaacaaggccagatcctgggggctttcgaattgtcccggtcgcccggttcggtgacgcacgagagcgatatccagcctgtacggcaaacctgtcacatcgccgcgatcgcaattgaacgttggcaatcggagtcgttactgcgcgagcgcgagcgccgttaccgggatattttcgaccataacctggacatgctgctgctgttgcaggtgacatcggccggcgatgtgtcttgtgtcgaagccaacccggcgttgtcacgcgcgctgggcaaagcccatgaggcgctgatcggcgcgacgctggtgtcgatattcggccggttgggcgcgcagaaactccaggggctttgcgagcagtgcagggcagccggtcgcacggttgagtcagatgagagcatgttgctgctcaacgaagttcgtaacctgcattttaccctggtaccggtggctgactctgggcgtacgggctcgcgcatactggtgatcggtcgcgataccaccttgctgacccgcgcccgacacaaagagctggagcgccagcacgacatcaacacactggtagaaaacagtccggacgccgtcgcccggttgagtgcccaaggtgacgtgctctacgtcaatgcgcggttaaagacctgggtcggcgacgcctggccgaagctgatcggcatgccgatggatgcgttggcccccctgaatcaccagtcccagctgttccgtgaattggtggcccaggtgattcgtgaaaacaaggcaaccgagcaagagtttcgactctcagtcttgaaggcggcccccaaagtagtactgatccactttgttccggaggtggatggtgagcgagtggtcagcgtactggcggtagggcgcgatatttccaagctgcgtgcggcggagcggcgcctggccaattccaacgcgcagttgcgcgatttgtcgacccgccgggaaacggcacgggaagaggaacgcaaactgattgccagggaggtccacgacgaattgggccagcacctcaccgcactgcgcatggggatctcgttactgcggtttcagttcggcgccaccacgccggagctcgcgcctcaggtggaacgcttgctggcgctgaccgacaagacgattcaggtggtgcgcaatgtttccaccagcctgcgaccgtccgccttgaacctggggctggtctcgggactggaatggctgaccaccgagttctccaccctgaccctggttccgtgtgtgctgcacttgccttcgattcccctggtcctgcctgatacacacattaccgccgcgtttcgcatcgttcaggaatcgctgaccaatgttgcgcgatacgccgaagcgacacaggtcagcgtcaccctgaccccgcaggaaacccattggctgctggaggtgcaggacaacggcaagggtttcgagccggaggcgctcacgcgccagaccctgggcctggcgggcatgcgtgagcgtggcctgatgttgggcggcaaagtcattattttcagtcatcccgggcagggcactacggtccaggcatttattccgatgcacaaggatacgtattgatgattcgcatgctgatcgccgatgaccacaccatcatgcgcgaagggctcaagcagctctttagcctggtggccgatgtgcaagtggtggccgaagccgagagtggaacgcagctgatcgagctgttgcgccaggtcgagatcgacctgctgctgctggacatgaacatgccgggtatcagcggcgagatcctgatcgcccgtttgcacgcccagtacccgagcctgccgattctggtgttgagcatgcataacgaaatccacattgcccaacgcgcattacgtgctggagcgctcgggtacgtcaccaaggatcgcgaccccgagactttgctggctgccatgcggcgggtggtcagtgggcaacgttacctggacccgggcctggctgagcagattgcgctgcaaagcagcggtttgaaacagcagacctacgtcgaaagcttgtctgatcgagagttccagattctgcgcttgctggcgcacggcctgagtgtcaaccagattgccgaacagttggtcatcagcaacaagaccgtcagtacccacaagacgcgcttgatggaaaagatggggttcagctcgacggcagacattgtgcgctttgccatgaccttgggcatctcgtgatccgcgcgctcatgtagggattttcctaaccggtttgccgttatccctaccccagaatagggatgctctgatggttgcgttgccatcattgggccattattgctcccaggccttcgaacagccgattcaccggcgatgaaaggctttgactgggagacacaccgtgagtgaacaggccccaaccccttcagctgccttgaccctggttccgatgatgattgccggcctgctcggcggcagtgcgcttgcctacagcggtggtttcagcgcctgggccctgatagcaggagttgcactgttggtgctgtgcacaggcctgagttgcctggtgcactggcgtcaccaggcacactgcaaacacctgtgccagcagcttgacgatccagcaactgcggcgacggtggtggctgtcgataacggcctggcagacgtctgcgtccatgtattgcccatctggtccaggcagatcgaagcggcgcgtgagatcagcgaaacctcgatcctcaagctcagcgaacgcttcagtacgctgtcatcagacatcagccacagcgtgtccagccagggggcgcaagacgcctcgctgcaactggtcgacttattggaggttggccagcgtgacctcaactccatcgtggtagcgctgcgtgccgcgctgtccaataaagagaacgaactcaaggaagtcctgcaactgtccgggttcactgagcaactccagcagatggccaagtttgtcggagacattgccagtcaaaccaacctgctggcgctcaacgctgccatcgaagcggcgcgtgccggcgaggccgggcgaggtttcgcggtagtggccgatgaagtgcgcaaactctcgagcatgtccggcgagaccgggcgcaagatcagtgaaaccgtcaacaccgtcaacgcggccattgcccgtacggtgcaaatgtcccgtcaccacgccgaacaagacaccctgaccctcgcggattcggagcgtgtggtgtcgcaggtcatcgatcattttcgcggtaccgcccagagcatcgtgggcaacagccatgacctgcagcaacagaacgccaatgtcgccggcgaaattgcccaggtgctggtcgccctgcagttccaggatcgcgtcagccagatgttgacgctgattaccggcgacctgggcaagttgcagcaacagttaggcgagcgccaggaagcgagcctcagcggtggcgtcctgatgccgatgcgcggtgaccagtggctgcagacacttgcaacgggctacaccatgcccgagcagcacgcgattcacggcggcaaagcgcacgccaaggcgcaagccagcgaaatcacctttttctagaggagtttttccgatgagcaaaaccattctgatcgtcgacgattcggcctccatccggcaggtggtgagcatcaccctcaagggggcgggttacgacgtgatcgaaggctgtgatgggcgtgatgcgctgagcaagctggacggtcgcaaaatccacttgattgtcagtgacgtgaacatgcccaacatggacggcttgagcttcgtcaaggccgccaagctgttgccggcctacaagttcaccccggtcatcatgctgaccaccgaggccagtgatgcgatgaaacagcaaggccaggccagcggtgccaaggcgtggatggtcaagcctttccagcctgcgcaaatgctcaccgccgtctccaagttgatcctgccatagcgatgaccagcgagcgctggccaggaggtttgcatgaaaagcaccgtgccgatgctgcgtcgaatccaggtaatggaaggccccctgacgatctacacggccagcgagcaaaaagacgtgttgttgtcgttgtttcccctggcccatgaggtcgagttggacctgtccaatgtcgatgaactggacagcgccggtttgcaactgttgattctgatcaagcgcgaatcgttcaaggaaggcacgcagctggtgctgagcaaccccagtgcgacggtactcgaagccctgcggctcagtggccttgacgactacttcgccaatccctctttcactgtatcggttggagcatgacccaatggcccagcccatgaacatggatgacgtgctgcaaacgttcattgccgagagtcgcgagcttctgttgcaaatggaagatgcgctgctgcagatcgagcagtcgccgcacgacctggacaccatcaacggcctgttccgcgtggcccacactatcaaggggtcggccggcctgttcggcctgatgccaatcgttgagttcacccacgtcgccgagagcgtcctggatcgcgtacgcagcctggaagtgagggtggacgaagccttgagcgcgttgtttctcgacgcccgcgaccatatcggccaactgatcgacctgctggccgaggatggcgaccttgagcgcctgggtgaaccgttgcgggttcagggccagcgcttggctgagcgcctgtcgatgtatctgcaagcgccctgcgcgctgcctgcatcggttgctcaagaccagtcgccgatggctgccgaagggcctggtcactggcatctgtccgtgcgctttggtgcggatatgtttcgcaatggcatggaccccctggcgttcctgcgttacctgagcaccctggggcacttggcgcataccgtcacgctgttcgacgcattgccgcctttgctgtcgatggacccggaaaccaactacctgggctttgaactggcgctggtcagcgacgcttcgcgggaagtcatcgacggcgccttcgattttgtccgcgatgacgccctggtgctgatcctggcgccccaggccgatatccaggcgtatcgcgcgcacatcgacgcgctgccggaagacaatacggtgttgctggagctgttggtacgttgcggcagcttgactgaggctcaggccgcactcgttattcaagatgaggcgccaacgcccgccgtcgcgcctgaagtcgcgcaggattcacaggccacgctggccaaggccggtaaaggcgcggtcaataacgaaggcaacctgattcgagtcgatgccgccaaattggaccaactgatcaatctggtcggtgagctgatcatcgccggtgccggcgccaacctggtggcggtgcgcagtgggattggcgagatgatcgaggcgaccagcctgttgtcgcggctggtagaggaggtgcgtgattcggctctgaccttgcgcatggtgcagatcggcgcgaccttcacccgcttccagcgcgtggtccgggatgtgtccaaagagttgggcaaggacatcgtgctgcgcatcggcggtggcgaaaccgaactggacaaaacggtcgtcgagcgcattggcgacccgttgacgcacttggtgcgcaatgccatggaccatggcattgaggcggtgtcgactcgcctgcagcggggtaaaccggcccagggcaccgtacgcctgaatgcctaccatgaatccggcagcatcgtgatcgaggtgtcggacgacggcggtggcctggccaagcacaagatcctcgccaaggcccgcgagcgcggcctggtcggggagggccaggtaccggccgacaaagacatcctgaacctgatcttcgagccaggcttctccaccgccgaccaggtcagcaacctgtccggccgcggcgtgggcatggacgtggtcaagcgcaatatcactgcattacgcggcagcgtgagccttgagagtgaagaggggcagggcaccacggtacgcattcgtttgccgcttaccctggcgatcatcgatggctttctgatcggtgtgggcaaggcctcttacgtcatcccgctgaacatggtggaggagtgcatcgagttggagcctgggcagggggctgaatccggcttcctggacctgcgcggcgatgtgctgccgatcttgcggctgcgcgacatgtttgccgtgcaagagccgggcggcatccgcgaaaacgtcgttgtcgtgcactacgccggcttgcgtgccggcctggtggtcgatcgcttgcagggggagtttcaaaccgtgatcaagcccttgggcaaagtcttcggagaggcccatggattgggtggtttcaccatcctcggaagcggggccgtggccctgatcctggatattcccaatctgttaggactcgttgccaaggaagccaccaaccgttcgaccccacgtcctttatcgatccaataagcgtcatcaggagttcctcgccatgaccgttatcaaaaatattacgctgttgattttcacggcaatgctgggcgtcgtcgtgttgggtggcaccagtttctatctgaccagtgaagtcaattccagcgccagttttgccagtgtcaacacggtacccagcctgcttgagatcgatcgcgccgccgaggctttcgccagcctgcacgccctgcaatgggagcacctgaatgaatcgggcaagagcacggttgcgccgtacgccgcactgatagcgcagcatttgggcaatatcgacaacgccttggagcgttaccgcacccaactggctatcgacgcgcatgatgcggcgttgttgagccagttgcgcacccggtttgacgagtttgcagccttgcaggggcgattcgacaaactggttgaaacaggcgatatcgccggcgctcgcgcgttgctcgaagtgagccagcctctgcaaacggcgacccaggcagcaatcgccgatgtgcgccaatacaacctggaactggggcgcaaggctcaactgctggccaccagcactgagcagaatgcccgctacatcatcctgctgatcggcgcgctcacactgctggtcactggactgatgggcttactgctggcacgcaatctcatgcgccagctgggcggtgaacccgccagcgtccgcgcctttgctgcgcgcttgtcagccggcgagttggaagcaaaagccaccctcaaggccggtgacaccacgagcttgatggcttgcatgcaacagttgggcgagaacctgcaggcgctggtcgcgcagataaacaccatgtccagcgcgcacgacaagggtgagatcgacgcacagatcgatgtaaaccgctttcacgcaagctaccgatcgatggcccagggcatcaacgacatggtcaacggtcatatcgcggtgaagaagaaagccatggcctgtatccgtgcctttggtgaaggtgatctatcggcgcagctggaacagttccccggcaaaaaagccttcatcaatgaaaatatcgagctgctgcgtagcaatatcctcgcgctgatcaatgaaatgcagcacatgtccagcgagcacgagaaaggtgacattgatgtcatgatcgatgttgagcgctttagcggttcgtaccgtgaaatcgggcagggcatcaatggcatggtcagcggccatatcagtgtgaagaaaaaggccatggcctgcattcgcgcgttcggcgaaggcgatctggccgcgcccctggagcaattcccgggcaagaaagcctttatcaacgagaacattgagcagttgcgcgccaacatcctggccctggtcgacgacacgcgccagatcagcgacagcgcgatgatcggcaaactcgatacccggccggatgcctctcgccatcagggcgatttccgccgcatcatcctgggaatcaacggctcgctggatgcgatcatcgtgccgatcactgaggccatggacgtcctggcgtcgatctccagtggcgatctgacccggaccatcgtcggcgattatcaaggcaagttcctggagctgaaaaactcggtcaacggcaccgtggaaaaactctcggaaatcatcggcgaagtgcgcgggtcggccgattcgctgtccagtgcctccgaggaaatctccgccactgcccagagcatggcgcaatcggcgtccgaacaggcggcgtcggtggaacagacttcggcgtcgatggagcaaatgtcagcgtccatcgcccagaacaccgaaaacgccaaggtgaccgatggcatggcgggcaaggctaacaaagaggcgtccgaaggcggtcgcgccgtgaaggacacagtggcggcgatgaagaccatcgctgaaaaaatcggcattgtcgattccatcgcctaccagaccaacctgttggcgctcaacgcggccattgaagcggcgcgggccggcgaacacggtaaaggcttcgcggtggtagcagccgaggtgcgcaaactggccgagcgcagccagatcgcagcgcaggaaatcagcgaagtggccaagaacagcgtggccctggccgaacgggcgggcaacctgctggatgaaatcgtgccttcgattgccaagacctctgacctggtgcaggaaattgcggccgcctcggaagaacaatcgatcggctccgagcaaatcaacagcgcaatgtcgcaaatgagccaactgactcagcaaaacgcgtcggcctccgaagagttggccgccactgccgaggaaatgagtggccaggccgagcagttgcaggaactgatgggctttttcaccgtacagggcaagcgcgtcgggcgggctgttgccacgtcgggtctggggcgtgcggcgtcgctgtcggatcatgacagccgtgcggtggagagcggtttcgtccgcttcgggagttgaaccatgagtgcctcagccgttgtgcctggcacttcagccccagcgctgcaagtcggcgagcccttgcagtacctgaccttctcggctgatcaggagatgtacgcggtcaacaccttgagcgttcgagaaatcatcgaatacagccaggtgaccagcgtgccgatgatgccggagttcctgcgcggggtgatcaatctgcgtggctcggtggtgccggtggtggacctcaaggcccggttcggcaagggcgtgacggaccttggcagccgcacgtgtatcgtcattctcgaagcggccaaggagggtgagtcccaggtgctgggggtggtggtggactcggtcagcgaagtgatcgagatcctcgatatcgacatcaagcccgcgccggccttcggcaaccctattcgtactgacttcatcagggggatgaccaaggtgcggggagcgtttgtcacgctactgcagatcgagcaggtgctgtgcgtcgatgagatcgccggcttgatgcgcgcttgaggtgtacgaccgtgcccccaggtgcgggcgcaaagcaattgatccgaggtgaatcatggcgttaaccatccaaagtcctggcagtgctgcgatctcgggcccgagccaatacctcaccttcgagttggggggggagatgttcgcggtcggcacgctcaacgtgcgcgagatcatagaatatgggccgatcacccacgtaccgttgctgcccgccagcctgcgcggggtgatcaatctgcgaggcgctgcggtgccgatactggacctgggtgtgcgctttcgtggcgaaagaacgctgcagacgtcaagaacctgctttgtgatcctggaggtacaggtcggtagcgtgcgcaagccggtgggcatcattgtggatgcagtcagcgaggtgcttgaaatcgccgagcaggatatcgaaccttcgctgagtgtcggcaccgaggtcagggccgatttcctgttgggcatcggcaaattggacagcggctttgtactgctgctggatatcggtcgcgtgttgtccctggaaccgatcgaggtgctggcaaaccttgaatccttactgcctgccaccgcctgatcaacttttgggatgcccttatgaacgtgattctctccgacgccgagttccagcagtttcgcagccttatccatcagatcgccggcatcagcctgtccgatgcgaaaaaacagttggtcagctcacggcttgccaagcggctgcaggcgttcgagctcacgacttacggtgcttactacaaggtgttgatgaaggacgccacggaactgcaggtggcggtagacatgctgaccaccaacgaaacctattttttccgcgaacccaagcatttcgacttcctgcgcgacgtggccctgcccgaactgcgtggcaatgcaacgctgcgggtatggagtggcgcctgctccaccggtgaagaaccttacaccctggcgatggtgctggcggacaacctggccggtcggccttgggagatcatggcgtcggacatcagcagccgtgtgttggataaagcccgccaagggcgctacccactcgagggtatacgcggcattcccgaagcgctgctgcacaagtattgcctcaagggcgtcggtgccaaccacggttgcttcatggtcgatccggcgctcgcggcgaaaatcgatttccaggcgatcaatttgaacaatccgctgccgaaagtcggcatgttcgacgtgatcttcctgcgcaatgtgatgatctatttcgacagcgataccaaagtgcaggtcgtcaagcgtctggtcagccatctcaagcctggcggctatttcctggtcagccactctgaaagcctcaacggcgtgaccgacgagctgaagctggtcaagccttcgatctatcggaggccacatgcctgacactcaaccttcccgcgaggtgttcctgaatcctggagattggtttttcggcactggcgcgattcggctgcgcacggtgctgggctcctgtgtggccctggcgttctggcatccgcagcgcttgttgggtggcatgtgtcactacctgctgccccagcgtgctgcgacgagcgccaagcccctggacggtcgctatggcaatgaagcgctgcaactgctgctcgatgccatgcgcgcgagcaaggtgcctccgacggagttcaggatcaatgtgtatggcggcgggaatatgtttcccgggctggtgcgcccggacaaccactacgtcgggcaacgcaatgtcgagcaagcccggcgcctgctcgacgtgaatcacttgcggtgtctgaactggcacgtggaaggcgtggggtatcgcaccgtggtattcgacctggccaatggcaatattcaactcaactacctggcgctgcagcgccccctcagcagccctcaacgagagcgtgcgctatgagtcctatcaaagtactgatcattgatgactctgccgtggtccgccaggtattgacggcgaccctgggacgagaccccgccattgaagtgataggcgcggcggcagacccggtattcgccatggataaaatgaacaagcaatggccggatgtgattgtgttggacgtcgagatgccgcgcatggacggcattacgtttctcaagaaactcatggccgaacgccccacgccggtggtcatctgctcgaccttgaccgagaagggcgcggccaccaccatgcaagccttggcggcaggggccgtcagtatcgtcaccaagccgcagttgaatttgcgccagttcctgaccgacagcgccgatgagttggcgggcgccgtcaaggctgcggccaaggccaacatgaaacgaatggtggcgtgtggtgaacgtgctccccagagggtgagtgccgacgccattcttgcagcgggcgccccggcaatggtgcgtaccaccgacaatattgttgccatcggcacctccacgggcggtactcaagccctggagttgatactgaccgcattgcccagggtgtgcccgggcatcgtgatcgtgcagcacatgcctgaacacttcaccgcggcgtttgccgagcgactcaatcgactgtgtgaaatcgaggtcagggaggcgaaaaatggcgaccgggtcatccccggttgcgcattgatcgcccccggcggccgacacatggtgctcaagcgcaacggtgcccaatatcaggtggaaatcgttgacggcccaccggtgagccggcatcggccctcggttgacgtgctgtttcgttccgttgcccgcagtgccggtggcaacgcgctgggcatcatcatgaccggcatgggcgacgacggcgcgcgggggcttaaggaaatgttcgacgccggcgccgccacggtggctcaggacgaggccagttgcgtggtgttcggcatgcccaaggaagcgatcaagctcaacgccgcccagcgggtcatggcgctggaagatattcatcgggcgattttgcatcggtgaacttgagtgccaggctgcttgtgccggtacataactaatgtgggaggggcggtgcgacgattcgacttgctcccgatggcggcctcagggccgaccaggatgttggatcagaccgagtacatatccattatttaggtaatggccactattggttccgcttttacagcgggtcactttgaaaagcgcaaagtaaccaaacgctcttgccccaccactcggcacctcgcttaggctcggtgtgcccgtaatccgacagagatttggggggccgcctgagatcaaaagcagatcaagatcaagagcggctcgctgcgcatcgtggttaccgtcggctgctacacagtgtagatacctatgtatacgctatagccgcctcggccatgcagtgtgcattcagtccactgtggttgcattaccgcaatgtggtattgcgcaggtaacgggccggtgaggtgcccagggttttacgaaacatcgtgatgaacgagctgacagactcatagccgagggcttcagcggttctctgcaccgattgcccttcggccagactttgcagggcgacgatgatctgccattgcttgcgccattgtccgaaggtcaggccggtttcggcttttaccaggcgggcaagcgagcgttcgctcatggcgacgttgcgtgcccaactcgccatggtggcgcggttggcgggatcttgcgccagtgcccgggcgatggtgcgcagcgggtttgaggcgggtaaaggcaggtaaagctgttccgtaggggccagttcaagttcttcgagcagtacgtgagccaaccgcgaactgcgcgaattggccgggtaatcctgggcctggccgctcaggtgcaggatcagctccaggatcaaaggcgacagcgccaaggtacagcagcaatccggcagcgacgcggcgccgggctccacgaacagaaaacacacctgcccgttggccgttacgcggttgctgtgggcgacaccccccggaatccacacgccgaaccctggcggcaccatccatacgccatcttcgaccgtacacacaatgccgccgcaacacgccaccaccagttggcccttgcggtgcttatgtacggcggactcgctgtcgttgcgctggggttccagcatcagcgctacggcgggctgggaaagggtgtcgtactcaaactgatcgacgtggatttcggccatgcaaggtcatccagggttgtccgaatttgattatattttggcagtgtactcaatatcggcagtggcagtaattccctagcattacctgcaagccccgccttcagtaggcgagcgaatgccagaacctctcgaatcccggtgcttgccatgctcagcgaaatctcgattgccaacctctactttccgcccttgctggtttacctgggggcgtccgtcctggcctaccagctgatcgagcgcctgacccgccgctggttggaccgggcgtggcacccggcgctggcgcgttttttcgtctcgctcatcgtcgtgtcgacgatggtcgtccattgctgagcgaggccgcgcatgtctatcgtcaaactccttaaaactgccgccaccctggggcttggtgtgctggccctggtgttttgcctgcaactctggcgcgcttatgtgctggcgccctggacgcgggacgggcgggtgagtgcccaggtgatccgcattgcgcccgaggtgtccggccaaatcgatcagttgtgggccagtgacaaccaatgggtggaaaagggcgacccgctctatcgcatcgatacgcgtgcttatcgattgacccagcagcagcgcgcggcgcagtttgcagaagcgcgcagtgtgttcgagcagcgcagtgcgcaattcaagcggcgcgcgcagttgggcggcgccattgcccgtgaagagatcgacaatgccgcgcgtgacttggccgtggcccaggcgcgcctggacgcggcacgcagccagttggcccaggcccagctcgacctggaccgcaccaccattagtgcgccggtggacggctatgtcacgcaactgcggttgcagcccggtgattacgcccaggcgggcatcaccaacctgtttgtagtcgacggtcatagcttctggatcacgggctattttgaagagaccaagttgccgggtgtacgcatcggcgcagcggtgtcgatcaagctgatgggctttgacccgctgctgcaaggccacgtggcaagcctgggcaggggcattgccgacaccaatgagttgcgcaacgacagcggcttgccccaggtgagcccgaccttcagctggattcggttggcgcagcgtgtgcctgtgcgtatcgagttggacaaggtgcccgacggggtggagttggcggcgggcatgaccgccagtgtcgaagtgacgcagccgggcgtcgcaccgcgctggcgactcacccaatggctgcaggcgttcatgtgatgactgacctggcgacacgctttttcgcggcgatcccccggccctggacatccgccacgcttgcctacgtgctgcgcagtctattggcggccggcctggcactctggcttggcttgcaactgcatctggattcgccgttctcgggtgcttccaccgtgttgctgctggtgcagcctatccagggggcagtgcggggcaagggtgtgtaccgaatgctgggcacgctggtcggcatggtcgcggcctttgtgctgatggggttgttcgcgcaacagatgctgttgttcatactgggcgtcggtatatggctgggcctgtgcgtcggtgcaatgacggtcctgcgtcattaccaagccactgcggcagtggtggcgggctatacggtgtgtttggcgctgggccctgccatcgtcgccccggaacagggcttcgaccacatcatcacccgtggcacggcggtagcgctcggcgtgctcagcttgagcctggtggcgacgctgttcagcgccaagaccatggagcacaaagttcgaagctcgctcgtcgacgtctgcgcgcgcagtgcccggttgctcgcggccagccttgtgggcgaagagcctgcgcgcctggcgacgctacggcaccagctcgcgatcgatatcggtaaggtggacgaccagctggggctcggccgtggcgaatcgtcgctgatccgctcgcggcagctggcgattcaggccggcctggcgcatctgcactcggcggtgctcgacgcgcacccggagcacccataccaaggaatcgaccctgcgttgcgcgcccggataagcacagggttgcagcaactgagtgaatgcctggcgcatgctcgctgcgactttcgcaccgcggccgatacgctggagcaattgcgtcgctgggcggatgttcgcgccgactcaagcccacaggtgcggttgcgcggcgaacgcttggacgacccactgacggacctgggcgctgcgttgctgaacttctccagcctcgaccatgcccgccgcgggccgacacgcgccgtggggtatcaccgcaattacgcggatgctgtgcgaaacggcatccgggcactgctcgccacactgagtgcgggtgcgatctggtatttcagtggttgggatcaggggcccacattgctggcggtgctggggccgttctgcacgttggtggcgacggctgccgcgccggcccaaggcattaacagctttatccgcggcacgctctacgcgattgtggcggcagcgctgtgcaaattcctgctgatgccgcagatcaatggcttccctctgttgctgctggtcatggcagggttctggtcgttcggcatccatgccacgtgccagccgcgccatgccctgcaaggggttgcctacctgattggcttcaatactttggtaagcaccggcatgaccgccacctacgatttcgtcggcttcgccaaccaggcgctggcctggatcgtggcgatgcttgtgtgcctcttggcgtttcagatcctgcccaaagatccagccaggcaggtacgcgcattgaaacgtgcgctccaccagcacacacgccggctgctacgccaggccagtacaatcgatcatgctcaatggcaagcgaagcaacaacaccggttagttacgttgaagagtttgcttggcgcggatcacccgcacgaataccaggcgggctacttgtcgctgcaactgagcaagcagttgaatcggctgcagcgcaaagccagcggtatcgatccggcatctcccgtggcccgatgtgtgcaaagcggtgcgcggcgggttgcacgatatgccgattatcccgctatcggcgccgcgcaggcgcggcgcacatcccggtcgttgagcaggcttggcgcgcctcatctggcgagcgcttatcaggacttggcgtggctgctggagcagtacgcgaacctcgtgcaatagcgctaacatgagtgaacgctcatgctcagcgcttactgccaactcgccggataccctacctatgagagatctgccgcccaccgcgaccttgcgcgcctttgaagccgccactcggcacccgacctttacggcggccgcccaggagttgcatgtcacccagagcgcagtcagccaccagctcaagcatctggaggcgctgtggggcttggcgttgttcgagcgcggccagtcgttacgcctgaccccggcgggggctacgctggcgcccatcgtgcgcgagttcttcatgagcctggaggctgccctggccgacctgcgcgaacaaaagggcagggtacggctcaaggtcagcaccacctattcctttgccttgaaatggctgctgccacgcttgccgaacctcgcgcgccagcaccccgagctgttggttgcgctggacaccacggatgacgtcatccacttttccgacgcccaagcggatgtcgcggtccggctgggcaagggcagttaccctggcctgtattcagaattcctgttcggcgagcatgtgtttcccgtggccagccccgaactgttgcggcgccttggcaccccgggcagccccgcccatttattggacttcccgctgctggcccgggatggcgccgagctggcaccgaaatgggaggcctggtttgaaacggtggggctggccttttcgccgctcagggaaagcgtcaggtttggcgacaccaacatgaccgtcgaggcggccttgctcggccatggcatcgcgttggtgcgcagcgggcatgtggagcaggaaatcagcgacggtcgcctggtgcgcctgtttgatgtgccgtttccatcgccgcttgcctactatttcgtgtgccccaagggcatcgaaacccagccgcatatcctcagcttccgtcaatggctgatgagcgaggcgctgaaagtacaacgggcggatcagtgaggtatgagtatctgttcatgctgtgatgagcagacttcgctgtaaaccggggccttggcttgcctaagatggcgcatgcctactcatatcatcttcctggtgctgttcgccgcactgctgcatgccagctggaacgcgctgctgcgcggtggtgccgaccggctatggtcgatgacggtcatgtgcatggccattgccgtcacctgtgtcatcgccgcagcgttcatggcaccgccagcgattgagagctggggctacggggtgctttcggcgttgctgcatgttggctacaacctgttcctggtacgcagctaccgggtgggcgacctggggcagatctatcctatttcccgtggctcatcgccggcactgatcaccctgggggctgcggtatttgccggggaacgcattgcgcccggcgagttgctggggattgcactagtgtcaggcgggattatttccctggccttcagtgggcgccggctttcggttcccagcctgccttatgcgctgggaactggttgtttcatcgcggcctacagcgttgtcgacggtatcggcgccaggctctccggcgcgccgctggcctataccgtatggatgtgcgcgttgtggggcgtgatgatgccagcggtgtacatcggcctgcgcgatgcccgcagtttattgcgtctgcgccccggaaccttggccgcggtggtcggcgggctggtgtctttgctggcctatgcaatcgtgatctacgccatgaacgaagcgccgttgggcgcggtctcggcattgcgcgaaaccagcgtgttgttcgcgatgttgattggctacttttttcttggcgaaacccttaccgcgcgcagggtcctggcgtgcgtggtgatcgccggcggcatcctcatcatcggctgacacagccatcttctaaggaggtattttcaatggttgacgtttcgcaggcaccgctgatcctgatcaccggtggcagtcgcggagtgggtgccgcgaccgcccggctagccgccgcaaagggctatgacgtggcgatcagctacgtgtccaacgagcccgcggcgctggcggtggccgcagatatcgaagcaatgggccgcaaggccctggccgtgcgggccgatagcgccaaccccgatcaagtcgccgacttgtttaccgccatcgaccgcaggttcgggcgcctcgacgtactggtcaataatgccggcgtgctggcgactcagtcgcgtctggaggacctgagcctggagcgcatgcagcgcatcttcgcggtcaacgccatcggcccgatgctctgcgcccagcaagcggtaaagcgcatggcgtatcggcacaacggagcgggcggcgtggtgatcaatatctcctcggcctcggcgcgcctgggcagcccgaatgaatacgtcgactatgcggcgtcaaaaggagccctggagactttcaccatcgggtttgccaaggaagtggcccgggaaggcatccgcgtcaactgtgttcgccccgggcacatctacaccgacatgcatgccagcggcggcgagccggggcgggtcgaccgggtcaaggactcgatccccatggggcgtggcggccagcctgaggaggtggcccaggcgattttgtggttggccagtgccgaggcgtcatttgttaccggtacgttcctcgatgtaacggggggcaaatgagtcggcaagcgatctgttgctcggccattgtgcatccaggcgggcatgaatgactgcctgatcaagccgattggcctggatgcgcggttgatgtcctaccagcacagccacaacggtgaagaactcgcgttgccgcctaccccggagcgcctgactgcggcgtctgacccggtacatctggttgaccttggtccactggagttgttgatcagcagtgagccggtaaaatttcggcaaattctcattgagttaatcaataacaatcgtaaggatcgccagcaactgggggtgctgttgcaagcgggggataccgatcagctcgtcgagttggcccatcgaatcaaaggggctgcccgggtggttaaaggtgggcagttggtcgaacgatgtcaggttctggaagcgacctgtgctgatccgaatgcataaacctaatcggccttcgccaacaatgggtttggcttgagcgccaggtcacgcgcaaacgcttgagcaaaataatccatgacggtacgcaccagcgccgaacgcttcatatcgcggtgagtgactaaccagatatcacgcgaaaaccccgcgctgtcgtgctccagcctgatcaactgcggatctgcatccgccaaaaaacacggcaggccggccacacccacgcctgaccgagcggccaccagatggccgctgatgtcgctgagttcgcacgccacggctcgctcgcctgcgatctgcagcaaccattgttgctggggcatgtcggcgaatgctttttcataagcgatgaaggcccactgtgccgggctgcaaaggtgcgcataggcgcggctggcgtacaaatcgaagtccatctttgcaacccgccgggcgacgttactcggctcccgtggccgcaggtgcctgacggcgatatccgcctcgccacgactcaacgagacctgatgcgcctgggcactgatcgataactgaatctgggggtactgctggcggaagtcacctaaacgcggtgcgatgaaatgcgttgccagtaccggggaggcgctcaaggttactcgcccactcaaggacacttgtcgggatttgacctgccgggtgatatcaaacgccgcgctttccatgcgcagggcctgttccacgatcagcacgcccgctgctgtcaggcggcaggatcgaggcaggcgctcgactaacggtgtgtgtaattgggcttcaagcgcggcgatgcgccggccgacggtcgcgtggtccacccgcaactcccgtgcagcgccggaaagcgttccagccttggccaccgcgagcagatggcgcatgttttcccaatcgaacatcggtgcaaattctcacatgagcagtgcgcttgtgtggaatttacaccataggcgcgggggcaatagtctttttacgggtgaacagcaactggataaacctgtttaggagcaacaagaacatgacccttgccatggcaatgacgctaaccggcggcccgcaggttttgcaaccgattgagattaacgtcccaagccccgggccccacgaggtgttggtggcccagtcggtgataggcgtcaactttgtggacacctactttcgcaacggcctctacccggtcgcgacgctgccggccgtgctcggcttcgaaggcgccggcgtggtggctgctgtcggcaagcaggtcagccacctacgcgacggtgaccgggttgcctatacaggcgggccgctcggcgcatacgcgcagttgcgcctgttgcccgcgagccggctggtgaagctgcctgacgaggtgtctttcgagatggccggcagctcgatgctacgcgggcttaccgcgcatatgctgctgcgcaaagtgcatatgaccaagcgcggtgactgggtcctggtgcacgcggcagcaggcgggttggggcagattgtggtgcgctgggcaaagcgcctgggggccaacgttattgctacggtgggctcggagggtaaggtcgccatggcgcgcgcagccggtgccgatgtggtgctgttgcacaccgatgagggctgggcagacgaaaccgtgcgcttggcagaagcaaagggtgtgcaccttgcaatcgacggtatcggcggcggcatgctgagtcagtcattgagcgtggtgcgcccctttggcgtagtcgccagcctcggccagcctgctgggccgatcccgccggtgcgcgtggaagacctgggtttcagccgctcaattgcactgatgcggcccagctcgctcctgtatgccaatgacccccaagcctacaaatccggtaccgatgaactgctgcagaggatgttggacggcatggtcagccccgtcggtgcgcgttatccacttgtggaggcggcaagggctcacgcagaccttgaggcaggcaaaaccatggggagtgtgatccttgtggtatgacgtggccatctgaccccggtgcctgggcgccggtcactcaacgatgcttgaaaaatgcggtacgacgttggcatcgagcaggaaaatgaagctgtttatcaaagctgattcgttgcggctgttccagctcatatacaagccgattgccggattgggaaggagccggcgaaacacaaccttgtcgcgcatgactgactgggcaatcgacttgggcaccagggcaacaccaaaaccacaggcaaccaggccgatcaaggtgtgcagctgtgtggcttcttgcaccaccaggacagcgggtatgtgctgcgcgccagcaacggccagtttacagcaacgcggtgggtcgagaaccctggtgttgactactcgctcgatcttgcccgggtaaaagccgccgctgccgagcaagtggcccagcgatgaagccagatcaaggagtgctgaacagcaggcgccaggtgtcaaccactacggactacttgtatgcttgcgcctgggcacatagggccgcagaacgcgccggcgtttgaacgatggcgagtggaaaccggatttccttaaggggctgacgtgaagcgtgaaattcgcctggtgatgctgttgctgttggtgatcggctgttccctgacctccctgaccatctggaaagtcctgtcttcccgtgagcgcgcgctggcggaggtggacgtgcacggcctgaacctgacccaggcactcaccacctacaccgaaggtatcgtgcggcaaagctcgctgctgttgctcgggctggtcgagcgcctggaaaccgaaggcagtggcccggcgcagatcgagcgtatcagtaccctgatcggtcggcagcagccgttgatgccgcaactcagtggcatcaccgtctacgaccatcacggccactggttgatgtcgtccaaccgtccgatcccagtgggtgccaacagcagcgatcgcgcttatttcattcatcatcgcgatgatccgagccgtgagccttttatcggcccgccgatccagagtcgtaccaaccacgagtgggtggtgaccatcagccgccgcttcaatgatgcgtcgggcaacttcgccggggtggttgcggtcaccctgggggtggaaaacttcctgcgggtgttcggcaaactcgatgtaggccaggagggcgcgatcggtttgtcctatgccgatggcacgctgttggtgcgctatcctttccgcgaacaggacatgggccgcaacttttccaagtcgcctatctatgccaagtaccttgtcgaccaatccgtcggcaccgccgcctacacgtccagcctggacggtgtggagcggctctacgcgttccgcaaaagcgagaccctgccgctgatcaccacggtcgcattgggcaagcatgaagccctcgctgcgtggcgtatcgaggcggcgttgtccgcagtggtggtggtagggctgctggggctgacagggttgatcggctggttcctgatcctcgatatccgccggcgtactgcggcggaagaggcgctgcgtgtcgtccagcaacagttgctcgactccaatcggcaattggcgctattggccaagaaggatgcgctgaccggcctggcaaaccgccgctgcttcgacgaaaccctggccctggaagcgcgccgagcgcaacgcgacggtacgtcgctggcgttgctgatgatcgatatcgactatttcaagcgctacaacgacgcctgcggtcacgttgcgggggatgcgtgcttgcagtcggtcagtacactgttggagaactgtgtgcagcgtccatcagacttggtggcgcgctatggcggagaagaaatagcgatcatcatgccggcgaccgacagcgaaggcgcgacggtggtcgcagaaaggatccttgcgcgactgcagcaggcaaacatcccccatcccggtagcccgttcgggcgcgtgagtgtgagtatcggcattgcgacgggtacaggctcacggctggagccagtatcaggtttgatcgaggcggccgatgccgcgctttacggtgccaaggctgccgggcgcaatgggttttcccggcagcccacggacattgcttcgggcggctgaaacggcctgtacttatgtgcttgccggttcacatcccaagtgtcggcatcgtgagttcgccgcactccatgagctggccggccgtgacttgtagctcgtttgtgggtttcgccgcgtagccaacgatgaagccggcgctgagcagtgaaaggcagaaggcggcttttatcaggatcatgggaggtggttctcacatcagctcaaaagggtgaaccacagattgtgtattcaaggaaaggttcctgggacgcctgcagcgctccagcacatcaccttttccaagtgacccgtatgttcgtcccgttgttcgttgagtacgatgaacccgtgtttcttgtaaaagtgcaggctgggtaaattttgcgaatacacgctcagttgtagaactgatcgggattccattgcgtctgcgagcaaccgcctacccacgccgccgccctgatgcgcgggcgcgacaaacagcgccgccagggtgtcttcatacacgcaactgaacccgaagactgttccatcggcctcaaacacgcgtgtcacggcgctgggcaggtagacgtcacgcatggcgcccagttgctcatgccagaactggggggcgatgaagtggtgggcgaggatcgatgcttgcagccagatatccagcaccggttcaaggtcagtgtgttggaagtcgcgaatcatgatgcctcaacggttgagtgaacaggccgaaccccagtgtggcggccgacagtactgcgcttgaacgcccctgcggcagcgattttgagcaaccgctggaaatttgggcattgcgcatggttgggtgcagggcaggcggcggcgtgacgtaagcctcgactcatggccttcagttgtttgaccgtcgcatcgatctcgtcggccttggccagcagcacacttctatccacctcggcctggccattgggcgacagcatggcctgtatctcatccaacgacagtccaccggcctggccgagcgcgattaccgccaactgttcaaccactgccggggcaaactggcggcgagcgcccggttggctgatcgaggtgatcaagcccttcttttcataaaaacgcaacgtgtgggcaggcacgccggtgcgtttgaccacctcggtgatatccattggcagacccttgacttgaagttgacttcaacttctatgatgcctgcgcgggttcaatcggtccatggatatgaggtgggtatggcggtgttggaagtggttgcacaggtggtgttgttgggcgcaggggccactctggtgatggatatgtggatgctgctgatgaaggccattggcgtgccaacgctgaatttcgcgttcgtggggcgttgggttggacatgcgtgccaaggccgtttcactcattcgagcatcgggcaggcgttcccggttcgaggggaagtggccctgggctggatcgcgcattacgtcacgggtgtagtttttgcgctgctgctcgtgtgggttaaaggggctgactggttgcaggcgcccacctttgtgccagccctggtgttgggggtggtcaccgtggccgtcccgctgttggtgatacagcccgccatgggcgcaggttttgcctcatccaagacgcctacgcccggtcagaactgcctacgcagcctgatcaatcatggggtgtttggtgtgggcctctacttggctgcgtgggtgatcgcctgggcgtgatcagttacaaatggatctgtagatcagcgaatgaatttaacgtacacccgctccgggtcaccttcgtcaaggttctcgatctgcccgctggggacaaacccggccttggtcatgagtgcctgggatgcggtgttggaagcgttggtcgaggcgaagagcttgggcgtcttgcaggccgtttcggctgccgccagcagacgcagggccacaccctggcgctggtgcgcgggtgacacaaccaccagcgcgacgaagccgtgatcgaaaaagtcatgggtgagcaccaggtagccggcgcatacgccagcgtcgacggcgaccaggcattgctggcgaaccaccgcgtcatagataaacacgcgacggctggcgtgggcggtggcgtaggcatccagctcgaccagggcatgcacatcatcgggcatggcctggcggatcagccaatgtggggttatccagccatcttgccgatcggtcacagtaatggtgttgcgtacagtggcatggagaggttccagataatcagcgttggtgaacctatcatacggggttgcccactctcaatcggcacacaccagggagggcttacgatggcttttgcccaagtgctcgtggcgtgtgtactcatgcccagtgatgtgcgtcggcgctgtgccagcgctgattgcctggtcatgcaacgctgcttccagcgcttgaagatgccgcgagaggatcttcaccgacccactcgggttggccgggtcgaacgggatcctgccattggcaatcaacaccatggccagttcccaggcgcgttgtgagtcgttcatcaggccacctccttggcactttggcaggccatcatctgggtgtatgtgtcgttgtattgcatgacggagctccttgctaaacgggactgatataggtgtgacccgctcaagaaggctcggtatcaactgggttgccgtcgaaatttcgatcatttcaacgattcagttccgcccaaaccatcttctttttagatggtggctgggttgccccgtgaaagaatgaacccgcgcggccccacgcacacctaagaggttatgaaccggacccggggacagggtatgaagccgccagaccatcgtgacctgcatagccgcaattacccggtcagcgaggacatgaccttgcaacgtaaggtctggcgcttcgagcgatggggttggtatgggttggtagtgctaatgggcttgaccctggccggcctgttttccaagggcccattgagcagtgccgaggtacgcagcgccgatgggcagctgcgtgtcgagtaccagcgcttcctgcgcaatggtgctaccgatgcactggtgattcatgtgcaaggccgggcgcgtgagccccttgaagtggagctcagtggcgcgctgttgcagggcttcaatgtgcaaatgctgcaaccccagccgctcaaggccagtacggcaggcgatggcatgaaggtgtgggtgctgagcgacaacgacggtcatgcggtgcttcacgtgaccctcaacagcgacggtgttggcagctttcaaaccaaggtggcgctggcatcgggcgcctcagttggcctttcccaattcatttatccctaggggcgaccatggactctgtgttgcgggctgcggcgatttacctggtactgctggtgctgttcaaggtggccggcaggcgcacgctggccgaactcaccacttttgacctggtgctgttgatggtcattggcgaggccacccagcaggcgctgctcggtgacgatttttcgctgaccaatgccgtgatggtgatcgtcaccttgattgccatcgacattggcttctcgctggtcaagcagcgctcaacctggttcgcacgggtgctggatggtgggccgacggtgctggtcgaggagggccaggtgctgcacaaacgcctcaagcatgcgcgcctggatgaaggcgacatccttgaggcggcccggtccacccaagggcttgtcgagatccggcagatacgcttcgcgattctggagcgcaacggcaagatctcggttatcccctacgaataacatcctggttggcgcttacttcccttcgctcgatggatgcgcatccattcttgatacgccgccgtgcgttgcgcatccgcgagcttcttggcttcggtgaaacgcagccaggttttcgcatcgccgctgtaggactcgatgatttgatacgccaaggtatcgagccgatcggcttcgaaaaacatccgggtgttctgcgctatttcgtcttcccatacctgtccaggcgtgtagtcgagcgtctggctgttcattgtgtcaaatcctccgcccactggagttgcgccgcaccgcaccagcgcacatcagtgatgccgtatttttccgccatcggtttggaaacgcgcttgaggttgttttgcccgaacctcggtattaccgccacaccggcatcgcaacttgcccaatgccaggcgtcggcgttattcatttgcggcgcacgcaaaatgaacgacttgggcttgccgtgaagttgatactcgatggtaaacagttcgttggttttcatgaggcctccctaaactcatgctctacagatatttgacgccagaaaaaattcagaaagattgtcggacacctcgatagctggcacttcggtggtcagcggtcagtgccggtggggagtctgggtcgggtcgtcgatctggataatcctgccttggcgccaggcgtccgcccctggagcaatggcgggtgtggcgatatccgcgcgtgcggccttcttctggttgctgtctacgcccaggcgcttatcccgctcggcgaccattttcgggtcggcctggccgtcggcggtaaaccccatcatcagttgcggcacgcccaatggcagctgcttgtgaaggtccgtatgccaggtgtgccaggtcttgccataggtatgcacgagtttctccatcagggcatgttcggccacttgtggaatgcccggtgcaaccaactggcctgatttgacctcatgcacgtggctatgccacagcgccttctcctgcgcgggcagggtgttgaacagctgctcactgatgatgtattcgacacccatcagcttggcatccttgcggttgccgtcgtagatcacgcactggatcacttcttcattgaggatcgcgcagtagtggtgagcttccatctgcacatcggggtgcccgttgtagaaatggaagccgtccaggtaggcattcaacgcatccaccggcgggcgcgattgcagcaccgcagcgccagcatccagggtgcgcgtagtgggcgacttcgcgtcaccgggcgcaaccacgttggacggtgagttgttgctggcgcaggcggtcagcaaggcaatggacagtgtcaggctgagttttttcatcgtggattccctccatggtcggtgaggctgtaccgagggttagaaggcttggccgcgcaggtgttcaaccggattggcgagcggctgtcgataggccccgcgtcgccggggatgcagcccaagtgctaaaagttttggaacactggtcagcgagatgggtcatttttcataggtgttaaatagcacgacagcgtttggctcaggcaagcctgtcgaagtggatggcacctcggcccgcgccggctgtgtggcgattcccacggaaaacacccatggctatgaggtgattgtcgacggtgcgatccaagcgtgcgcacagaccttggccgactacctggccacgtactgaaccagcatcaggctcgcacacgacgtgcaggaggataaaaccgtgtctatcgccgtttccacgattgactacctgaaacaatacgatatgacccttaccacggccgagtcctgtacagcggggaaaatcatcaccctgctgtcggaagtcgagggcggtggggcgtgtattgagagtgggtacgtggtgtattcccctgaagccaagcagcgtttgttgggcgtgcgtgcgtatatgattgagaccttcaacctcaccagttgcgaggtcgcccgtgagatggccgcaggcgcgatgcacgacagtccggcggacgtggccgtggccaccaccgggctgctcggccctgacgacatggatggcattccagccgggaccatttgcttcgcctgggcttatcgggtggggcagggggtgactattttcagccgcaaggaacgctttctgggttcccgtgagcaggtgcagctttacgcggcggagcatgccttaaagtggctggcacattttcaccagcgcgtcctggccggcgagcaaggctagcgaaaccttatttgaccggctgcgacgcccattcaccgccggctttttcacagtcgatcttggcttggaccagatcattggcggcgtagtagtaggtcactacgcgggcattcttgggcagcaatgcgccttcgtgatccggtgccttggacgtcgaatggggattggccagggcctcctgggtcggcgtggccttgcaactggcgacatggttgctggcacaggccgcgaccttgtttttcgtagtgggcatcatctccttgttctcgttgctgcaagaccagtcgatggcttcaggcggcatgccctcgtagcggtagcaggtatgttgctcgaccgtcggcacctggtcgctttgcccgcgtgtaaccacatcgcaggcgtcggccagggccgtcgaggacgtaaggatgagtagcaaggtaaacggcagtcggacgttcataaacctaatctccgcgcttgcttgaaagggcgagcagatgcgccgcttcgtaagcattggaaaaggccacgagcactaaagtttgaacaatttgcgcaagcctcgacgagcggctgaccattcgtctaagcccgcgccgatttgttgaacgcccgcgccttcgttccggacagatacagcaagggccgacgaacgttgctttcgtctggcgccctggatatcaatcactcagcagcaggtgaaccatcatgaagaagctctatatgtgcctgggattgtgcagcgcgttcatgcttcacggctgttttgacagttccgacaacaccaccaaggacaacaccagcgggaccaagtcttcggtacagatgcaggaaggcaaggctgaggaaagcaagtagaggcccctggactaaatgtgggagggggcttgctcccgatataggtgtgtcagtctatgcaactgtgactgaactaccgccatcgggagcaagccccctcccacagttcatacatcactcagcgcatatgcaggatgatcgggctgctactcgcagggtcggtatgcccgcgcaatttacccacagccttcgcattgatcgcgccaccgttgttgccccaggtgccgcgtacatagctcagcacgtcggcgatttcttgatcggacagttgctcacgaaacgccggcatccggtaggcgtccggcatcccggccgccaccacgcgttgcgagccgttgagggtgatgttgatcgcggaggcgtcttccttcgccaaggctgaagtggccccagccaatggcggcatccactccggctggcccttgccgtccaggccgtggcacgaggcgcagcgtgtggcataggtatgggcgcccgggttttgcgccggggtgttggcgaccgcctgatactgccatggtgagccgtcacgctgcgggtcgccgggcagtgacttgaggtaacgagcgatggcggccaggtcatcgtcctgcatgaactgcgtggagttgttgaacgcttcggtcatcgaaccgtagaccaccgcatgggcattacgcccggtcttgaggaactgcacgatctgcgcctcgctccagcggcccaggccggtgttgtggtcctggcgcaggctcggcgcgtaccacccgtcgagcagggcgccggcgaggaacggcgcgccggactcatccagggctttctcgttgaaggccaggccacggggtgtatggcaactgccgcaatggccgggaccctggacgatataggcgccacggttccacagtgcatcctggccgggcttggccgcataggtggcggtgggggcgaacacgccgttccacaaagcgatgggccagcgcatattgagcggccagggaatgtcactggggatgttcgcctggttggcaggttgcacgccttgcatgaaaaacgcgtacagcgccttcacgtcgtcatcgctgagctttacataggacgggtagggcatggccgggtacagccgtcgcccgcccggcgctacgccgtggcgtacggcgcggtcgaagtcggccaggctataggcgccaatgccatgctcgcggtcgggggtgatgttggtggcgtgaatcgcccccagtggcgtggccatttccaggccaccggcaaagggctgcttgccggcgaggctgtgacaggccacgcagtcactcacccgcgcaacgtattcgccgcgactgaccaaggtgggctcgaaacttgtagcctgttgctgttcaaaaggcgaagcgggctggtgtgtgacgtaccaggccagcaggcctgcggcgaccacgcagggcagcaccagccaccctgcggttcttgcgaatcggcggttgttcatcggcgttccctgtcggttagctaaaggtgtagcggctcaatggcagactgcggatgcgctggccggtcaactgcgccaccgcgttggccacagccggcgccaccgcgggcagcggcggttcgccgataccgcccatcttttcgccactctcgacgatcttcacgtgaacctgagccatacgcgagggcggcaggatcggatacaggtcgtagttacgtgctcgtggcataccgtccacgtacaccgcttcctccagcaatgtttgcgacaggcccaaggccacagcgccgctgacctgggcttgaatgatcgccgggttgacgatgctgcccgggtcgatagcctcccagatatggtggaccttgacctggccgttctcgatcgacacttcggccactaccgccgcgtgagagccaaagggtgaggccatggccaccccgcgagcacggcgcgtgccgtcctctgcggtgtaggggccgcgcttccagccccccgacaactcgcccacggcttgcagcaaggtggtcaaccgggggttgtcacgcagcaagtgcaggcgcagctcatacgggtcgtggccgcctttgtccgccagctcatccaggaacgcttcatagaaaaagtcgttgagggagttacccaccgaacgccagtagccaagcatgggcgcgcccttgacgtagatctgcgcgatgcgcttgttggggatcgcataactcttgcccgacaggccttccagggcggtagggtcgatctgctcgccctgtttgccactgagggcttcagtggggccttcggtggcgctgaccgcttcgatggccaccggcaggcctttgtcatccagtgcggcgcggaatttgaccacggcgactgggcgcagcacatcgcgcaggaactcttcctcacgactccagatcagcttgatcgggcggccgacggccttggccaacgcgatggcctgtgggtacgggttggctgagtcatacaggaaatgccgaccaaaaaagccccccagcagtggcgagtgcagggtgatttgctcgggggccaggcccgtgcgcttggcgatgtcagcacggaacatatccggcgcctggttgggcagccacacctccagggtgccgtccgggttgaagcgcgccaaggccgaaggcggttccagttgggcgtggttgaggtattgattatggtaggtggcttcgactcgggtcttggcgccggccagtgcaccggccacatcgccttcgttttcgtcatcgcgggccgggccttgctgggcggcaaggaagtcgcggtgcttgtcgctggaaaagtctgccggcatcgcccgcacggtcgagtcggcagaggcttcctgccattcaacctggatggcctcgaccgcacgcttggcgtgccaccaacgttcggccaccaccgccaccgcgccgggcaaggtgtgaaccgaatgcacgcccgtcatggcttggacctgggcctgattgcgcaggctgcccaccgtcatacccaggcgcggcgcgtgctggacggcggcgtggagcatgccgtcgattttcagatcgatggtgtagagcgacttgccagtggatttgtcataggcatccaggcgctttaccggcttgccgatccagcggaactggctcgggtcgcgcaacgtgatggtggcggggtcgggcaccggcatgtccagggcgcggccggctagctcgccgtagcccacggagcggccggacgcggcgtgtaccacgcggccaggctgggtagtcagttcactcagcggtacgcgcagttgctcggcgccggcttgcatcagcatggcgcgggcgagggcgccgaggcggcgcatggtcgggtagctcatgcgcaccgacatgctgccgccggtgatgcgcataccgttttccatcaccacgtaggcttcaccgggcggggccgcttcgacgataaacgtggcggggtcggcatccagttcttcgccgatgatctgtgccatggcggtatgggtgccctggccgccctccatgaaggggctgagcaggcgcacgctaccgtcggggcgaatctccaggaacgccggcacttgggtgccgcgttcagctgcgccgccggtagcggcctgcacgcgggacacaccgaggggcaggccgaagccgatgaccagcgcacccacggcggtactggcgaggaagcgacgacgcgacaggttgatcggctcgtccagcttaacgcccggcaggatctcagacatgttcatcaggcggtctccttcccggcagccaggccatccatggcggcatggatggcgttgtaggtgccgcagcggcataggttgaccattgccgcatcaatctgcgctttggatggagtgggggtgtgcttgagcagtgcagtggccgccatcacttgcccggactggcagtaaccgcattgcgctacctggtgctcgacccaggccgagaccacgcgtttgcctaccgcatcggcctcgatggcttcgatggtggtgatctcacgcccgatcaccccggctaccggcgtgacgcaggagcgcaccagattgccgtccaccagcaccgagcaggcgccgcactgggccaggccgcagccgtacttggtgccggtcagccccagattgtcgcggatcacccacaacaagggggtgtcggcttcggcatcgacttgataggccttttggttgatacgtaattccatggctcacctgctgatcaacggttggtgctgctgagttcttataggagcggtgcgactgtacgtcgcccatcgtcgaactctagaccaccgcgcaacagctatctatgcaattgccttcaagtccagaggatcaggcaagaattcaacaggattgggtcacatccgtctgtaggagtcagcttgctcgcgaaaaacgtcaacgataacgcgtgtttcctgaataaacgcggcacctatgggtttttcgcgagcaagctcgctcctacaagagccttcatcagccgtcagcaaattgaaacccgcctgacagtttttccttcaaataccccaccaacaccgtcaccgacctgggcacatggggcgaatagggccgtatcaggtaaatctcatcggcaaacgcaccctttagcgtccaccctttcaacacctgcaccaacttgccgctggctaaagcggcctgggcactgaagtctgggagcagggcgatgcccaggtggttgagcgccgcgtcacgcaaggcttcgctgttgttggtagaaaagctgccggcgatgggcacggtgacgcgctggctgtttttaccgacgcgctcgaaggtccaggccggctggtcgctgccccgtgggtagtagaggcagttatgcgcgctgagatctgccggggttcgcggttcgccgtggtgttgcaggtagtctcgagtggcgaccaataccgaggtggtgtcgcacagcttccacgccacatgggtctccggcacctggaaaccatggcgcaccgccaggtcgtaaccctcggccgccagtgagctcaaggcgtcggacacatcgagctgaatgcgcacctgcggatactgctgcaaaaaaccggaaagatgcggcaccagttgttgccgggcgaacgccaccggggcggtcaggcgtaccaggccgcgaatttcgccgaccgaatcgcgcaccgaggagaagctgcgggcgatctgcgcgtaggcgctgcgcacgtcgcgggtcaatgccaacccggcctcggtcagtcgcacgctgcgcgtggtgcgggttaccaggcgcgtgccggtggctttctccaggtcggagatacgctggctgaccgcggatttgctcaccccaaggcgggcggccgcagcggtgtaggtgccgtgttcctccagcaccgacagccagtgaatgtgggtccacaagccttcgatctcaaccttttccatgagtgtattgttcgcctgtcaggacaataagttctggattctgctctggtttggaacaaatcgaaagcctatcgtgtgttccaacgctacccaccggggatccattgccatgaccaccaccatcgaacactacatcaacgaccagcgcgtcagccgcgatgatcgctaccaggacgtctacaacccagccaccggcgaagtgaccgggcgcgtggccctggccagccgccagaccgttgccgaagctgtcgatgccgcccaggctgcatttgccggctgggccgacacgccgccgatccgccgcgcccgtgtattgttcgaatacctgcacctgctgcgcgaacgcaaggacgacctggcgcgcatcattgttgccgagcatggcaaggtcttcaccgatgcccaaggtgaagtcgaccgtggcatcgatatcctcgaattcgcctgcggcattcccaacctgctcaagggcgagcattccgaccaggtgtcccgtggcatggacaactggacgatgcgccaacctctgggcgtcgtcgctggcgtcacgccgttcaacttcccggtgatggtgccgatgtggatgtaccccatcgccatcgctgcgggcaacaccttcatcctcaagcccagccctactgacccgagtgccgcgctgttcatggccgagctgctgcgtgaagccggcttgcccaaaggtgtgttcaacgtggtgcagggcgacaaggagtcggtggacgcactgatcgaacaccccgacgtcaaggccgtgagttttgtcggctccacgcccatcgcccagtacatctatgaaagcggtgcccgtcacggcaagcgcgtgcagggcttgggcggggcgaagaaccatatggtggtgatgcccgatgccgatatcgagcgtaccgtcgacgcgctgatgggcgccgcctacggcagtgccggcgagcgctgcatggcgatctcggtagcggtgctggtcggggatgtgggcgataaagtcattgccgccttgaccgagcgcgccaagacgttgcgcatcaccgatggccgcgatttgaaagccgagatgggcccgatcgtgtcgcgggcggcgctggagcgtatcagcggttatatcgagcagggcgtacaggccggcgcgcacttgttgctcgatggccgtgactacgtgcccaccgagcctggcctggaaaacggcttctggctcggcgccaccttgttcgaccacgtgacccgcgacatgagcatctaccgcgaagaaatcttcggcccggttctggcctgtgtacgcgtgaatgatttcgccgaggcggtaaagctggtcaacgaccatgagttcggcaacggcgtcagctgcttcacccgcgacggcaacatcgcccgcgaattcgctcgccgcattgaagtgggcatggtcggcatcaacgtgccgatcccggtgccgatggcctggcatggttttggtggctggaagaagagcctgttcggcgacatgcatgcctatggcaccgagggcgtgcgcttctacaccaagcagaagtcgatcatgcagcgctggtcggagagtatcgagcaaggcgcggaatttgcgatgcctgtctcaaaataaggtctcacaggcactgtagatccaaatgtgggagggggcttgcccccgattgcagagtgtcaggcactgtaaaagtggctgatacaccgcaatcgggggcaagccccctcccacatttttatgtgtgttgccctgaattgacctgtagagcataaaagtccagtatggaattataagtacaaattcatcgctacacgtttttcttcactcttgccaaaccaacaacaacccgcgagaacccgatcatgaagaaacgccaccttatccccgccctggccctgagcctgtttgccgcaagccacttgctcgccgccgagaaacccctacgtatcggcatcgaggccgcttacccgccgttcgcctcaaagaccggtgacggcaagatcgtcggtttcgactacgacatcggcaacgccctgtgtgcgcaaatgaaggtcaagtgtgtgtgggttgaaggtgagttcgacggtctgattccgtccctcaaggtcaagaaaatcgacatggcgctgtcgtccatgaccattaatgaagaccgcaagaaatcggtggatttcacccacaagtattacttcacctcctcacgcctggtgatgaaggacggcgcggtggtggatgaccagtacgccagcctcaagggcaagaacgtcggcgtgcagcgcgccaccaccaccgaccgctatgccaccgaggtgttcgaacccaagggcatcaacgtcaagcgctacagcaataatgaagaaatctacatggacctggccgcagggcgcctggatgcgatctttgccgacaccatccccctgagcgacttcctggcgatgccacgcggccagggctacgcctttgtcggcccggagctcaaggatccgaaatacgtgggcgagggcgcggggattgcagtgcgcaagggcaatacggcattggtcagcgagttgaatgcggccatcgatggcattcgagccagtggcgaataccagaagatttcgcagcagtacttcaagaccgatatctacggagactgaaggtcactgcggcgaacgggtgtggcgggcgttaacccttcaactccttcaaatgcttgtagaccgtcgcccgccccatacccagcacattggccacatagttggaggcgctcttgcccttgaatgcgccttcggcatgcagcgccagcaccagttcacgcttgtggtcgcgggtcagcaggttgaggctcagctgacgctcgcgcagccaggcatgcaggaacgtgttaatgcgttcctgccaatcatcgcgaaacaatgcatctggctgggcgatcagcttgcttggcgacaggaacaggtccagtgctgccttggcggtttcaaacatcgagatattcaggttgatacacaacacggccagccggcggcctttgtggtcgtgcagcacagtgctcaggctgcgaattttctgaccgtcccagttgagtttttcgtaagggccgatattcacttcgctgacgtcaccgtccagcatgtcctccagcgacgaatcatcacccaagctgcgtttagacaggttgttggcgatgtagtcgacggtctgcgtgcgcaaatcatgcagcaccacttccgcatggggaaagaacagggtggcgatcgcatcggcgatcccacggaagttctgcatgacggtgtcttgttcggcgatggtcatcaatggggctccaggcggacgggggagagcataccagcgtccaggccgaatcgcgtcagcgcctcgggcagcggcgcgccgcgcaccagtgcggcgctggcctggcccatggcgggcgacgtctggataccataaccaccctgtgctgccacccagaacagccctggcacctgcgggtcaaaaccgcagagcaaatcaccgtcgtgcacgaaactgcgcagcccggcccaggtgcgcgtggggcggcggatggtcagggtggtggcctcttcaatctggtagatgcccatggcgatatccagttcttcgggctgcacgtcctgggactccactgggtcggcgttggccggcgagccaaggaacatgccggcatccggcttcatgtagaaggcttcgtcgagggctaccagcattggccagccgtggctgtccaggccgtcggggccggcgaagataaaggccgagcggcgcttgggttgcaggccgatggacgccgcgcccgccagcccgccgatatggtcggcccaggcgccggcggcgttgatgatgatcggcgcacggaaggttgcatcctgtgtacgcacctgccagcaaccgtcggcatcgcgactcaggcccagcacatggctgtcggtgcgcacctcgccgtggttacggcgtataccgcgcaggtagccctggtgcagggcgtcggtgtcgatgtcgcaggcggtggggtcatagatggcaccgtggactttttcgcggcgcaggatcggcagccgtgcacaggcgtcgtcggcactcaggcgttccacctgttcgacggtagccttggcgttcaggtattggctgtccaactccgccggatcgccgttaaagtcgacggtcatttcgccccggggtgtgagcagcgggtgctcgcagaagcccgcaggcggttgatcgaaaaacgcccggctggccagggtcagcgcgcgcacttgcggggtgccatacgcggccgtgtagagcgccgccgaacggccagtggagtgataggccgggtggttttcgcgctccagcaccagcacattgccgtgctgcgacaaccagaaaccggtggatgcgccggcaatgccgccgccgatgatgatgaagtctgcctggtgcataacaatctccgggttagcgttgcagttggtagagggcattggccaatgcaatgtcttccaggcccaggccgatggagcggaaaaatacaggccgatcgtagtttgggcgttgcgccatgtcgctgagcaattcgggcaagtcaccgagcactgcgcgcgcgtcccagccgtgctgttcgctggcgatcagcatatcgccggccgcgcccggagtggtctgccgatagtcgcagtacacctgcatctggttgaggcacgccgggggcacttcatgggctcgcggtgcattggtgctgatggaggtgatcagcgcgggcttgcgcaagcgcatcgggtcgatcaccgggcctgccgatgaggtgcagagcatgatcacatcggcgtcctcaacggcggcatcgcaagtatcagcgagggtcaggcgcgggtccaggctggtcaactgtgtacgggtgtcggcgctggagctgccaaggctgggggaatacaggcggatgtgctgccagtcgcgcaggttctgcacataacgcaggtgcgcctgggcgaccttgccgctgccgatgatcgccaggcgctgcgctgtcgccggggccagggcgtccaccgccaatgcggtggtcgcagcggtgcgcgcagtggtcagttcagaggcgtcgcacaatagcagcggctggccgctgtgcatcgacatcaacagcgtccacgccgtcaccaggggcccgtgctcacgcacgatatagggtgaggtcttgaccccatacaccccgtcctcggccagcacccccaggtagttgataaagtcaccggcaccgtgggggaactccacccactgctgcggcggttgcacggcctgcccggcggccaggtcgcagaacagcttgcgcagataagaggtacatcgatctgggcgagcaatgcccgcgcctgaacttgatcgatgatgaggggggcattggacatggatgtctccagggaaactaatttgtctattatggacatttagttcttgtacgcaataacccctggaaaaaatggagatcaatgtgggagggggcttgctcccgatggcggtgtgtcagtcacaaatgtgcttactgacactccctcatcgggagcaagccccctcccacagttttaaccgcgtttcaggcagtggcttttgtgcaggtcaggcactcgatggagcgatccaccgtggtcttggcaatttccagcaaatgccacaccgccaggatcttcgcgtgctcggggctttgtagcagctcgccgcagtccagcgcggtggcggatgcgctgtcgagcaaactggcggtgtagagcagggcatcttcgaagctcaggtcttcgttgacgcagtggaagccttgggtgggcaggtagtggtcgatggcgcggttgaaggcggcgcggtcttttgcgggatcgcggggtgggtcgggtaggactttattcatggtgtagttcctgtctgaatatcaaggagctgacacctttcgcgactaaacgaaggtggcggctgtacgcaggttagtcgaccggtcagaacaggaacccggcgcgcccgagggcgccctgcgcacagccaccataaagcttcatgggagcatgcgcctgttcaaaatccgggcgactaaacccgatcactgaattggcagtgacggaccgcagactagccatcgattccagcaggcacaaggcggcagggattgtctaggaaacgtcctgcaatttaaagggacacgccttgctggccctttaaaaaccatgaccaaatgccaccaacccctcatttgaaatgcagacaaatgtgggagggggcttgctcccgatggcggtgtgtcagtaacaaatgtgcttactgacactccgccatcgggagcaagccccctcccacagttttaaccgcgtttcaggcagtggcttttgtgcaggtcaggcactcgatggagcgatccaccgtggtcttggcaatttccagcaaatgccacaccgccaggatcttcgcgcgctcggggctttgcagcagctcgccgcagtccagcgcggtagcggatgcgctgtcgagcaaactggcggtgtagagcagggcatcttcgaagctcaggtcttcgttgacgcagtggaagccttgggtgggcaggtagtgatcgatggcgcggttgaaggcggcgcggtcttttgcgggatcgcggggtgggtcgggtaggactttattcattgtttagcttccttttggattcaaggagccgaacctttcgcgactaaacgtagggtggcggctgtacgcaggttagtcgaccggccaaaaggcaaaatccggcgcacccaagggcgccctgcgcacagccaccgtaaacatgggtggttcatgcgccttttggaataccgggcgactaaacccgatcactgaattggcagtgacggaccgcagactagccatcgattccagcaggcacaaggcggcagggattgtctaggaaacgtcctgcaatttaaagggacacgccttgctggccctttaaaaaccatgaccaaatgccaccaacccctcatttgaaatgcagacaaatgtgggagggggcttgctcccgatggcggtgtgtcagtcacagatgtgttcactgacactccctcatcgggagcaagccccctcccacagggttctccagtgttggtaagtatgggcttaccgccgacccgcccgcgtactcacatccacccacactgccagcaccagaatgctgcctttcacaatcatctgccaatagctgtccacgtccagcatcgacatgccgttgtccaggctggtaatcaccaaggccccgagcaacgcgccgtataccgtgcccgagccgccgcgcatcgaggtgccgccaataaagcaggcggcgatggcgtcgagttcgcccatgttgcccgccgacggtgacccggcagcgaggcgggcggtgttgaccaggccggcgagggcgcacatcacgcccatgatgccgaagatccacagtttcaccgcctgcacattgatgcccgacagccgtgtggcttccatattgctgcccaccgcgtacacccgtcgaccaaaaacggtctggctggtgacgtagctgaacacgccgagcagcaccagcaacagcagcaccggcaccgggatgccgtcgtagctgttgagggtggtgacaaacccggcgagcaccgcgccgatcagcaccacacgcagcccgtcacgcaccagcgagtgcgcggccaggccatgcagcgcgcggttacgccgttgtttccaggtcagaaaaagcgtcagcgcgaacagcactacacccagccctgcgcccaccgtgtgaggcaagtagccctggcccacatacaccagcgatggcgacaccggcgcgatggtggtgccgccggtaatccccagcaaaatcccgcgaaatgccagcatgccgcccaggccgacgataaacgaggggatgcgcaggtaagcggtcatatagccgttggccaggccgatcatcaggccgcacagcgccaccaggctgaggttggccagcagcggcacgtgatagaccacgtcgaggatcgccgccagcccgcccagcagcccgagcaacgagcccaccgacaaatcgatctcgccgctgatgatcaccagcaccatgccgcacgccaatattccggtgatcgacatctgccgcagcaggttggacaggttgcgcggggtgaggaagccgccctcggtctgccagctgaaaaacagccagataaacgccacggcgatcaccagcgcgagcattttgtagcgggtgaaaaggtgtttgacctgattcatctacagggtcttccgaaggttattaggttggctgagcgccgcggcgagcacctgttcctgggtcaggccggcattgacgaaatcgccccgcagctggccgtcgcccatcaccagcacgcggttggatacccccagtacctcggccagttccgaggagaccatgatgatcgacacgccttcggccgccagcgcgcccatcagcttgtagatctcgtacttggcgcccacatccacaccccgcgtgggttcatcgaggatcagcaccttgggcttggccatcagcattttcgccagcacggccttctgctggttgccgccggagaggctggtgataggcaggaacgggctggcggtcttgaggtgcatacgcgcgatttgctggtcgatgctgcccagttcggcctcggcgtcgatgcgggtcaggtgcgcataggtatcaagtaccgccagggtgatgttatggcccacacccaggtcggggatgatgccctggcgcttgcggtcctcgggcaccatgcacagcccggcgcggatcgacttgagcggcgtgcgcgtgtcgatcagctgcccgtccagccacacctcggcgctgtagcggccggggtaggcgccgaagagtgccgacaccagctcggtgcgcccggcacctaccagccccgcaatgccgaggatttcgccgcgtttgagcacgaaggaaatatcgtcgacacgcttgcgcttggggttgtcgacgtcgtagcaggtgacatggcgcgcttcgaaaatcacctcgcccactgcatggggttcggtggggtagaggttgctcatctcgcggccgaccatctgcgtgatgatccgggggatgtccatgtcagccatggctgtggtcgcgatatgcttgccgtcgcgaatcaccgcgatggtgtcgcacaccgctgccacttcatcgagcttgtgggagatgtacacgcaggccacgcccttggccttgaggtctcggataatgtccagcagcacctcgatttccgaacgggtcaacgccgaagaaggctcatcaagaatcaacaggcgcgcctgcttgtttagggccttggcgatttccaccagttgctgatagccgccgccgtactgcgacaccggcagcgccacattcatgtccggcaccttcagctcgcgcatcaaggcttcggcacggtgcagcatcgccgggtagttcatgcgcccgccgggcagggtcagctcgtggcccatgaagatgttttcggccaccgacaggtccggcaccagggtcagttcctggtgaatgataacgatgccggccgcctcggtttcgctgatggactgggccttgagcggctgcccatcccaaaggatttcaccctcccaggtgccgtaggggtagaccgccgacagcaccttcatcaaggtggatttaccggcaccgttctcgccgcacaggccgacgcattcccccggtcgtaccttgatgtcgatgccattcaacgccttgacaccgccaaagcttttgacgatgccgttcatttgcagcaggtagtgcgacatgacgatggctcacacaaaaggccgataaaacacgctcactgtaggagcgagcttgctcgcgaaaatcgcgcaggcgacgcgggcctgcctggcagcgctgcgttatcgttggcgcttttcgcaggcaagccagctcctacaggccgatctgctctttggtatagaacccgtccttttccaacaggtcgatgttggccttggtcaatggcgtcggggtgagcaggatggtgtcgaccttcttgctgccattgtcgtattgcgagctgtaggtaggtttttcgttgcgcgccagctgcaccgagagcttggcggcttcggtggcgatcagtttgagcggcttgtagacggtcatggtctgggtgccgtcgatcacgcgcttgacggcggcaaggtcggcgtcctggccggagatgggcaccttgcccgccagcttctgcgcagccagggcctggattgcgccgccggcggtggcgtcgttggacgcgacgatggcgtcgatcttgttgtcattacgggtcagggcgttttcgacaatgctcaaggcttcggtagggttccactccttgacccactgctggccgacaaccttgatatcgcccttgtcgatggccggttgcaggaccttcatctggccttcgcgcagcaccttggcgttgttgtcggtgggtgcgccaccgagcaggaagtagttgcccttgggcgccgcctgcagcacaccgttggcctgcatctcgccgactttttcgttatcgaaggaaatatacgcgtcgatatccgcgttgaggatcaggcggtcataagacaccaccttgatcccggccttcttggcttcggcgacggcattggtcaacacggtggcattgaagggcacaatgacgatcacatcgacgccccgggagatcaggttttcgatctgggaaatctgcttctgctcgttggcatcggcggactgcacgaacaccttggcgtcgagtttttccgccgccgcaacaaagtaatcgcggtcgcgggaccagcgctccaggcgcaggtcatcgatggagaaaccgatcttcggatgagcagaatcggccatcaccggcaaggcaagcagggccagggtgctggcgagcagggtgcgtttgaatgatttcatggtggtgcgtccctttattgttgttggaaagacacaaggtgatgcgggtagaactgtagagcgtcccttgacgctctgtgcatagatttgtcgtgcaaatgtcaccgatagataaaccgattcacaaccccctccagcatctcctgccgaccactcaccgcctgcgggttcagctcctgggcaaacgcatgctcagccagggactgcaggctgaactcacccgccagcaccgcctggcccaacggctgctgccaaccggcataacgctggtccttgaactgctgcaagcggtcgtcctgcaccatcgccgccgcacgctccagggccagggccagcacatccatggccgacacatgcccgtggaacaggtccacctcgtccaggctctggcgccggaccttggagtcgaagttgtagccgccgttcttgaagcccccggccttgaggatttcataggtggccagggtcatttcctcgacgctgttgggaaactggtcggtgtcccagccgttctgcgggtcaccgcggttggcgtcgatgctgccgaagatccccagtgacacggcggtggcgatctcatgatgaaaactgtgcccggccaatgtcgcgtggttggcctcgatgttcactttgatttctttctccaggccgtactcatgcagaaagccgaacaccgtggcgctgtcgtaatcgtactggtgcttggtcggctcctggggcttgggttcaatcaacaggtcgccggtaaagccgatcttgtgcttgtgctccaccaccatgcgcataaagcgcccaagctgctcgcgctcgcgcttgaggtcggtgttgagcagggtttcatacccttcacgaccaccccacagcacatagttggcacccttgagccgcagcgtggcgttcatcgcactgaacacctgggcggcagcgaaggcgaacacttccgggtccggattactcgcggccccggcggcaaaacgcgggttgctgaagcagttggcggtgccccacagcagcttgatgccggtctgttcctgatgacgctccaggtgatcgaccatctgcgcaaagtggttacggtactccttgagcgagctgccctccggcgccacgtcggtgtcgtggaaactgtagtagtcgatacccagcttggaaaaaaactcaaaggccgcctccgccttgccgatcgccagctccatcggatcgccactgcgttgccatgggcgtttgaacgtgcccatgccaaacatatccgcccctggccacacaaaggtgtgccagtaacaggcggccatgcgcaggtgctcccgcatgggtttgccgaggatgagtttgttggcgtcgtaatggcgaaaggcgaggggggattcgctggcagggccttcgaagcgaaccttgtcgacaccggggaaatacggcatggcggtttccttattgttcttggcggtgcctggatactagcaacggcacctggggtgctgattatgaaaatcaccaaggtgtagtgcgattttgagtggaggggtcagaacggctcagggagtacaggatttacggaaacgtctgactttacggtggggatatgcctcttcaaggtttgggtgttgatcaactttagctaagtggggcagtaaatgagcaaaggacactatgttgttttaggtgaccaaacgacgtgcggcggacgaattctcgaaggtgatccaacattcaagttacgtggccttcaccgtgctctggaaggtgctcgggtcacttgcggaaatcatgccggaagttttcgaatcctaggcggcatttccaatatgaggcgtaatggaaaacgtgttgctggcacgctggatagcgtgagcagttgcccctgtggagcccggttgattccttcggtattaacggccacctacgaaaagcgagaagcagaaccgccagcgagtcagcgggttgctcaaccgggcgaggcaactgtaaacggtaacccagtgacatcgtctcaatctgctttcacgccttccgatcgtgcagtgccaacggtagtcaacagcgtgcagggtcaggaaccaggcttctatatcgtgcccaagagcatgtctcgcgaagcactggaagcggcacttttcccgacgctcgacccggctgtgatgcgcaagtttcaatcactgaattccaacacaagctacgtcaaagccggctcgatgattgtgctcagcgatccgagcaatacctcctgcacctaccaggaagcgcaactgatgcaggccgctcgacaggtcgaggcctccctggatgccttgacgccagacgaggccgaattcctgtttcgccacggcgctgaaattgccgggtttatcggccatacctcaacctggctcggcgtgagtgcggtggtgatggagaagcacctgagtaatctgcgcgacacactccaggcgatggagcgcctgcatcaggaaagctaccggcagcacggccaccttagatcgccgcagttctttgctgatcgtcagcggctgatgaaccagctggatgcccatttgctcaactccacgcgcttgcgcgggcagacaaccttgggcgatcacccgaagttgaaaacggccctgggtatttccagccgcagcttggtgcatcactgggacaaggcgggcgggccggggcagattccggggtatgccgctcatgttgaggcgacgagtcgggctgcaaaatacatgaagaccggcgggtatatcgggattggtattggcggagtgtcgtcggttctggctattcagcaagtatgtaacggcgattcggatgctgcttgtgagaaggttaagtttattgaaggggggaaatttggtgggtctactattggtggttatatgactggaaagatcgcccaatcagcaagtggccccatctgcttggcgcttggcgtctctacgggtataggtggcgttgtttgtgttgcggtcgttgtgggagctggaacttggctgggtacgactgtcggtggtatgaagggtgaggggttaggagagaaattgtatgagaaaactttgccatgataacggaggaattttggaggtcttggctgggtatctgccttgtagctggcccattcctgcttggacttaccagcgttgtatatagtctgtatctaagccgtcgccatttggactccataaaagctgctttgaagaacagtcgttatgtgtatctttgggggccgagcctaggaacgcgaggtttagtatggtccctcttggagatagcaaaaattacaggaatggtaatgatgcctagggcatatatccgtctgggagacctcgaccctgtagatctgaaggatttccctcaagatttgaagcttcttttgaagattgattttgtgatgctgactagtggtgtcgtttggctagcgatcatatctgtgctgcaggagctttaatgatttggtggatgggatgctaggtggcgaatacataggcgaaatgatttacgaggctacacagccatgaccagcatcgatacctggccaaggtgggtcgcgatcattatcacgggaggtcccggtctgctctccgtaattggtcttgcttacagtctgtacatgacccatcgtcacttggatgctatcaaggaagctttaaaaaatagtcgctacatttatatttggggaagtagtctagggaagagaggtttgatttggtccctgctggaaatggcaaaaattgccggaatggtggtgtggccgaaggcttctattataagtggggagctggatccaatagaccttcaaaatttcccccctcatttgaaacgacacttgaccgctattactacgatggccttcacagccctaacttggggaatagttgcagccttgctggtgaaatataggtggtttgggtagcgatggccttggctgtaaacgttatcggcgttccaatcgaggcctggacattattgggcctcggttggtacgcctggaggatatatgggtgagaaaattcatgaaattaaccaattatgaccagtattgacgcgtggtcgccctgggttgcgctcatcatagtaggtgctccaatcctgctagcgatggtgagctttgtatatagtttgtatctgcgcagtcgtcatctagatgccataaaagaggcgttgaagaacagtcattatatctacctatgggagccgagcttggggcgtcggggtttgatttggtcccttttggagatcgtaaaaatcactgggatgataacaatgccaaaaacacacatccgtctgggtgatttggcccccatggatgctgaaaattttcctcctcgcctcagacggcttttgaaaattaaagcagtgataatgattggaggcggaatctggtgggctgttgtatttgcgctactgcaattcaggtagcgtacttgaacccgccaagtatcgaacagatacttttggcatatctagtagacgcttgctgcattactggaacagggaagttgggtcgcggctcatacccggtattcggctcgtggaggcggcgagtcgggctgcttttacaggccagtggtcctgtctgcctggcgctgggtatctctacaggtaataggaggtgttatttgtgttgcggtactggttggggccggcgcatgggcaggtacgactttcggtgaaatgggtggcgattacattgggggaaaaatttacgaggcttctcaccatgactagtattgactcctggtcaccctgggctgcgatcatttttagcggggggccttttctgctcgaactcgtgagtattgcgtacagtttgttcctaagccatcgacatttggatgctataaaggaagcattgaagaacagtcgctatatttatctttgggggccgagcctgggtaggcgcggctatatttggtcgttgttggagatggcaaaaatcaccgggatgatagcgatgccaaggacatatatccgcattggtgacttgagccctatcgattatgaaaactttcccccttacctaaaacgcctactgaacctacatttagcaatgatagttggcacgggtgtttggctgataactgtattcatagttttaaagtttaggtagataggacgggcctccctgaggcccgatgtgcccagacagcttccgggatacgacatcgatttgaatgtagctaggcgtccgtagtacatagacctaatctgcacccaccggccccaggacgaaaacaatgaaaaccctaccgcccgtgcaccgcatcgccttgctcttcaacggcagcaaaatctacgaccgcggcatcatcaccggtatcggcaattacctgagcagtacccgcgcgtcctgggacctgttcctggaggaggattttctttgccgtctgcgcggtatcgagcgttggcagggcgacgggatcattgccgacttcgatgacccgctgatcggcgaggcgctggctgggagtcggataccggtggtggcggtggggggatcttacgaggacgtcagcgcgtaccccaagggcattccctatgtcgccaccgataaccacgccttgatgaagctggcctacgagcatttgatcgaggccgggctgacgcggtttgcctgtttcagcctgcccgaagcccaggctaatcgttgggcccaggagcgtgagaaagcctttcgccgcttgatgcaacgcgatggtttgcaggtggagatctatcgcggcctgggcaccagcgcgccgttgtgggacagcgcggtggagcagcagattgcctggctgcacagcttgcccaagcctatcggcattatcgccgtgaccgatgcccgcgcccggcagttgctgcaagcctgcctgaccgccgggattgccgtgccggagcaagtggcgttgatcggtatcgacaacgacccgctgactcgcacccttacgcgggtgccgctgagttcggtgatccagggcaccgagaccatgggccgtaccgccgcggccttgctgcatcagatgttgcatggcaagccctgcaccggcacgcaggtgctggtgccgccggatgcgatcaacgtgcaggcctccagcctgcatcagcccttgggcaacccttatgtgatgcaggcattgctgtttatccggcagtacgcttgccaggggatcaagaccgaccaggttgccgcttatgtcggcgtctcacgctcttccctggaagcgcactttcgcaaggtgcgcggctgcagcgtgcatgatgaaatcctcggtttcaaactcgccgctgccgccaagggcctggagaaccaggacctggccatcgccgacatcgccgccagttgcggtttcacctctgcgcagtacttgcatacggtgtttcgtcgtgagtttggctgtacgccacgtcagtatcagcagggcaggccagttgcagcgcctgttgcatgcttgccagcttgatctgggtttcttcgtactcgttggccggcaacgagccttcgacaatgccgcagccggcaaaagcatggcagtgtctgggcgtgatcaaggccgagcgcagtgccaccaggaagtcaccgttgccattggcgtccagccagcccaccggcgcggcgtaccagccacggtcgaagccttcgtgttcacggataaagcccagcgccgttgccctgggcaagccgccgacggcgggggtggggtgcagcgcctggacgccgtcgagcaggcgcttgccgacattcagttgcgcggtgatgggcgtgctcagatgctgcacggtggccagtttcaacaggccagggcacggcgcggcgtgcaggtcggtgaccttgtcgtgcagggcctgggtgatggtttgcaccaccagttgatgttcatgctgttccttggggtcggccaacagccgctcacccagggcttgatcttcatccggccagagcccgcgacgggtgctgcccgccagggcgtgggtggtgaggcggcccgcgtcgcaactgagcaatcgctctggcgtggcgcccatgaaacagtgctcgccacggtggatggcgaacaggtgcgaggcgttgcggcgctcgtgcaggcggcccatcaccgtgccggtatcgagggtggcgtccagatggtggtcgatatgccgcgccagcaccaccttgttcaactcacccccggcgatggcgtgcagcgcggtgtcgaccttggcctgccattgatgccggggcagtgcgcggcgctccagcacatcgggtgtagaggttacatggggggcggggttgagcaactgttcgtagacggccaggctttcgtgcaccaatgcggcaggatcgctgcccggctcgaccacatgctggcaacgcagccagcggcctgtggtgtcctcgctgagcaaccagtgggcgaggtggaaactggcgtcggcatacggtgcccagtggggcgcacagggttgctgttcatcgaagcgcatgccacccagtagcaacggcgggtagggtccctgcaccaatgcatcggcgcacaatgcaaaccattggcgatccacttcggccatgcgccggggcccgatggcttcgatctgccaggcgcagcccaggccgaacaggctcaggtctggcgagtgtgcgcaccagaagaagccctgtcgatgggctgcatacagcgccaaaggcgccagcgtcggcgcggggtaggcgctgacggcaatcactgggcgctggtacgccaccgcccgttggtgcgcggcctggaacaccttgagtaagtcggtagcgttcataccgccttgctctttttgtgcagccagaacgcggtttgctcggcgatgtaccagtggatgatctggttgaacaggctttcgataaattcgccatccagcccggcgtcctgcgcccattgccggcgttggggcaacatcgctgcgacgcgctccggggcggcgatactggcctggtccggcttgaatgccgaggcggccttgacgtactgcatgcgcaggccgagggcgtcgatgatctgctggtcgatgctgtcgatggcgtggcggatgtcgtgaaggccagtgcagtgttccggggttttcattgtgagtcttcctgaaggtaggcgctgcgctgcaacaggtggtggatcaccggtcgcggctgatgcttgaggtaaaagtgatcgccgtcgaaccagcggatatccgggctgtggcggctcaggtcggcccaggcgcgggcctgttccaggctgacctcggcgtcgtcgtgcgccaacagcacatcgagcggtgcggccaagggcagcaggtgggcggggcgccaggtctcgatggcctggtagtcgctgcgcaacaccggcaggaacagcgcacgcaactgcgggttggcccacaggtcggcggcctgggcgtcctggcgcaggatgtcggcgatcagcgtggtgtcgtcctggcggtgcaggtcgctgggcggttgccggtgcggtggtgcgtgggccgagacaaacacatgggcagcccccatgccagcggcttcaagctgtatgcccacggcataggcaagcgccgcgcccatgctgtggccgaacagccacaggggccgcgcaggcaaggccagcaacgcctggctgatgtgttcggcgaggctcgccaggcacgggatatgcgcctcgttgaagcgctcttcacggccgggatactgcaccgccagcaggtcgatgtcccctggaaggtgcgccagccacggacggaaaaaactcgcgctgccgccggcatggggcaggcacaccaggcgtgcgcggggctgttcgctttcacgcaatgcgcgcagccacgggctcatgaggccaatacctgttcagccagggccttgcggttgaccttgcccaggcgcgtcagcgggaactcgcgcagcacctgcaagcggtccggcaacttgtaggccgccagcccacgctcgcgcagccaggcgttgatcgaggccaggtccaagggttcaccgtgggccagtacgcaggcgcaactgcgctcgcccagcaattcgtcggccagggccaccagcgccacatcgcggatcagcggatggccgagcagcaggttctcgatctcttccaccgggatcttctcgccgccgcggttgattacatccttgctgcgcccctcgacaatcaaatgcccctcgggcaggcgccggaccaggtcgccgctgcgataaaacccgtcggcggtaaacgcccgctggttgtgctcggcggcgttgtaatagccacggatggtgtagggcccgcgcaccagcaattcccccacggcgccgggcgccacctgtacatcgtcggcatcgacgatacggatctcatccgccgtcgtaaggggaaggccctgggtgtcgaagactcgttcctcggggtcgtccagcggcgtaaaacacagcaagccttcggccatgccgtacacctgttgcaggccacagcccagggccgggcggatgcgggcggcgatctcggccttgagccgcgcaccgccgacttgcagccattgcaagctgctgaggtcgtggtcggaccattgcgcgacttccagccacagcaataccagcggcgggatcaaggcggtgtgggtgatgcgttcgcgttcgatcagttcgaaggcggtgtccgggctcggctccggcgccagcaccagggtggcgccgacactgaacaccccgagcgcgccaggcgaggccagcggaaagttgtgcgccaccggcagcgctgccaggtaacgggtgtggccgtcaaaaccgcaggcctgggccgccagccgggcattgcatgcatagtcgtcatgggtgcgtgggatcagcttgggcaggccggtggtgccgccggacaacagcagcaccgcgacgtcccgggcgtccggtgtggggaattggcggggcgcggcgacgcaatcggccaggcccacgaactcctcgggcgcgcccaccacccacacctgttgcaagctcggcaccttctcacgcagggtgcgcgccagcgggcggtaatcgaagcccaggtgctggtcgacaatcacataggccaccgcctggctcaggtgcgccaggtgttccagttcatgttcgcgatgggccggcagcgcaaacaccgggatcacccccaggcgcagcagggcgaaggtcaggctgaaaaactcggcgatattgggcagttgcaccagcacccgctggccggcgaccagcccgcgttcggcgaggccggcggccagtcggtcggcctgttggtccagctcggcgtagctccagcgtcgattgccgtccaccaaggcttcctgctgcggcgtgcgctgggattgttcgcgcagcagttggcccaggggcacgccttgccaatagccttgctcgcggtagcggcggataaagtcttcgggccagtcagtgcagccatcaagcatggaaatctccttgggcagtcgggcaacccagcaactgggcgccgtgcagggtcagcggttgcgtcaggccggcgatttgcaccgcctgtacgccggtaaactcagccggatgcaggtgcaacatcgggtcgtcgcccgccagcaggtcgagggcggtgcggtcggcagggctgacccccaggcgaatcgccgccagcccggtggcgccgttggggtggatcaaccgctccggatgttgggaaggcgtgtagggcgtgaccaggaacggcaggcgcgcatggcgcgggtagacgaaacgaaagcgcgtctggctgccgtccgcacaggtgcgctgccacttcaccacccggcccatggccacgccgcaggccgcgagacccttgaggcgcggcgccagcagttgctcatcgcacagcaaggccaggtcgcagaagccttcgccgtgggcggcccaacgcaacatgcgctgcccggcacctcggccggccaggcagtcgatgggccacttgaacagccaggcgtggcgaggcgtagtgagcaactcgatgatcggcccatggctgaaccagatatgcgcgtgttgggcacgggcctcggcagtggcgtaggtgacctcgaacccggcggagcgaaagttcgccacggcctggtgcaggtcgcgcacccacagcagcacatggctgcaggacgagcgggattgggtagtgttcacaagggcagggctcccaacagttgcgcgccagggtcagcgcgagggggttgcacagcgtcggcgcagcggtgcagctcggccagcggcaatgcccggggaatcggcggttcaattaattcgggcatcccgatcaggctgttcatctcgcgccaggccatcgacacctcggtggcccacagtccgctgcgcaggcgccgcgccggctcgtcgatgtcgtcgcacagcgcgtcgagggcgaggctgaccgcgtcgggccagaggtcgctgaacacctggtgatagctggcgggtatctgcgggtcgagcaccaccatgctcggcccggccagccgctcgctgccttcacctgccatgatcaggcggtcggtgtcgtcccgtggcgcatgcaggcgcgggttccacagcaccgggccgtgggtatcgcacaggctcagcacgccgccttcacagccgacttcaaggcgatgcagcaggaacgagtggttgtcggggtcctggggatgcacctggttttgcacgcgcaggctgatcggcacgccattgaagctggcgttcaatcgtgtgaagggctgcgcaccgacgctggccgccggcgccgcaaatgcccagggccgtaaaccaccggccaggcgcccgagaatatccagcaaggggtaggccacctggctgttacaggccgcgtcgatataggccagcccttgttgctcgcgcaggtacgcggccaccgccagaaagcggcggatcgcaaggatattcgggtacagcgtattcaccgcgtaggctgcctggccctggcgtgctgcctgcatgcacgcggcgatttcgcggtggtgcaccgggtgttcctgcaacacgtggatgccacggcgcaacaactgctgggccagttcgctgccggcgcctccggtggcgccggaacgcaccaccacgcaggcgatatccaccgctgtcggcacctgctcgaccgcctcatacagcggtacgccatagtggtcggcgcaggcttgggagtaggcattgccccgcgacaggatgcccaccaattcatagcgctcatgggcacgggccagggcttgcaggtagatgcggccgaacgcggtgccggcgacgatcacgcgtttacgtgcgccactcatgaccaggtcaccggcaggcaatgggcgccgcgaaagaacgtcgcggttttccactgcacctcaccgcagcgttgcaggttgggcaggcgttccaccaacgcctgcaaggcctcctgcaattccacccgcgccagggcagagccgatgcagtgatgcaggccatggccgaagccgaaatggccgctggcatcgcgttgcaggtcgagggtctgtggatcggcaaagcgcgccgggtcatggttggctgcgccaatcgaggcgaatactgcctcgccctggcgtaccaaagtctcacccacctgaatgtcttcaagggcgtaatgcacaaacattgccgccgatgccaacgggatatagcgcagcagctcttccaccgcctgggggatctgttcgggatgggccttgagctgttgccactgcgcaggattgtccagcagcacctggatgaaattggggatctgcgaggcgctgccttcgtagccggcgacaaggatggcgatgcacaacagcagcagttgctcttcgctcaggcgctcgccgttgtcatcggcctgggccagggcagtcatgaaatcgtcctgtggctggcggcggcgctcggccaccaagcccttgatgtaggccgcgagttcgcccaggtgttgctgggtcagagcggcgtcttcggggcgggttgacagcagcgagtcgttccacagcttgaagcgttcgcggtcttgcagcggcacgccgagcagttcgcagatcaaccccaggggcagcggcaaggcatagtcattgaccaggtccgctggcgggccggcggcgagcatgcggtcgatcaattcatgggcgtaggcccgggcatgggggcgcaaggcttcgacgcggcgccgggtaaacgcctgggcggcgcgggagcggatacgtgtgagttgcggcgggtccatcatcacaatgcctccggcaatccgcgggaacgcccgtggagcgtcgtcgcggcggaacgcttcgctgcggctgaaacgccggtcgcccagcaccaggcgtacatcgtcataacgagtagcgagccaggcgggcgcgccgatgggcatctggatgcgcaacaggcctggcgcctgctgggcgtggcggtaaggttcagccagctccaggtcggtgaaggcgttgaaggggtaggccagcggggtcatggcaagtccttgacgttaggcaggtcgggcaaatggtcgagcagttcaagctgcaggtcggggtgttccaggtgggcggccaaggcggcacggctcaggcgctggctcggcacctgggcggcgaacactcgatggcccaggcgcgccaatgggtgatcggcagcgggcaggctgcgattgccctggaagccggcgcgggccagggcggtctgccactgctcgaggttgaggaaggtgctgcggcccagcgcacgctcatcgctggcctggttgagcatgaacgcctgggacgccatgacccagaattcttcctgggtcggctcgctgaataccagccagccgcccggcttgagcaaggccagcagggtggacagcgaacgctgggtgtcgcgggcggcgttgagcacgccaccggcgacgatcaggtcccagctctgggtgggatacccctgggccacggcggggcggtcgatatcgaacacaccgtggcgcacccatggccaggcgcgcagacgctcggcggcctgttcactgaagtagcgcgacacgtcggtgcacaggtagtccaccgttagattcgccagggccggcaacacggcctgggtggtggagccggtaccagcccccacctccagcacgcgcaaaggttcagttgattggcgtgccgcccaggcgccgatccagtgggccacggcgcggtgctggtactgcgccgccaggctttcgcggtacaacgccgctgcacgttcggtacggccttcggggaacagcaggtgcaccgccgcgcaatcaccgcgcatcagcgccggcaactggcgagcattatcccgcgcatagtcgagggtggcgcagccgccggtgttgtgttcccagtccaggctcagttgtgcccagatagcgtccaggctggcgtcgctccaggcgttggggtcgaggctgggatgcagatggtcgccttggcggcgcagcaaatcctcggcctgcaacacgtccagccagcgtgcgatcaagggccggtggccaggggcgatgccggcgttggcgaggctttgcgccacgtcgttaaggggcgccggcagcaggccgcattgctcaaggccgttgagcatcgacagcaacgcggcgtggctcaagcgttggttcaactgcacggcgtcgtgcagttgcgtagtgctgaactgctgatcgacggcggccccggtcgcgtccagatgatcgtccaccgctgccggtgcgcaaggctggggcacggcgaacagagtctggccatgcagcgcgacggcgctgacctgaggatgccccaaggcgcgctcacaccagcgctggtgctcacgcttgacactggtcaactcgcgcccgtcatcggtaaaaccctgtacgtggcaattgagttgcgccgcggcgcgttctgccagttgccagtcgcttgggcgcgggctgatgaacagcacctgttccaggtggctcaggtcactcaaggccaggccgggaaaatccaacaggcgttccagttgttcggcgcccatcaccaccaccgccgggcgctggcgttcgagcaccgccagcaaccgggccggggcctgttgatgcacgcccaggtcggtaaaggccggtagatgccaaggaaaggcagcgggtaggtcgatcagcaaggtgtcgacattcatgttgaaactcctctggcatggaacaagcgttgccccgcggcggcgagcggttccgccgcggcgggccatacctcgagcaactcaaagccggccgcctgcaaggccaggtgccaggcgtcgggtgccataaaggcttcatcgctggcgcgcaacggtgcatcggcggggggcgacaacaacaggtgcatgaaggtcagcatcgccgggttgtcggcgatggattcactgaacagcaaggtgccgccatcgaccaggctgctgcggatctgccccaggcaatcgggtaggtcgtgggcgttgtgcagcacattgccggcgatcaccagatcctggctgtggggcgcaataccctggacgctgaagctgcgatcgaggtcgagcaggccgaattgcatccccggttcgaggcgaaactgacgctgcgccgcgccggtaaacagcgagctgatatcagtgaagcgatagtccttttcacgcgcttgcagcgccgccaacaccgcgtcggtggtgcagccggcgccgccgcccagttccagtacccgcaacgttccaccagcggcgctgacttgctgcgcccgtttggccagggcgtgattgatcgccgcagtgaaagggttgtgctggtaggcgccgagcgccttcaccgggtcgctgccgagcatcagcaagtgggtgagggtgaattgatcgcgcagcagctcgggcaggcactcgatgacttgggtgtgcaggcgcgccatagtggccgggaagcccaactcggcatacaggcgcggcagttcacctacccgcggatcgaggggtgttgcttgccaacccagctgttcaccgtcttcgcgcagcatgcccgcacgggtcaatgccgccagccaacgccgcaccacccaggcatgccgcgcagccgtgcccagcgctgcgttgatctgttcggcgctgtgccaggcttgcaacggcaaagcctgggtgtgcagcagcacctgggccatcacgcccaggctgacatgttccaactcgttcagggcggtgttcataggcaaccttcttcggcggcatgcagttgatcgagcgggctgtgcagcaggttcagggtgcggatcgccgaggtgcgcagcaggcgttcaaggctggcggcggggggcagggcctcggcggctgcatggcagccggaccggatctcgccctccaccacgctgatcaccgtggcggcggccatggcaccggtcagcgccgcattgccggcgccgctgagcaccaggctgcgggtcagggcctgctcgtggtacacgccatcgagttgcagcagcagcgtgacaaaaggcgcttgcccgctcagatccaggcgactggcctggcacaagcgctgcacggcgtcggcccgtggcaggccgtgggcctggtcgagggccttgagcacgtagccgtcggtgatcacgttgaaccactggccgacctccagattcagctgcatggccaagcgttcgccctcgaggttcaggtagggcaacaggtggacctggccggggaagcacggcaccgacacctcgcgctggcgccgcagcgcacgactgcaccgaccgttgcgccaggccgccagcggttcgctgctgccgtccaccgcgccttgcaaaaagtcgtcggcagccacggcggtgaagtgatcgcgcaatccgaaatagctggtcaggctgcgcacctgggtgaatgcctgctcggccagccagcgcggcagcaggccagtgagcccaggttgcaggccggcacccagcaccgcgcagcggccacgccattgggccgggtcgaggtgcatgtggccggcggcatcgacgtaatgagcatcggcctgcaacgcggcgtgtgcggcacgcgcctctacgcgccaggacgggccggcgcagttgagcagcacatcgcaaccacgggcgaacgcggctaaggccctggcgtcggtgaagtccgccgcgacccattgcaagcgtgcctggggccattgttgctggagcacttgcacacagtgcgcacccttgacggcatcgcgcccgcccaggcgcagctcattgactcccagcgtcaacaacgcctgggcgctggccagccccacgtcgccgctggcgcccaacaccccgatcagcatggctgggcctcggcgttcaggcgccaaccaccggcgcgctggcggtcatgccagaacccggcgtagcgaccgttgcgggccagcaactgcgcatgggtgcccgattccaccaggcaaccctcatccagcaccaggatctggtcggcggccatgatggtcggcaggcgatgggcaatcaccagcaccgtggagctttgcatcagggtgcggatcgctgcctgtacgaaggcttcgttgtgcgggtccagcgccgccgtggcttcatccagcaatacgatgggcgcccgcttgagcagggctcgggccagggatacgcgctggcgttcgcccccggacagcgccgcgccgccttcgcccactggcgtgttccagccctggggcaggcgtgcgacgatttcatccacgccggccagccgtgcggcttcggcgacttgttcggcactggcgtccgagctgccgacgcgaatgttggcctcaaggctgtcgtcgaacaggtacacgtcctgcatcaccagggacaattgcgccatcagcgcggcattggacagctcgcgcacgtccacgccgccgaccttgacgctgccctcgctggcatcgaaaaaacgcatcagcaggcgcgtgacggtggtcttgcccgagcctgaggcgccgacaatcgcggtcatggaatgggccggggcgttgaacgtcaggcggtgcagcaccttgggcccgctggggtaagcgaagctgacctggtcaaaggccaggctgccgggcgccgtcagcggttggctcaccgccggctccggcaacgacggctcgcgcaggatgctcaccagttggtcgaggtcattaccggccatgcgtaacaggccgctgcgcgccgccgcttcggccagtggcccgacaaagcgcgctgccagagccagcagggcgaccaactggatggcgtcgatgtcgccgtgggcggccagggcaatgcctacgcccaccagcagcgcgaacgccaactgcacggtcaaaccaccggccagcaatttcggaaaggtctgggacagcatcgagccgcccgcgtgtttctgcgccaggttggcggcctgcaatggcgcgtaaccgtcctgggtgcgaccaaaggcgcgcagcacttgctggtagcgggcgaattccaccacgcggttaccggccagggtcgcggcggcttctacccgcgcgtcgttgctgccgatggccgccgccgaccagtgatgggtgaagtagatcagcggcgcacacagcacggccgtcaggcccaggcgccagtcgaacacgaacaggctcagcgccaccgtggccggcaccaccacgccggacaccaccggccccaggtaatgggcaaacaagccggtgaccatcagggtgccgctggtggcactgcgtgacaggcgtccgactttttctgagttgaaccagcccaagggcagggtcaccaggtgctggccaaggcgatcgtgcaaggtggtcaacaccaccagggccagggcaaaccccttcatggcctgctggtagtgggcaatgcaggtcagcaccgccatcgccgccaggcccgccagccaatggaaggcgctgtgcaggtcgccggcaaacagcgcgtgcaggatcggcaccaaaaacgccacggcaacgccttgcagtacggcactggtcaccagccaggcgaggtagcggtacaggcgtgcggcatgggccgggcccaataaagtcacgagactgcggatcacaaggacatctccaggtcgggggcggtggtttcggcgctggcgcgccacagccgggcataggcgccgttggcctgcagcagttggtcatggcggccgctttcgaggacgcggccctggtcgagcacgacgatctggtcgacgccgcagatactcgccaggcggtgtgcaatcaccagcaccgtgcgaccgcgggccagggcagacagcgcgtcctggatcaaggcttcggactcggggtcggcgtgggaggtggcttcatcgaggatcagcaccggcgtatcggccaacagcgtgcgggcgatggacaggcgctgggcttcaccgccggagaaaatcgcgtcttcgccaaccaccgattgatagccccggggcagggcctggatgcgttggtgaatctgcgccgaacgggcggcggcctcgacctcggcatcgctggcctcggggcggcccaggcgcagattgtcggccaccgtgccgtgcaccagttgcgcgtcctgcaacacaaaacccacgtgctgatacagctggcgcgggtcgatctcgcgcacatccacaccgcccacgcagacccgcccggcgctgacgtcgtgaaagcgcggcaccagcttggccagggtcgacttacccgcgccggacgcgcccaccagcgcggtgacgctgccggccgggcagtgcaggtcaacgccattgaggatcatatgcgcggggtcataaccgaactgcacctgttcaaagcggatgtcgctgccctggggcggtacgcagaccttgggcgtcggcagctcctcgacgcccagcagcgcttcgatgcgctcggctgcagcgagagcggtgcgttgcgcagtaaggctctggttgatcaccagcagcgactgcgggatcaccaccgccaccagggtttcggcgaacaactgcaatggcgtgatccagccctgggccagtaacaggctgcccacgctcaggctgaccagcaggatcaccggcacactcaaggccatcgacgagaaggcttccaggcgcagcagtggcttgacccagccggcgtactgggtgctgaactggttgaccgcctgctgataactgcgatgggcctgtccgacctgcccgaatgccttgaccacggcaatgccgtggacaaactcgacaatcgccgcgctgacccgggtcatgctcttgtcgagcaactgcatcttggtgccgaagccgcgcatcatcaggctgtaggctagcgcgtagatcggcagggtcagcaccgccagcagtgccaggcgccagttcaacgtcgccagccagatcaatcccgccaacggggtgacaatcgccgccgtcacttcgacggcgtgatgagcaaccagatggtgcaggtcttcgaggtcgtcctgcaccaccttgcgcacggcgccggaagtggtgtcggtgtaccagcccaagggcacgcgcccgagcttgcgcaccatggcctcacgcaggctcgattgcaggcgatggtcggccaggtgggtcagccacagcgcggcgccgctggccatccagcccaggctcagggcgaccactaccagcgctgcccactgccacagggtggcgctgtcggcgttgccggcgagcaacaagcggccaagttcagtgaggccgataaagggcaccaggttgaccagcgcgccgactgcggcaaacaccacgccgaggcggatcaagcggttgaccgggcgtttcagggtattcagggcggtggtcatgagtttttccgaagggcctcaagcaggtgcgcggtgacggtgtgcacgtggggtggttcgatcacgctgaagtggttgccgggcacgtcgatcaagttgaactggcccaggcaggcgtcctcccagaacggcgccgccaggtggccgacaccgccggtaatgccgaacgattgctgctccagacagcgcaggtaggtcatgttgccgaggaacggtggtgggtcgaaccgcgccgcccgcatgctgtggcgacaaacgcggaacagcgtcggcaccagctcggggccgatcggcaccccggcctgaccagacgccaggcgggcgtactcggccaggcgttcttcctggctgcgcgccgattgttgccggaccgccagcgccagtgcttccaggcccgggtcgccgcccagggcagccatcgccccggcgggcacgcgccggttgtcgcgggccatcagcaggtcgatggcgcggtacacgtcgtagtcttcgatatgggcgccgaacacggtcttgactgggtcgaggttgaggttgggcacgaagatcgcctcataggccagctcttcgtcggtgtcgataaacatcgggatgctgtcgatcaggctcaggtccaccacctccatgccgcgctccagcaggcgccgtgcgacttcagtggcgagcaggccgccaaggcagtagccgatcagctggaagcgctgatggccgtcggcgatcaagcggtcggcgtagtcctgggccacgctttcgatcaggcgcttgggttccagggccaggtactgcgcggtgtcggccaccgcaaagccaatcactggccctgcctgctgggtggcgagcgcacggcccaggtgctggaaataatccagggtgcccagggcggcatggaacatcacccgtaccgggccgacctcgccaccgccgaacggcaccaccagggcgttgctgtgggcggcgcgctgcgactggtcaggcgccgcggcggtgggggggctttcatcgtggttgagcaggcgcgccagggcgctgacagtcggctcgttgagcatctgccgcagcagggtgtcgtagctcaggctgtgcgcctggggcagttgttcacgcagttggccggcaacgcgggcaaggatcagcgaatcggcgcctttctcgtagaaattgtcgtcggcgccgatctgcgccaggcccagggcttcggcccacaccctgcacagctcggcggtgagcgggtcactgggcaccgcttcgttgccgccggcctgtgcatcgatggcggggcgccagttggccagtgtcttgcggtcgaccttgccgttggcggtcaggggcaggcggtcgagcacttgcaggtgcgccggcagcatgtagtccggcaggcgttgcgccagggcgcggcgcaggctgtcgacgctcaagcgttgcagcccggccttgaagcgtgcggcgaatacccgcatgccgagggcggccagcgggtggtcggcgtggggcagcgccggcaggcattcgccgccgaatgcctggacccgtgcctgccagatatcggcagcgcgcaaaccgctgcggcccaagtcgtggtcgtcgcccgccggggtcatcataaaaccttgggtcagcaggatcggcggccattcgccggtcggttcgctgaacaccagccagccaccggggctgagcaattcggtgatctggccgagggcgttgtcgatgtccttgacgctgttgagcatgcccgcgcacagcacgatatccacgctgttgctggccaggccctgggggcgaatatcctggtcaatgtccagcacgccatagcgcacccaggcgtgatcggcaaagcgctgcttggccgccggcaggaaaaacgcggtcatgtcagtgaacaggtaatccacgttcaggccgtcgagcaggctgatcaccggcgtgctggtggccccggtgcccgcaccgatttcaaggatgcgtagcgggccatcgccgtcatggtgggtggcaaaccggttgatcagcgcggcgatgctgtggttgttgtagcgggccaccgcatccccgccatacagctgcaacgccaggtcttgctggccctgggggaacaacagatcgaacgggttgacctcgccgcgcagcagttgcggcagttgcgctacatggttgagctggtagtcaagcagcgcctggctgcacagcccgcacgccaccgcctgttccacccggccccaggccagcgccgggttcggcgcgccgtgcagcaggcgataacgggattgttcgcgctgcaacaggcccgcgtcacacaaggccagcaaccaacgccgcaccaaccagtgatggcgcggttgcacctgcaaggcactgaggatggcagctgcatccggctcggccagcgcgccgctgaacaactgggccttgagcatgacatccagcatcgaactcaaggcggcggcgttgaggtcagcctgatagtcgcgtacctgctgcgcgtcaaagttgccgacctggctgtcggcataacgttgcactgccgtcagcagtggtgtgcccggcagcggctcgggttcgacgcgcgccgccgtgacgaaggccagcagctcgccgctgagcaggctgacggcgctgtccacgcctggggtggcgagcagtgcggcgtcgatttcccccagctccacgcggtgtccacggatcttgacctggccgtcgtcacggccgaggaactccagttcaccccccggcaggtagcgcccacggtcaccggtgcgatacaggcgctggccgtcgagggggtgagcgaagaagcgcgcttcactcaacgccgggtcgccgaggtaaccctgggccaggccgaccccggtgatgtacaggtcgcccgacacccaggtcggcgcatcgcgccattggctgtccagcacgcggaacccctggttggccagcggcaggccgtagggaatactgcgccatgccgggtcaatcgcgccgatggggtgcaggttcgaccagatcgaggcttcggtggcacctcccagggctaccagggccaggcccggcaacagcgtttgcagttgtggtggcaggttcagcggtatccagtcacccgacaacagcgccaggcgcaagctgtccagggggcgcggctcggcttgcaggtagtgggccagcatgtgcagctgcgccggcaccgagttccacagcgtaacctgatggcgctgtatcagctcggcccagtgcgacgggtcggcgccccgtgccgggtcgggcagcaccagggtgccgcccacggcgagcgggccgaacaggtcatacaccgacaagtcgaaactcaattgcgccaggcccagcacccggtccgcagcgttgatcgcaaagcgccggttgatgtcctgcacggtattgagggcggcgcggtggctgatcatcacgcctttgggctcgccggtggagccggaggtgtagatcacataggcgaggtcgtcggggttggcgtcctgtgccggcaagtccggcgtagcggctgccagttgatccaccgcatgccagtgcacaccctcgggcaatggcgtgtctggcacggcctgggagtgaccgagcacatgccgcaccttggcactgcgcagtacgcggtcgcggcgggcggcgggggcgttgctgtccagcggcaggtaggcggcgcccgccagcagcacgccgtaggccgccaccacttggtcacggcccttgggcatcaggatcgccaccggttcctgggcgcggcaaccggcggcgcccagggctgcggcgactgccagggcgcgctccatcagggcggcgtaggtcaggctgccgtgggcgtcgaccaccgccagggcctgtggccgttcccaggccatggccaacaggccgtcatgcaggcgcccggtgggcagcggcgcgtcggtggcgttggcggccaggcgttcacgctgttgccaggccggtagcggcacttgcatgggctgttcccaggtggccgggtcgagggccaatgactgcaattgggcaacgaatgcctgctgcatgtcctcgaccaaaccttcggggaacacgccttggcgcacgtcccagtggatgtgcaagccgttcgcgtcgtccatcacctggcagtcaagggtcacctgcggggtttgggtaatgccgtggccgacccggcgctggctggcggccggtggttcaatcgccaggccaatggcactggtgaacaccaccggcatggcggctgcctcacggccgcgacggcggccgatttcgcgcatcacttgaatgccggaaaacagccggtgctccaggtcggcgaacaattggttgcccagttgccgtgcctgggcagtgaaatcctggccctggggatcattgacctgcaacaggctgaccgaggtgaaatcccccaccagctggttgacgtgtgggtgcagcggtaaacggttgagcagcgtgaggttgaggctgaaggaaggttgctggctccagcgttgcaaggtgccggcataggcgctgagcaccacgatggagggagtgaggccgagggcgctggcggctcttttcagggcggcccatggctgcgcatcgaggtgcgccgagtggcgttggaagcgtggcactgtggtgtcttcgccgctcaggggcgccggcagttgcggagccgggggcagttcatcgagacgcgccagccagtagtcacggtcacgctgatggcggctgccttcaagcaggccgcgttcggccagcaggtagtcgcggaaggtgatgtccaggtgcggcaagctggcctggggatcgtgcagcaactgctccagctcattgaacagcagttgcgcgctggcccagtcggcaatcagggagtccatggaaaagtgcagggtgtcgccgctgtcgctgcggctcaggcgcaattcgaacagcggccaggtctcggtggggtagagcttctgctccatggcctggcgaatctgttgtacggcatgctggtgctgctcgccagtggcgccacgcaagtccgcgacagccagtgggtaatgggcgacctcggccagcacgcgctgggagccttcgctggcaatcaccgcacgcaacatgccgtggcgggcgatcaggcggttccaggcctgttccacctgctgggggtcgaggctcggccagctcagttcgaggtaaccgtggcacgccacattgccgtagccgaatgatgactggcggccgagcaggtaggcattctgcacatcggtgagcgggaagggcgcgtgacgttgcaaggggtcggccaccacctcgggccgctcctgggtttgcagcaggtgcaggatctgctgcttgtgctcgcgcaattgcgccaggcgttcggcgttcagcaggccttggggggcacggaatttgagttggccatcctggggccagagttcgacgcccatggacttgagttcgcttaacagtttggcggcgggcatggggacagctcctgggataaagggaggttgtacgggcatcagatgacgccctcttcaacggggtgcggggcgggctggcgctcgagggtttgcgccacttcgagcaggctggcggcgccgaacaattggcccatgggcagctccacgccgatgcggctgcgcagcatttcgagaaaacgcgtggccagcaggctgtcgccgccgaggcggaagaagttgtcgtggcgcgacacgcagggcacgttgagcaactgctgccacagctcggcgaccagctgttcagtggtgctcaacggcgtttcatccagcgtggggcgtgaatgggcagcggcggccagcggcgcgagcaaggcgcggcgatcgaccttgccgttgctgctcaagggcaggcgatcgagcaccaggatctgttcggggcgcatatacgtgggcaggcactgctccaggtgcagggccagcacttcggcgcaggtgctggcagcgacggcggcgagcaagcgctggtctgcgaccaacgccacggcctggttcacacagggatgacgcgcaagggccgcttcgacttcgcccagctcgatgcgatggccgcgcagcttcacctgggtgtcagcgcggccgaggaattccagcaagccgtcggggcggtagcggcccaggtcgccggtgcggtaccagccgttgacgaagcgctcggcatttaattgcggcgcatggcggtagccacgggcgacgccggtgccgccgatccacaactcccccgtgacccagtccgggcagtcgcggccaagggcgtccaccacgcggtaagcctggttcgccagtggcacgccataggggatcgaacgccagcctggcagcggctgctgaacctcgaaatggttggaccagatcgccgcttcggtcgcgccaccgagggcgataaagcggcagtccggggcctgttgtcgcaggcgttgcggcaggtcgaggccgatccagtcgcctgacagcagcgccaccttcagtgccaggggttgctgctccaccgcgttggcttcgagcagcatgtcgagcaacgccggcacgctgttccacaggcttacgccgtgatgttgcagggccttgagccaggcgcgggcgtcgcggcgctgatcttcatcaatcaacaccagggcgccgcccaccgagagcaggccgaacaggtcatataccgacaggtcgaagtccagcgccgacagcgccaggccacggtccgaggcgtcgacgccgtagctgcggttgatctcggccacggtgttcatcgcggcgcgatgggtgatttccacgcccttgggctggccggtggagcccgaggtatagatcacataggccagttggtcggtgctcacgggcaacggcgcgtgcagcggttcgacgctttgcgcctgggacggcttgaggtgcttgaccccgggcagttgcgggtcgtgctcggcgaggataaggctgacgccggcctgttgcaggatgcgctggcaacgctgtagtggttggtccacacccaccggcaggtaggccgcgcccgctgccagcacccccagtacactggcgatctgttgtggtcccttggccagggacactgccaccagatccccggttgtcacgcccgcgtccatcaggctgcgggcgatgcgcagcgcacgctcggcgagttcgccataactcaggcggccatgctcaccccacaacaacgccgggcgttgcggggcttgctgcgcgtgttggaagaagccctggtgcaaggtcgggtcacccggtacgccggggccgggggcattcaagcgggcgcgcagtcgggcctgggccaccggcagcagatccggcggggcgctgtcccaggggtgtacggcgagccagtggaggctgcccaggtaggcatcgaacatcgcttcgacgaggccgtcggggaacaggccgaccacccggtcccagttcagggcgatgccgccgtcggcttccaccacctgatggtcgagccacacttgcggggtttgggtcaggccgaagacctgcctggcgaacgggccgtccaccggcgcggcggtgccgtccggcacgcccagggcgctggtgaataccaccggcatgctcacctgttgttcaccgctgtccctcgccaattggcgcaacaggctgaccgaaccaatgcagcggtgctccagggcatcacccagatgctgctgggtgcgccgtgcacggtcgatccagcgttcgcctgccacgggcacataaccgagcagggtcagggaggtgaaatcgcccatgacctgatcgatctgcggatgcaccgggcggcgatcgaacagcgtgaggttgaggctcaggtccgggcgcgcactccagcggcccagggtttcggcaaacgcacagagcagcactgccgaggcggtcaaaccatgctgttgggccttggccaggatcgcttgccacgcatccgccttgacctgcccttgcaggcgctcgaagcgtggccggcccaggctggcaggatcggccgccaggggcagttgcgggtgcggcggcaattggggcaaacgtgcctgccagaagtgttgcgcggcgtgcagttcggcaggttccacgccggcctgcagctgatagtcgcgaaacgacagttccagcggcgccagggccagcatcggctcgcgatacagcgcgtcgagttcggcatagaagcgcaggatgctcagggcgtcgaggatcaggttgtccaggctgatcgccagtcgcgtatgccggccctgggtcactgcctgcacatcgaacagcggccagtgggcaggatcgaacacgcggtgggcacagtgttcgcgcaggtcatcgatgcaggcgtagccttggccgatcacgaaggtcggcaccagggggaggatgcgcgcctggcccgcttgatcgaacacggcgcgcagcatttcgtggcgttcgatcaggcgcccgagtgcgtgttgcaggcgtggcaggtcgaggtcctcgacgtcgtattcgcggtagaagtggcaactcacaccgcccagcaccaggcttgggtcgcggcccagccagtaggcctgctgcacctcggtgatggggaagggcgcatggcgctgggcgaggtccggcaccagggtgcgtggtggttggatatgggcctgttgatgcaggccttcgcaaaactgcgccagcaccggctgggcaaacacccgggcgatgcgtgcgccgcccaggccttgctcggttagcaggcgcaccaggcgcgtggcgctcagcgagtcgccgcccagggcaaagaagctgtgctcacgacagacttcaccacagccgagcaactgctgccaggcgtgggcaaccagttgttcgatggggccacagggcggtgacagctggcccggggcggcgccgctgtgttccgccagccagccgttgaggaccttgcggtccactttgccattggtcgtcagaggccattgcgcgcagcccaggatcaggctgggaatcatataggccggcagatgctcggccaggctcgggaacgccagtggggtgggctgcgctgggccattcgccaggcgcaccaccgcccccaggtgctggccggcgagcagcgccactgcctgctcgacaccggggcaggccagcagcgcgtgttccacttcaccggcttcgatacggtagccgtgcagcttgagttggaagtcggtccgcccaaggaactccaccgtgccgtcggggtggtagcgcgcactgtcgccggtgcggtaccagcgcaggccctggtagtgcacaaagcgttcggcactgcgcagcgcatcgccccggtagccctcggccaccccggtaccgccgatccacagttcaccagccacccagtccgggcagtcatggccgtgcgggtcgacgatgcgcaggctgacgttatccagtggcttgccgtagggcaggcaatgccagtgcagcgcctggccgggcacgacttcgaacagcgtcgagtgaatcgccgcttccgttgcaccgcccagggccatgaagcggcaaccgggggcttgggcccacaggcgcggcgccagctgcggcgcgaccttgtcaccgccgagcaagacggcgcgcaagggcagcggtgcgtcggcgcagccgagcagcatgtcgagcagcgccggcacgcaattgagcacgctggcgcggtgctgcaccgccagttcgcgccagcgtggcgcgtcgcgctgggcgtcgggctcgatcaggatcaccgccgcaccgcaggccagcggggcaaacaggtcgaacaccgacaggtcgaattccagcgccgagagtgccaggacccgatcatcgcggttgagctgcaagcgtcgttgcaggtcctccagggtgttggcggcggcgagatggctgatttccacgcccttgggctcaccggtggagccggaggtgtaaaggatgtaggccaggtcgctgattgcaccgcggcggggtgcttgcaatggtctagcagcgtccggcaactgggtgagcagcaagcgcgcaccggcgccctcgcagatcttgcggcaacgtgcggcaggctggtcgacgccgatgggcaggtaggtggcgctgcacgccaggatgcccagcacagcgatcacctgctcggggcctttgggtaattgcagcgccaccacgtcaccgcgcttcacgccttggctttcgagataggccgcgacgcccagtgcacgcttggctaactcgccataggtgatggtctgattgccgtacagcaatgccggcagggtcggggccaattgcgcttgggtaaagaaaccttcgtgcaggcgctcgaccggcaacgcggcgggctggccctgggcggcgctgcgtacgccaagctgactggcgggaatcagcgccggtaccggctgatcccaggccgtggcgtcatggcacaggcgctgcaacaggccggtgtaggcgtcgaacagcccgtccagtacaccctcggcaaacagcccttcacgggcatcgaggttgaccaggacgccgccgtccagttcggtgacctgggcgtccagccacacctgtgggccctgggaaatgatccacgccggctggccgaaactctcctgcacaccctcggcgaacaactcccccaggcccagggcgctggtgtacaccaccggcgccagtacttgctcaccgcgttggcgggacagttcgcgcaacacctcgagcccggaaaacgcgctgtgggccgcgtcaccatggaagcgacgttgcaacgccgtggctcgggcggcaaagctgccggccacccggccatcccaggccagcaggatcgacgaggtgaagtcgccgaccaggcactcgacatcggcatgcaacggcgtgcggttgaacaacggcaggttgagcagcagttcgggcgcctcgcaccaggcgccaagggcctcgcaaaacaccgccgccagggccatggccggggtgagggcgtgctcgcgggcatggcgttcaaacgcctggcgctgggacggcgacagccagtggtgacggcggcgcacctggccttcatcaccctggggcttgatcggcaggcgtggggcacccggtaatgcgtccaggcgctgcaaccagtaatcgcgggcttggcgatggcgctcacggtgctcaggactggcctgctcctcgcgcaggtcggccaggtagcgcgggaagctgtagcccagcgcaggcaggggctgttggcggtacaactgcaccagatcaccgagcagggtgcgcaggctcagggcgtcggcggcgagcatgtcgaggttcaggtgcaggcgtgtgccccggggcaacagcgatagctggatgtccagcacctgaccgtgttccaccgccaactggcgatgggacaactcggcacgcaaggcctgcagttgctgttgcagctgttcggcatcggcctggcgcaggtcatgcactttcaggcccggccatgggctttggggcaggatctgttggcggccatcgtcgagaaactgcgcccgcaacatcggatggcgggccagcagggcctgcaccgcggcttccaggcggcttgggtcaatgccgtggccgtcgaattcgttatagaagtgtgctgccacaccgcccagggcttggccaggggcgcggccgatccagtaggcgtgttgcatgggcgccagttcgaagggcaggccgtcgtccgcaatgtggttggcggggggcgcggcgacgggggcggtatcaagcagcgtcagccacgtgcacaggcgtgggtcggctaccagctcggcgaaacgcgcggccaggccctggcgccgccattggccggcgagacggatcagggtgactgaatccagcccccattcaatcaggttggcctccaggggaatctgttcggcgggctgccccagggcttcggacagggaacggcgcagcagggttgcggttgaggtgctgggagtggccatggctcaacgtcttctcatcgctagggcccggaccggggttggcccaggcgctgggggcaggtcattgtgtggaagcagatgctagtcattctcattgtggcgactaccccaatcgaatcgtttttgccccgtatccgtttgcccgatgcggatcaggctgcggcggtggtgggagacaacgccggtcaccgagcgggatacggttggaaaatgacttgaatcgggtagaaccgcgttgccggccttgactaccgtcgctcgccgcccttttgcagggctcgtccttgatggagttgtggatgtcagtcgattcgggtttacaggtgcgcggcttgtgcaagcgctacaacaatggtgtcgaggcgctgcgcggtgtggacctgagcgtagggccgggcatgtatggcttgcttggccccaatggcgcaggcaagagcagcctgatgcgcaccctggcgaccttgcagcaaccggacgccggcagcattcacctggatggcgtggatgtgttggccgatgccgagcatctgcgccgtcgcctgggttacctgccacagcaactgggggcgtaccctggggtgagtgcgcgggatctgcttgatcggtttgcctggctcaaggggcgtaccgacacccgccagcgtcgtgaagaagtggagggcctgctggccaaggtcaacctgcaagacgccgcgcatcgggcgctcgccacgtattcggggggcatgttgcgccgcttcggcatcgccatggccctgatcggctcgccgcgtttgctgattgtcgatgagcccaccgcgggccttgatccggccgagcgcaaccgctttcaccgggtactggcggatgtggcggccgagtccatcgtgttgctgtcgacccatattgtcgaagacgtcgagaacctgtgcagccgcctggcggtgctggccggtgggcgaattattgtcgaaggccgcccggcggatttgcttggcgctgagcagggtcgcctgtgggaggcgtcgttcggccgtggcgagccactgcccgccgctttgcacgtagccgccagccccgccggtagccgcgtgatcgtgcacggcgaacgcccggccgatccgcgcttcacccctcacgcgccgcgcctggaagacatctattacctggcgctggcccaggccggtgaggcgctcgaggcatgaatacttttgctctgttgatgcgcgaggcctgggtggaagtccgcgccgggctgcgcagcggtattccgttactggtgttcctgggcctgaccggttatttgctgatgtccctggcgaatgccgactacgtgcagaaaatgggcgccagcgacattgcgcgcaacgcgccgagcctgatctacctgatgtcctgcgggtgcatgttctttctgtttttcgcctgggcctgggtgttcgcgcaaccggccttgcgcgatcgcaaggcgcagttggaagaggtgttgctggctttaccgctgtcgctgcccgcgctgctgtggggacgttttatcggcgcggcgctggtgggcggcttgctcgccagttcgctgatcgtcggcttcctggtcagcccggtgctgggctggctcggctgggtgccggccgccagtatcggtgcgccgatgtggtcggccctggggtttgcctggatcgccttgctgttgccagtgagcaccggcatcggtgcgttgtattacctgctggcgctgcgcagccgtggcctggcggcgccgttcgggttggcgacggtgttgatgctgttgtggatgtttgccgtagtggtgctcaagggcgggcatatcaacccgctgctggccgccagcctggacccgtcattgttcacctttgcccaggcccaggtggagacctggagcgccgcgcaaaagtcccaatcgctgctggccctgaccccggggttctggcttaaccgtgtgttgtggtgcgcagtgccgctgctgttgctggctgtcgtattggcccgcaccacgcgccagggtttgatgggcaggcgtagcggcgccgtgttggccgagccgccgatgctgctggcgagcggcgtgaccttgcctggcccgctggtgcgcagccagtggccgcgagccctgtggtgcgaggcgcgttggcaggtacgccagctgtttgcccggcgcatctggtgggtggccctcggattactgttggtgatgggcgtgctcagtggttttgtccacggggtgtggcatgcccgtgggccgatggtgcctcgggcggatctgaccctgccattgctgtcgagcgcgttgttcctggtgatcgcctttatcgtcgcggcgctggtcgggctggtgtgccggcgcgatgacgtcgaaggctttggcgccatgttggaggcgaccccggccccggtgtggctgcgcctgttggggcgggtggcatgtgtgttgatggcgacactggccctggcgttggtgccgggcctggccagcttgctgatcagtgctattgccgcgcccgacagcctggcgccgggttttgtgctggtctatcaggcgctggtattcgcgccgccgctggtggaactggcgatgctcacggtgctggtgcatgcgctggttcgccgctccgggctggcttacgccacttcgatgctgctgacgtttttcctggtgctcaaccatgagttggggctggtgagttacccgccctatgccatggcgatccctgcgcatgtgggggtgtcgttgctgaccggctgggcgccatggctggggtttctggccaccttggccagctggaaactcgccggttgcctggtgttgctcgcgctggcggcactggccttgccccgtgggccggagcgtcgtcggttgggcgatgtgcgccgcggtttgctcggcttgcccggtgcgttgctggccttgggcatcgtcggcttgctcgccagcggcgtgctcttgcagcggcatctggtggagcagggcgattaccagtccgtcgccgagcaacgtgccgaacgtgccgactgggaacagcgctggctgcccggggcgaacgcctggcaggtggccggtgggcagttgcagatgcaggttgattcggcggcgcggcaggtcttgggccagtggacgttggatggggtggtcgctgcccacctggacgctgagttaccgccgggcctgcagttgacggcagtcagcgtgatggggcgaccggtcgcgtttaaacaagccaccgcgcatctgcgtgtgcctttgcagggttgcgcggcgagtggttgccaggtggtgttgaactggacgctgagtgctgacggctggcctgccgaaggcgaagcgttctggcttgggccgcagggtgtgtggctggaagcgcgccgcgtggtgccgcgcctggggctggacagcgagcgactgttgcgtgcgccggccctgcgcagcgaagctggcttgccggtcgcggtgccccggttgccaaggggggctgaggtggcggtggatgcggtcgcaccggccggacactggcaatggcagcttgaggtcgatggccaggtcttgaccggcagcagcctgggcccattggacttcgcctacgccacgccgcttcgcaaggatgccagccgtgagcacaccgcccgtgaagtgcaggaagacctggacctgatgagcgcctgtgtggcgcgacgcctgggcggccgctccagcgtcgaacacctgagccaatggcctgcaagcatgggcgccagccgcttgagccacggccatctgctgctcagccagtcgcccaattgggacgtggggccaacaggcgtcggacgctggacacgccgcgcccatattgccgaactgctcgcccgccgcatgttgaccgacgccagcgacctgcgccaggcccccggttacctgtggctgagccagggtgtagcgggggcgctgggcctgctgtgtgtggaggatgccgatggcgctgacgcccgggccacgctggtcaagctgatggccgacgacctgacccgcgccctggccagcgacggcgagcccgtcggcaccctggccgatgcccgcgaacaaggctgggccgccagctatgccgcgctggtcagcctcgactgggtcgccgcgcaaacccccgaacatctcacggcgatgaccgccgatgtccgtcacggccagggatggccaaccgcgatccagggcctgctgggcgcgccctccgatccggcgattgccgccgcgctcaagcgctgggggcctgcgcaatgaagttgaaccatccctgtcttttggagttttgccatgtcatctgaactgtctatccagccgctgcgtcgtcctctcggttggcgggccaacgtattgacccaagccatggcgctgaccttgtccagccagatgtgtacggcctatgccgctgaccatcaaccggccgccagcgccgagaccatcgagctggcaccggtgacggtgagtgcgcggttgaatcaggagagtgccaaggacattccgttcggcctttcggtgctcgatgggcaaaccctggagacccgccgcctgcgcaccctggaagatgccctgcgcaccacgccgggggtggatgtgaactcctggggcggcgccaacgacgccaacgtgcgtatccgtggggtcggctcgctgaaccagatgagcatggacgacggctcggtggtgctgaacgtggacggggtgccgatgtcggtgcgcaacgcggccatggccaccctcgacgtgcagcaagtggaagtgctcaagggcccccaaggcacgctgttcgggcgtaacagcgaagcgggagcgatcaatgtcaccacccgtaagcccacccgcgagctggaagggtatgtgcgcggcgaagcgggcaaccagggccagttcatgaccgaaggcgcagtgggcgggccgctgaccgagtccctggccgggcgtattgcggtgcggcgcagcggctttgataactgggtcgacgaccaacaggacggcgaccccctgaccaagccacgtgacctggccctgcgcggcagcctgctgtgggacaacgacgaagacactaccggcctgctgaccgtcgagcgccagcgcgccgaccactatgccggctcggagatcctgcggccattcggtaatcgtcccagcctcgactacacccccggcaccttcgatagcaacaagaagaccaacgagcgttattccttcgagctcaaccacgacctggcccaggcccggatcacctcgatcagcgcctacaccagcaccgacttcaaggcgatcaagggctatgatcgcaacatcacccaggcgttgtacggccaacccttcgagtacctggtcgaagacgcggcccatgagcgggtctggagccaggacctgcgcctgggctcgctggcggatgccgaggtgttctgggtgaccggggtgaacctgtcccgttccgagcgcagtttcgattccaccaacttcaccaacggcgcccggcaaatgcgcgatttcaccaccaacagctatgccgcctacggcgaagtaaccttcccgattgccgaggactggaaactcaccaccggcctgcgtcacacctgggatcgcaagacctacggcgccgactacagcagtggcggcaacctggtcagcgacagccgtcgcttgcaggacgactacaacaccggtcgcgtggccctgagctatgcgtggacgccgcagaccaacctgtatgcggtgttgtcgcggggctacaaatcggccgggttcaacgattacgccacctcggtcaaggacagcgagccctacaaggcggccaaggtgaactccgccgaagtcggcttcaagcatgaaagccaaggcggtgcgttgagcctggaaggcgcgttgtttatcactcgtgtgcaggatgaccacctgctggggtatgacttcaagagcatggccgtcagcgccgtgaatgccgacacccgcagcaaaggcgccgaattgtcgagcacctggcacgtcaccgatgagctgaccctgggcagcgccatcagctacaccaacgcggtggtcacctccgatgcgccaggtgtttccggtggtgatgtggccaagggcagccgcgtgccggatgtgccgttgtggagtggcaacttcagtgtggcctggaacaaacccctgggtgaactgctgggcttgcctgcgccgcgcttgaacaccttgctcaactaccgcgtgcagaaaaaccgcccggctgatccgcagaaccactatgacctcaagggttacgccaagttggacttgcaccttgggctggagagtggggggtcggaggtttatttgtggggcgataatttgctggatgcgcggtatgacctgtatggcgcgtactccaccgacacggtgctgaccgggatgccggggcgcgtgcgttcggcgggggtggggtatagctatcagttctgaggcggtcactgggtggaatgtgggagggggcttgctcccgatggcgacctgacagttgaccaggatgttggatcagaccgagtacatatccattatttaggtaatggccactattggttccgcttttacagcgggtcactttgaaaagcgcaaagtaaccaaacgctcttgccccaccactcggcacctcgcttaggctcggtgtgcccgtaatccgacatggatttggggggccgccgccacgcgccatccatggcgcggggcggctaaaccggcatccctgccggtttaccccccaaatccctgtcgaattccggccagcgtggtttgacggggcgcctgagatcaaaagcagatcaagatcaagatcaagagcggctcgctgcgcatcgtggttactgacggtggctacgtaagagttgtgtagatacccatgtcccgatgagggagtgtcagtgaacatatccgaggctgacacaccgccatcgggagcaagccccctcccacatttttaccgagtgcagtcaatcagaccgccgcgaaccaagtcctctccaacatttgaactcaggacagccggccgaatcgcgtcggttcagaattgataggtatagcccacgcccagcgtacgccgacgcgatggcccgccataggccaccgggtcactgtagaaaccataggtgtcatacgtctggttcaacaggttgtcggcaaacgcatacacctcgccaaacttgctctccagccccgccctcaggtcaagtttttcatagttatccagattgaagtggttctgcggatcggccgcgcgttcgcccaccaggtggtagttgaggctggtgttgagggtggtttcgccgaggctggcgaggctgcccaaaggatgtttccagctggcgttaaagttgccgctccaacgtggcacatccggggtgcggttgccggcggcaacgtcgccggcctggatgccttgcacaccgctggtgatcttggcgtcgaggtaagtggcgctggcggccagggtcaggccgtagtcgaagcgccagctgccttccagttcggcgccgcgggtgcgggtgtcggcgttgaaggcgttggtggcgaaagttgcggcgtcgtagccgagcaagtgatcgtcatgcacgcgggtgtagaacagcgcgccgttgaggctgccgcgacggtcctctgtctcgctcttgaagccaagttctgcggccttgctgacggcggccttgtagggcgcgctgtcgctgacctgggaggcatagtcattgaacccgccggatttataccccctcgccaattgcacgtagacgttggtctgcgcggtgagcgcgtaactcagggcggcgcggccggtgccgtaatggtcggtaagtttgcgtgagtcatccacggcgctcgaacctgcgaagtattggccgtcgtaggtcttgcggtcccaggagtggcgataaccggtggtgagtttcaggcgttcggtcagcgggaacgtcacttcgccgtagccggcataggtggtggtagtgaagtcgcggaacttggcgccggaggtaccgtaggtgttgcgcggggtgtcgtagctgcgctcgttgcggctggcggcgacccctgcgacccagaacacgtcagcgtcgggcagtgagcccaggtgcaggtcctggctccagctgcgctcgaaggatttgtccaccacccagaactcgccgggcgtgccataaagcgcgcccatcaacttgctgtcgtaggcgatcaagccggtgaagtcggcggtgccggtggcggtggtggaggtcaggcggctgttggcgaagtcgtgatcgaccttgatcgtgtagcgctcggtggtcttgtcattgtcgtcgaacaagccaggggtcaggtccaggctcgggtggctgccgtaggggcgcagcaccagggagttggtggcgcgttcggtctgctggcgttcggcgctgaacagtatgtgggtgtcatcgttgaggtcccacagcaggctgccgcgataggcttcattgcgcggtttggtgatggggtggttggtctggtcgttgtcgatccaactgtcgtagccggcacggcgcaccgccaggcgaccgctcaagctgttactgagcgggccgccgatggcgccttcggtgaggaactggcctttttggccgacttcgccacgtacatagccttccagtgtacgggtgggttggcgggtggtgatattcaccgcgccggcctggccaatcgcaccggacatagtgccctggggacccttgagcacttcgatgcggtcgacatcgagggtgccgaaacccaggctgcgcgacgataccggcacgccgtcgatgttgaacgccaccgagctgtcatccatggacatctggtacagcgaacccacgccgcggatcagcacgttgaaatcattcggtccgcctgaggaattgacgctgaccccggaggtgttgcgcagggcgctttccagggtgtcgaggcgttggctgcgcagctcttcgccgctggtcacactgacactgatcggcacttccttggggtcttccttggccatgcgcgcggttactgtcgaggcgggcaattgcaggggctcgttggcggcggcgaaggctgatggagagagtgtcagtgcaatcgctattgttatagtattacatttgtagcaagattggcgggtagccgtcgtgttgcatcgtgcagacatgatgggaccttgactgagaattctgatcggcgcgcggtgcacaggggcagcggcggtatggcgcagcgtttgcggcgcgccaaatgctaataattatcaattgcgcacatctaccccgatgtgatctgattcgagccgtatccggtcagccaggagatttacgatgtcagccgttcaaggaggcgcaggggagccgatgccggtctcgcgaatcattacgggaggctatggaagcgatcttgggccaggtgcccattgccgggtcacccgcatgacactgcaggaaggcctggatatcgtgcgctggcagagccgcttcgagcagccggtggaactgccgttgcaggatgacagcgagtgcattcacttcagcttcaccaacctgctcaaaggcaaggccgcgtgcagctttcgcgatggacgtcggcaacggcgctacgcgattgacgagggcgcgggcagcatcagctatggccgctgccgccatggcctttatcaccagcacggcgagatcgacaacatcaccgtcatgattcgccccgagctgctggcccagtgggagctgaaactcgacccgctgctgaacaaggcactggcctgcgagcattgtttttgtacggccatcgcagcggtgaaatgagcgccactgcgcacatgcttgccctggccatggatcaaggcaccagcctgccaccggcccagccacgcagcagcctgtggttgtacgggcaaagtgtcacgctggtgagcctgttcctgcaggcgcgccaggacgccgagtgcacctgccgcgtcagccacaccgaccgccagcgcctggtgcgggctcgcgatcgtttgttggaggatctgggcaaggcgccgagcctgtcggagttggcccgcgaatccggcttgagccagcccaagcttacccgcgggtttcgccaactgttttccaacagcgtctacggcgtgttccagcagatgcgcatgatccaggcgcgcagccgcttgatgagcggcgaggaatcggtgatgcgcatcgcctcggacctgggctatgccaacgccagtcatttcgccacggcgtttcgcaagcagttcgggatcaacccgtcgatgctcaagaacggcggccgtggcaaatccttgggtgccggctgacgccgccggtcagaacaccgctttgacctgcaagcccagcaccagcgcattgtcgatgttgtcaccggaaaacgcccccggctcgatgatgtattgcacatccgggcgcagggtcagccacggcgtggcctggtaaccataactgagttcgatcaactgttcggcagtgtccaggtcgggataggccgtgccggcattgaacgcggccagctcctgcacatcgcggctgcgggggttgggcaccgcacggccataacccagggccacggtatcccgcgggcgaccttcgaacggcttgtacaacaccacgcctgcgccgtaccacttggtaaatggcgacgccgcttcgctggcggcagagtattggccaaaggcgtgcaggctgcgcccctcggatgactcggaagcccacacggcctgatcgatcagcaggtagtggccaccacggccgctgactttcttatcgctgccgatgcgcttcacatcggagctgtcgtagtaatagcccagcttgtattcacccggcagggcgcctgcgtgcttgtagatcagctcgatgggcaccacggtactggtggtgtgcttgggccccacatgccaggcgcggctggcgttgccgttactggacgggtcgacattgaacgccgccacccgcagctgccagttgggcgaaaaatcatatttcacccgcgcgcccaggtgcgcattagggtagttggcccaaccgctgccgccggacatgttcagcggatgcccgcagaaaccggcgttcatgaagttgcacaggatgccgctgtccaggccgcccaggtcgttgcccatggccatatagccgagcttcacattcagcgcgggggtgaacagcgtgcgctcgtagctcagctcggtgaggcgggtgtagaggccgccgtagttttcctggatcggcaggcggttgccgaccagatcctcggaaacactgttgccgcggcggtcattgatggtcagctggatacggtcgccattgttgaaaccgtagagcttgcccaggtcgaactgcacgccgagcttgaggttttgcgagtagcgcgccgagcgatgctggccgccgtgggcgttgtaggcggtctcgccgctgtagtcgccagtgaatcgcacaccttgtgcgtcgagttcgcgacgcaggccgccccagtcgccggtcagggtagtgtcgtcggcttgagcgggcagggcggcagccagggccaggcccagcaccaggcggccaaaggaggtatgagaagtaggggtcatgcgcagggttccaggcacagagcgcggtgccggagcaccgcgcgaacagaggggttacggcagggcgtaggcgatcacgtagtcgccacggtcggtggactggcgtgcgccaccggcggtgaccacgatgtactgcttgccggttttcggcgacacataggtcatcggcccaccctggctgccgaccggcaggcgggctttccagatttcatcgccgttgccgctgttgaaggcgcgcaggtagaaatcctgggtaccggcgataaagatcaggccaccttgtgtcgacagcgtaccgcccagggtcggcaggcccaccttgatcggcaggtgcatgcggatgccgaggggccctgtgtcttcaacggtgcccaccggtacttgccaggcgaccttttgcgtcttcatgtcgatagcggtcaaggtgccgaacggcggtgcctggcaagggatgccggccactgacaggaagcggttcttgttcaccgcatatggcgtgcccttgagcggcacggcgcccatgccggtgttcagtgcttcgccaccggaggaggcctgcgccttgttctgcgacggtaccatctggatccacaggcccaggcgcatgtcattgacgaagataaaaccgtgcaccgggtcggtggagatgctgccccagttcatgccacccagggagcccgggaagctcagggatttatcggtgcctggtgctgtgtacaggccgtcgtagcgcatgcccttgaagtcgatgcggcacaacaactggtcatacggggtggcgccccacatgtccgattcggtgagggtctgcgcgccgatctgcggcatgcccacggatttgggctgggttggggaataaggctcgttgggaatgttggcggccttgaccggcacttcctgcacgtcggtcaacggcttgccggtggcacggtcgagcacgtagatctgcccggccttggtgccgatcaccacggccggtactgccttgtcgctgcctggcggagtgaagtcgatcaggctgggttgcatcggcaggtcgaagtcccagaggtcattgtggacggtctggtacacccatttttcagcaccggtggaggcgtcgagcgccagtactgaagcgccatatttgtggttgagagcggtgcgctcgacgccgtatatatcggtggacgagctgcccatcggcaggaagaccgtgttcatctgcgggtcgtaggacatcggtgcccagctgttcggggtgctgcgcacgtaggtgctgtcgcccgtcggagcttgcttgtcctcagggttgcccgggtcgaacgcccagcgcatctggccgctgattacgtcgaaaccacggatcacgccgccgggcatgtcggtctggacgttatcggcgacgcggccaccgaccaccacggtggtgccggcaatcagcggcgccgaggacagctggtagtagctgtccggcacattgcccaggccggctttcaggtcaacctggccatgggtgccaaagtcttcgcagaacttgccggtgtcggcatctacggcaatcaggcgtgcatcgatggtgttggtcagcaagcgacgctggcactgcgcgccggccggcacgctggcgccaatgatcggcgaactgttgggttgggtaggttgggcaatgggtgcagtggcgtcgaaatacgccatgccccggcaacgctgccagaccgccgatttagcgttgacctcgttcttccacagctctttaccggtgtcggcatccagggcgatcaagttgttgtgcggggtgcagataaacactttgttgccgatctgcaatggcgtcagctggtcttcggcaccgttgccatcgctgagggccacgtcgccggtatgataggtccaggcgaccttgagcttgtcgatgttgtcgcgattgatctggtccagcgcggcgaaacggctgccaccttcggtattgccgtagtgcgcccagtctttctgcgcatcggccgcagctaccggggtgatgcccgggccagcgccggtgggcgccacgctcgggtgggcgacaaacatattgcctgccgctaccgctacgcccacggccaacacggcggcgacgccataggcaccccgcgcacgttggttgacgagcagcgggtacaccagcgctaccaccataccgatgaccgcgaacatgaacagtcgcgagaacagcggccagaacaccagccctacatccgctatggcccagatggccgtaccgaccaggaaggccgcgaacagccaggcgccggccggtttacgacaagcgagcaacagccctgcaatcgccatggccgcgccgccgatcaggaagtaccaggaacctcccaggctcaccagtttgacgccgccgatggccagcgcgaggccgagcagggcgatgatgacgcccaggcccagcagtaagaatctagaggcgccagcggcgcgcgatgctcgtttcatgtcgatcaggactcgagtgaggaaaggcagggcctgattttagcaagataagtaaccagttagtacatttggctcggtaatgcactcttacaaatcctgcgattatcccagacagcaaaaagccgcttgcgccaaaaggcgcaagcggcttgagtgggccagtacctgggtcagaacttgaagcgaccgaccagacccttgagttgcccggagatatccgtcaatcggccagatccggtctgcgccgagtgggcaaactcttcgaccagttgcgcatcggcatggatctgcgcgatgtggcggttgatctcctcggccacttggtgctgctcctcggcggcggtggcgatctgagtgttctggtcgcgaatggagtccaccgagccacggatcttgtcgaagctgtcgcgggcctgttggatgcgctcaacgctggcgtgggacaccagcaggctgccctgcatctgctgggtgacttcctgggtgcggcgggcaaggttgccgagcaggctgtcgatttcgccggtggagtcggcagtgcgacgggccagggcgcgaacctcatcggccaccacggcaaagccgcggccctggtcgccggcccgcgcagcttcgatggcggcgttgagggccagcaggttggtctgttcggcgatggaacggatcgtgtcgagaatagtgttgatgttcttgctgtcctgttcgagcaactccatggtctgggtcgacttctgcaggtccgcgctcagcttgtgcacgctggtggtggcttcgccgatatgttgctggccgttgtggacatcgcggtagccttcatcggcgctcgtcgctgccgcgctgcatgagcgcgccacttcgttggcggtggccaccatttcgttgaacgcggtgctgaccagttccacggcttcacgttggcgcccggcggcctgattcatgttgcgcgccacttcgctggtgtcggcggcagcggtttgcaggtcggaggaggcattgccgatgcgctgcaccagttgtgcgatcacgcccaggaactggttgaaccaacccgccaggctggcggtttcatccttgccctggaccttgagttggcgggtgaggtcgccttcgccttcggcgatctcttgcaggccgtcggccacgccgcgaatcggtcgcacgatcactcgggcaaagctggcgccgacgatcgcgaacaccagggcgaggatcgccgcgatgccggcgatcaaccacgtcaggcgagtcgccccggccatgacttcgtcgcgcttgatcaagccgataaagcgccagcccagcccttgggagctgaccacgttggccatgtacggcacgccgtcgatgtcgatctggcttacgccgtcgccacgcttggccaattcggcgtagttggcgcccaagtctgccagcggcttgaagttgtgcttggcatcgctggggtcgaccagcacgttgccgttggcttccaccagcatcaggtagccactgtcgcccagcttgatgttgcggaccagctcggtcagctgcttgagcgacacatccaggccgaccacgccgaggatattgccgctggcatcggcgacggtgtgcacggtgccgatcagggagacgtcgtccggcgcccagtaataggcgccagtgcgcacggtggtgcctggtgcggcgatggcggcctggtaccaggggcgtacgcgcggatcgtaattagtgagcttggtgtcgtcaggccaactggcatagccgccgtccttcaagcccagggacaggtaggcggtgctcggatggctcttggcgaactggtcgaaaatcgccagcagttcttgattggtcggtgtcagcgggatttgtgcagcatcggcgccggcatagcttttgaggcctttggccgcgacaacgcgcgggtccttggccacgtactcgacgttctggctgatgccgtcgaagaactgcttcatgccattgtcgatctggcggatttcgcggccactgctatcgagaaaattcgccagggccccctcgcgcaggttcagcaccaccaggacggccaccaggatgactggcaggcacgcgatggcggcaaacgcccaggtcagcttttgcttgatattcatgacttctcccgcgggtatttataattttggcaagggggaaaacggtagcggtgagcgtcgcatgtgttgttttgcagtctgagcggcccatgcttacccttgtatatcgactgcaagggcaagcacttgagggcaggggcaaggtttaaccgatgtgctcggcacccagggcatcacgctgcatcgactgcaggttcttttcgatggtttcgcagatgctctccatctggatctggtgttcgctggagttgaacgggctttgcaggtcggtaccgatgcgttcgatggccaacagcatgaagcccaccaccgtggaggccagcggcgtgaaccagcccagggattccaccaggcccaccggcacgatcaggcagaacaacgaaatgaacagccgcgggaaatacacgtaggggtagggcagtggcgtgttggcgatacgttccatgccgccctgggcattggacaggtccaccagggtcgactccagccgtgccaggcgaatgctgtccaggcgcccggcctggtattcgcgggccagtaacgtagcggagccggtgaggatgtcattggcaaaattattggtggcgccgttgcgcgcaaattcgtcggcggggataaatgcccgcacttcttccgggcacggctggcccttgaggtgcgcggccaggcaattgacataggccacgtgccggcgcaacagcgtcgacttgaccgggttcacctcaccgggagcgtcatccagcagggtcaatacttgccgggcaaagctgcgcgagttgttgaccatcgctccccatagcgtgcgtgcttcccaccagcggttgtaggcactgctgttgcgaaagctgatcagcaccaccagcgccgaacccagcaaggtcaggggcatcagcggcaagttgatcttggcggtgagaaacagcatgaagtccaccgtcacggccacatcccatagcaacagccagaacagcgcccagcccacatagcccatggtcttgatgatcaggcgatatttcttcaggacagcagctttcaaacgagcacctcgcagtgggtggttggcaacaatgccctgttacgacgtcgccagagagggaaggttcgcagggtgctgaatcgattagttgataagtcgctatcccgggagaatgtaacgagaggtgtcgcgcaactgcgggccacagatgatttgaatgtggaacaactttggtactgatgacgtctggtgcggcaatcgctgtacattgcgttcgaggcaaaaagccattaatggcagggtttttgacgtgatttgttttggggcctggctgcagggatttcgtagccgagatcagtggaataattggttgatcagggctctttcatgcgtgtcagttcgttgaagtcagctatgtgtaataccgcgcaagcactcgaacgtcatagggattttgaagcgtgcatgagagcgcattaccacgtgctgctcgtgccctattcaagacgaccgtttttctataagagtgcacttaaatacagccgcttgatggtgtcgtttgcgttattgagccagtacttttccaccccgctgccattgttggcggaagttaaggccctgtgcgtgacgcgcaggtattgttcgaaaaacagcctggaatcaatcttcctgttgtttcgtgccctgggtttcatggaggttgcaccgcacccagaagacagtcgcttccgggtgtattcaccctcggatgaagcttgccgtgaagcacgcttgatgctgaccgccctgactgagtcgttggcgctgctgtacccggagcgggagattttccggcagatgcgcgacctcgatgatcgcgggtttctggccctctatttcaagggttttgccgtaatcctcgcgtctgaactaacggtggatgtgttactgcccgagtgttattggctggtgaaacgcgatgccgggcatctgttgatgctggccatctataacgatgcctttgcgccggacaatgaccgcactaccttcaggtcgtcgtcctacctggcattggccaagcaactttccgtgtccaagacccacattatccgcatggtgcaggaaggtgtggagaagggctatttcaaggcccactccaagacccggctggaagttctgccacctttcgccagtctggtaaagcgcttcatggccttttcatttgcggtgggcctgcatgctattgagatgggagcgtaggggatgcctgctaacttgaagttgcggccccggatgcgcagtttgctgtcgcctgcggtgacgcaagccgaatggatagggattattgcctgggtcggcatgttgttgattcatccggccctgcagttggatatttatacgatgggcgtcactcttggcctgttggtggtttgccgcgtgcataccaggaccgccaactttctgctttggcgggtgctgggggtgacctatatggtgctgttgtcggtcggcttcgcctacatcattcgcttgaatgaagagttgcgcatttatggcctgccattggccgtcaccctggtggtgggcagcgccatcttgtttatcagtgtccaggattatctggccgacgcgctattggtctggcttattctgtggccgccgatgcaggccgatatatatgcgggcaccgaggtctatctgctgatgttttgtgcttcttcggtgtccattggttttatcttgagttactcctacttgaagaacctgcgctcggtattgttggtggaaagtgagtttcgcgcattggccgagactgattatctgacctcgatcctcaaccggcgcgcctttatgcaaagtttcgaaaagttgctcagtggtggccagagcggctacttcatcatgttggatatcgacagtttcaaggaaaaaaatgacctgtatggtcacgatgtgggcgacaagatcctgcgtgccatggccgtgtgcctgaaaaacgccaagggcagtcacagctttggacggatcggcggggaagagttcggtgtgttgttgcagggtgacgacccggaactggcctgcgattttgccctggcgttgttacagtcgatccgcagcagtgtcgctgcaccgcataactacacgtgcagtgcgggcatggcgcgcttttcggcgggcgacgacctgtcgacggtgctcaagatggcggacaagaacctgtatggcgccaagcgcaacggcaaggactgcgtgcatctggacggtgcgctgctgcagccggttttatcctgacgcgcaggcgtcatctacagctgcgacagaatactcgccaacaacccgggaaagcggctctccagctcgtcgcgacgcaatgaattcatatgggtagtgcccacgttgcgggtgtgcaccaggccggcatcgcgcagtacccggaagtggtgggacatgctggatttaggccgcccgccatccagttcaccacagctggcttcgggcacgccggccaggcagcgcacgatgtccaggcgtacggggtcgctcaaggcgtaaagcacgcgctctagggtcaattcttgcggtgtagggtgtttgaaggctcgcatgggcggatcataacaggggggtagcgttcaataccatagttcgattaccatcgaactatcgaatcaatcacccttccccggagtatctgatgtccgccttgttcgaaccgttcaaacttaaagacgttaccttgcgcaatcgcattgccatcccgccgatgtgccaatacatggccgatgacggcatggtcaacgattggcaccacgtacacctggccggcatggcccgtggcggggccggcctgctggtggtcgaggccaccgcagtcgctcccgaagggcgtatcaccccaggctgtgccggtatctggagcgatacccatgcccaggcgttcgtgcccatggtcaaggccatcaaggccgcaggttcggtgccgggcatccagatcgcccacgccggtcgcaaggccagcgccaaccgcccgtgggaaggcgatgaccacattcctgcctccgatgcacgcagctgggaaaccatcgccccttcggccatcgcgttcggggccaacctgcccaacgtaccgcgtgccatgaccctggacgatatcgcccgcgtccagcaggacttcgtcgacgccgcccgccgcgcccgtgacgccggttttgaatggatcgagctgcacttcgcccacggctacctgggccagagctttttctccgagcattccaaccagcgcaccgatgcctacggtggcagcttcgataaccgcagccgcttcctcctggaaaccctggccgccgtgcgtgaagtctggccggaaaacctgccgctcactgcccggttcggcgtgatcgaatacgacggccgtgatgagcagaccctcaccgagtccatcgagctggcgcgccgcttcaaggaccgtggcctcgacctgctgagcgtcagcgtcggtttcaccattcccgacaccaacatcccgtggggcccggccttcatggggccgattgccgaacgcgtgcgtcgtgaagcgggtatcccggtgacatccgcctggggcttcggtaccccgcaactggccgaaggcgcgttgcaggcggggcacctggacctggtgtcggtagggcgtgcgcacttggccgatccacattgggcgtactttgccgccaaggaattgggcgtggaaaaatcctcctggaccttgccggcgccttacgcgcattggttggaacgctatcgctgaggcgggccaggcatacacaagagccactcaagtgagtggctttttttcgcctggcgtttatgcactacggaggccaaaggcttgagcgaaaaataacaaatgagaatggatgccaaatgagaatcgactgggctatgatgctcgcgaattcttggcaggtttgccgtcccatctggctctttcactaggttcaacacccatgcgtcgtaccctgatttccatctgcgtgcttcaggcgttttcccctttttcgtgggcagaggatgcccccgctgaaacagccagtatcgagctgcaggccaccaacgtgactgccaccgcagacttcgagtcggcccaggggccggtgcagggttaccacgccacacgatcagccagtgcgacgcgtaccgacacctccattcatgaaaccccgcaatccatcagcgttgtctccaaggacgtggtcgaggacatcggcgcgacgcgcctgcaggatgccctcgactatgccggcggtgtcggccgcgccaacaacttcggcggccagggcctgaccactttcaccgtgcgtggctttactaccggtgagttctaccgcaatggtttcccgatcaaccgcggctacccgaacatgccggacgccaataccatcgagcgtcttgaagtactgcgcggccccgccaccatgctctacggccgtggcgaccccggtggtaccttcaacgtcgtgtccaagcagccgctggccgagcgcaccgtgaccctgggcagccaggtgaatgaccagggcatgaaacgcggcaccctggatgcctccggcccgctggacgaagaaggccgcctggcctatcgcctgaacgtggtgggtgagggcggcgataccttccgcgatcatgtcgagaccgagcgctatggcgtgactccggtgatcacctggcaggccagcgacgacaccaaggtgaccttcgaaggcgacttcatgcgcaacaaccacccgttggaccgtggcctgacgcgcctgcccaaccagcgcggcacgccctcgcgcgatacgttctggggcgacaaggacgccggcaagctgcacaacgacaacaacatggcgcagttgcgtttcgagcatgcgctcaacgacaactggaccctgggcggtggtttccagtggttggacggcagtttgaaaggcaacgccatcgaagccaatgggatgggcagcctgggcgccgatggccgcaccctgcaacgcaacttcaactaccgcaaactggaatggactgacaaggattaccagctcaacctgaccgggcacttttccacgggcggcttcgatcacaccctgctcaccggtatcgagtacgaggattacgactaccagtcgatcatccagcgttccagtgcggccctgggtacctacccgatcgacattttcaatccggcgtatggccaggcccgtccgccgctgacgcgcacgccgacccacgacaaggagaacctcaagacctatgcggcgtttgtccaggatcaggtggcgctgaccgagcgcttgaaagtcttggcaggagcgcgtttcgagcgttttgagcatgactacgaaagctatgtaacgggagtaaaaccctggaccgccgctgacaacgcggtcaccccgcgtgtgggcgtgatctacgacctcaccgacaccgtcgcggtctatgccgacgccgcccgttcgttcaagcccaataccggtgccagccgtgaaggcggtggttttgcaccggagaaaggcaagtcctatgagatcggggtcaagtgggaggcgcttgaccgtcaactgagtgtcgacgcggcgatctaccagatcgaaaagaaaaacgtgctgaccaatgacccggccgaccccaccaacaccttcagcgtcgccgctggccaggtgcgcagccgcggattcgacctgaacgtggcgggtaacctcacacccgagtggcgcgtgatcggcggctacgcctacgtggatgccgaggtcacccgagacaacaccttccgtgccggcacccgcctgatgaacatcccgcgcaacagcttcagcctgctcaatgtctacgagttccaggacggcgcactcaagggcctgggcctgggggtcggcggcaagtacgtcgaccagcgtgccggccagaccgccaactctggcttctcgatggacgcctacaccgtggtcgacctgctcggctactacaaggtcaacgagcaggtacgcctgaacctggatgtgaagaacctgttcaaccgcgagtatgaggaaggggcgttcggtaatatctatgcctacccgggtgccccgcgtacggtgcagattggaatttcctacaccctataacgtgccttacacagttccaaatgtgggagggggcttgcccccgatggcggcctgacagccgaccaggatgttggatcataccgagtacatatccatttctgcggtaacggctacttagggttccgctcttacagcggctcacttttggaaggacccaaaagaaagcaaaaggtcctcgccccaccactcggcacctcgcttaggctcggtgtgcccgtaatccgacatggatttggggggccgccgccacgcgccatccatggcgcggggcggctaaaccggcatccctgccggtttacccccaaatccctgtcgaattccggccagcgtggttttgacggggcgcctaaaatcaaaagcagagcaagagcaagagcaagcagcaagtcggcacggtcagttgtgtagatacctatgccccgatataggtatgtcagccaggtatctggtgctgatccaccgctatcgggagcaagccccctcccacatttggactgcatgcgtccagggggctctctgtcagcctggaatgcatatctcatgtgggagggggcttgctcccgatagcattatttcaaccagcatatgcggggctgatacaccgccatcggtgccattcgaatcgttgcaccgcccctcccacatttggatctgcatgactgtcaaggttgacagtagacagtgcaggaccatggagagatgtttgccattaacgtgtcagcctagttgtcggcgcccatgcttttcgaagccacgcttgatagggatattgaaaatggagcgagaactcgtcagtgaaaccgatgaactgattaaaaagactaacgatgccgagcgtctcttcacccgttacgccaccaagtgctatacctcagccctgcaaaagtacgtcaaggaaatcagcgagacctcgtacacctatctattggccgagctggccgagagttcgctgagttcggaaatacttggccggccaggcgccaatatcagcctggtcaggatcgagatagaggaggtcatgctagaggccgaggtgatcaagaaattgaagcgcgccgaaacccattacctggaaacgctggagtcggtgcgcaagttcgaagacctcaagcgcttcgaaaaaatgcaggacacctccgatatcgtccgctcgatcaagctcggcgtgtcgcgcttcaatatcctctttgtcattttgctgatcggcgggttgacctgggcggcgatcaatctgcccaaagaagccctggcacttatttccgccgctatcggcggggccattacccacttgttgtccgagcgccaggcggtgctggcgctgaaaaaagacggagataacacctgccccagagccaacgccaataatcaggaataggtgccacagcgccgggttacaacggcgtcagcacattcatcaccgtatccagcgccacccgtgtgtcatccaattgcaccagcgaggcgtgccgcgcgcccagggcgtcgcggttctggatcgcggtaaggatcgccttgtgccggggcaggctcaaaccctggatatccggacggcggttggtgatgttgatcgactcgcgcaacggcagtgaaagcatgttgcacatataggcgagcaggtcgttgcgagtggcgtcggcaatcgcacggtggaagtccaggtcggcctgcaacagctgttcgtgggtctgcgcggtttccatgccctggtaggcttgttcgatggtggcgatgtcttcatcggtggcggtggtcgcggccatggcggcgatttccggctccaggatacgacgcaccccggccagggtgttgaagaactcgctgtggggtgtggactgcatcaaccaggacagcacgtccgggtcgagcaggtgccatttcaagcgcggccgcaccaccgcgcccacccgcggcttggaatacaccaagcccttggcgctcagcacccgcgtcgcctcgcgcaataccgagcggctgacctggtattcctcgcacagcgtggcttccatgggcaaccgttcttcaggcttgaagcgaccggaaacgatgtgcatgcccaagtcctggacgatctgggcatgctggctcttgcgcggcttgggcggctggtgatccataacgacggataggctctggcttagattcgccgcatcatagcatcccaattagtgggaatgccgtgggacttcggcgccacggcaacccaccaggaagtcgaaatcacagccctggtcagcctgcagcacatggtcgatgtacaactggcggtacccgccgacgatcaggttctgcgccggcttgaggtcggccatgcgtgccgccagctcggcgtcagggatgtccaggtgcaggcggccattggcacaatcgagctcgatccagtcgccttcctgcaccgtggccaacggcccgccggcagcggcttccggcgccacatgcaagaccacggtgccgtaggcggtgccgctcatgcgtgcatcggaaatacgcaccatgtcggtcacgccctgggccagcagcttggccggcaagcccatgttgccgacttcggccatgcccgggtaacccttggggccgcagttcttcatgaccaggatcgagttggcgtccacgtccaggtccgggtcgttgatgcgcgccttgtacatgtcgaagttctcgaacaccaccgcacggccgcgatgctgcatcagctcggggctggccgccgacggcttgagcaccgcacccagcggcgccaggttaccgcgcaacacgcagatgccgccgtcggcgcggatcgggttgtcgagggtgcggatcacttcatcttggccgtagatcggcgagtccttggtgttctcgcccagggacttgccgttgacggtcaaggcattggggtgggggatcaggttggcttcacccaggcgacgcagcaccgcgggcaggccaccggcgtagtagaactcttccatcaggaagcgcccggagggttgcaggtcgacgatggtcggcatgccgcggccgatgcgggtccagtcatccaggtcgagttcaaccccgatgcgcccggcaatggctttcaagtggatcaccgcgttggtcgaaccgccgatggccgcgtttacccggatcgcgttttcaaacgcttccttggtcaggatcttcgacagcttcaagtcttcgcgcaccatctccaccgcacgcatgcccgacatatgcgccagcacataacgccgtgcatccaccgccgggatcgccgcgttgtggggcagggacgtgcccagtgcctcggccatacaggccatggtcgacgccgtgcccatggtgttgcaggtgcccgccgagcgtgacatgccgccttcggcagcaaggaagtcatccagggtgatggtgccggccttgacctgttcgctgagctgccacaccacggtgcccgaaccgatgtcctggcccttgtgcttgccattgagcatcggcccgccggtgaccacgatggccggcacatcgcaactggccgcacccatcagcagcgccggggtggtcttgtcgcaaccggtcagcagcaccacgccatcgatggggttgccgcgaatggcttcctccacatccatgctcgccaggttgcgggtgagcatggcggtagggcgcaggttggattcaccgttggaaaacaccgggaattccaccgggaagccaccggcctcgatcacgccgcgcttgacgtgctcggcgatctggcggaagtgcgcgttgcacggggtcagctccgaccaggtattgcagatgccgatgatcggcttgccatggaactggtggtcggcaatgccctggttcttcatccagctgcggtacatgaagccgttcttgtcggcggtaccaaaccactgggcggagcgtaggccgggctttttgtcaggcatgatcgattctcttattgtatgactatatgttctatgcgtggttaaacataagcgcaaaatcgaagctttggaagtgttgttttgcaaatagtcatactatatagtcgatctcaactgaggtatgaccctggcggatttcgcgagaggcgtcccccgagcttctataaaaacaacaatcggagatcgacccatgagccaggaattgcggcttattcggcgcatcacgctgaaactgattcccttcctgatcctgctgtacctgatcgcctacgtggaccgttccgccgtagggttcgccaagctgcacatgggcgccgacgtcggcatcggtgacgccgcctatggcctcggtgccgggctgttcttcattggctacttcctgttcgaaatccccagcaacctgatgctcgaccgcttcggcgcgcggcgctggtttgcgcgcatcatgatcacctggggcgccatcaccatcggcatggctttcgtgcaaggtccgcacagcttctatgtgatgcgctttttgctcggcgcggcggaggcggggttctttcctggcgtgctgtactacatcacccaatggttcccggtacgccatcgcggcaagatcctcgggctgttcatcctctcccagcccatcgcgatgatgatcacgggccccgtatccggcggtctgctcggcatggacggcatccttggcctgcacggctggcagtggctttttatcgtgatcggcaccccggcgatcctgctgacctggccggtgctgcgctacctgccggatgggccgaaacaggtcagctggatgagcgagcaagaaaagacctggctcaccggcgagctggaaaaagacctgcaagcttacggccagacccgccatggcaaccccttgcatgccctcaaggacaagcgcgtgttgctgctggcgctgttctacctgccggtgaccctgagcatctacggcctgggcctgtggctgccgaccctgatcaagcagttcggcggcagcgacctcaccaccggcttcatctccgccgtaccgtatatcttcggcatcatcggcctgctgatcatcccgcgcagttccgaccgcttgaatgatcgctacggccatctcgcggtgctgtatgtgctcggcgccatcggcctgttctgtagcgcctggctgagtgtgccggtgctgcagatggctgcgttgtgcctggcggcgttcgccatgttttcctgcaccgcggtgttctggaccttgccggggcgcttctttgccggggccagcgcggcagccggtatcgccttgatcaactcggtgggcaaccttggcggctacatcggtccgttcgtgatcggtgcgctcaaggaatacaccggtaacctggcctcgggcctgtatttcttatccggcgtgatggtgttcgggctggtcttgaccctcgtggtctaccgcgtgctggagcgcaagcacgtgctgccggtcgaccaattcgccgccagcgcccgtggcgccacacgtacttaaatcctggagaaaatgcatgcgtctagttcagttcgagttgggtaacggggagcgccgcgtcggcgtagtggaaggcaacactctgcgcgaagtgcagggcgcacacagcgtacgcgagttggcgctggccgccatcaaggccggcacgggccttgcgcaacaggtgcagggcctgggcctgggcgacagccatgactacgccgcgctgctggccgagctgaaagtcctgccgccactggaccacccggacccggcccatatgctgatcagcggcaccggcctgacccacctgggcagcgcttcggcccgcgacaagatgcaccagcaggccggagacgacagcgccatgaccgacaccatgcgtatcttcaagtggggcgtagagggcggcaagcccgcggccggccaggcaggcgtgcagccggagtggttctacaagggcgacggcagcattgtcgtacgcccgggcgccgccttcccggtgccaccgtttgccgaagacgctggcgaagagccggagatcggcggcctctatgtgatcggccacgaccgcaaaccctatcgcctgggttttgcggtgggtaatgagttctccgaccatgtgatggaacgcaagaactacctgtacctggcccattccaagctgcgcagttgcagctatggcccggaactgcgcgtgggcgagctgccccagcacctggccggcagcagccgcatcctgcgcaacggcgaagaaatctggcggaacgaattcctcagtggcgaggccaatatgtgccacagcctggaaaaccttgagtatcaccacttcaaatacagccagttccttaagccgggggatgtgcacattcacttcttcggcaccgctacgctgtcatttgccgacggtatacgtacccagccgggcgacgtgttcgagatcagccaggccgaattcggcgcgccgttgatcaacggtatcggaagcaacgacgcggcatttgaacccggccaagtcacccccctttaaggagatcaacatgacccagttcctcggccacaactacattggcggccagcgcagcgccaacggcgatgtcaagctgcaaagcgtcgatgccaccagcggtgaagccttgccgcaggatttctaccaggccacaccgcaagaggtcgatgccgccgccaaggccgccgccgctgcgtatccggcgttccgtgcgctgagtgccgcgcgccgtgcgcagttcctggacgcgatagccgacgagctggatgccctgagcgataacttcatcgatttggtctgccgcgaaaccgcgctgcccgccgcccgcatcaaaggcgagcgtgggcgcaccagcggccagatgcgcctgttcgccacggtgctgcgccgtggcgatttctacggggcgcgtatcgataaagccttgccggatcgccagccgctgccacgcccggacctgcgccaataccgtatcggcctgggcccggtcgccgtgtttggcgcgagtaatttccccctggcattttccacggccggtggtgataccgccgctgcgttggccgcaggctgccccgtggtgttcaaggctcacagcgggcacatggcgacggccgagcaagtggccgatgcgatcatccgcgcagccgaggccaccgagatgccggcgggggtattcaacatgatcttcggcggcggcgtcggcgaagccctggtcaagcatccggcgatccaggccgtgggtttcaccggctcgctcaagggtggccgtgccctgtgcgatatggccgcggcacgcccgcaaccgatcccggtgttcgccgagatgtcgagcatcaacccggtgatcgtactgccccaggccttgcacgcccgcgccgaaagcgtggcccgcgacctgaccgcctcggtagtgcagggctgcggacagttctgcaccaatcccggcctggtcatcggtatcgcgtcgccacaattcacggcgttcactcaacaggtcgcgcaattgatcggcgcgcaaccggcgcagaccatgctcaacgccggcaccttgggcagctatggcaagggtctggaaaaactcctgtcccaccccggtatccagcacctggcgggtaacgcgcagtcgggcaaccaggctcaaccgcagctgttcaaggcggatgtacggctgttgatcaacggcgacgaagtgctgcaggaagaagtgttcggccccaccacggtgttcgtcgaagtcgctgaccaggcccagctcaatgcggccttgcacggtctgcacggccagctcacggcgacaatcattggcgagccggcggactttcaacagttcgccgaactcacgccgctgctggaacagaaagtcggacgcatcctgctcaacggttatcccactggcgtcgaagtctgcgattcgatggtgcacggcgggccatatccggcaacgtccgacgcccgtggcacgtcggtgggcaccctggccatcgaccgcttcctgcgcccggtgtgcttccagaactaccctgatagcctgctgcccgaggcgttgaaaaacgccaacccgttgcgtattcagcggctggtggatggcacgccatcccgcgatccgctgtaattcaccaggaggcttcatgtcagtgaatgcagtgaccccacaccgtgcccggttgggcgaagggccgttctgggacagaccgacccaggccctgtattgggtggatatcgctgcccggcaggccctgcgcctgatgggcggcgagttgcaggtctggcaattgcccgagcatgtctcggcattcatcccctgtgaaagcggcgatgcgctggtgaccttaagcagcggcgtgtatcgcctggacctgaccaccgaagcgctgaccctgctgtgcgtcgccgacccgcaacccggcaaccgcggcaatgaagcgcgctgcgatgcccagggccggctgtggctgggcaccatgcagaacaatatcggtgagcaaggcgaggacttgcccatcactcggcgttccggcggattgttccgcatcgatgccgatgccacggttacgccgctgctcagcggcctgggcattcccaacacactgctgtggagtgaagacggtggtcacgtgcacttcggcgacagcatggacggcacgctgtaccaccatgcaatccagtctgacggccaactcgatcccgcacgggtgtggttcggaccccacgagcgaggcggtccggacggttcggccatggacgccgaaggctacatctggaatgcccgttgggacggcagttgcctgctgcgcctgacaccccttggcaaggtggaccgcatcatcgaactgcccgtcagccgtcccaccagttgcgtgttcggtgggcccgacctgaccacgttgtatatcaccagcgccgcgagccccttgggtcaccctttggacggtgcgctgttggccattgaggtcgatgtgcctggcaaaccttgccatcgcttcgccggttaaacccaagacttaaaaacaacaacaagaggtgtcgttcatgaaaaaggttctacgcgttctggctgccgccgttgctttaagcagcctcagcagcatcgtatccgctgaagaagtgaagatcggctttctggtcaagcaggccgaagaaccctggtttcaaacagaatgggccttcgccgaaaaagccggcaaggaacacggtttcaccgtgatcaagatcgccgtgcccgacggcgagaaaaccctctcggccatcgacagcctggccgccaacggcgccaagggctttgtgatctgcccgccggacgtgtccctgggcccggccatcgtcgccaaggccaaggtcaatggcctgaaagtgatggccgtggatgatcgctttgtcgatgccaagggcaacttcatggaggacgtgccgtacctgggcatggccgccttcgaagtgggccagaagcagggcgccgccatggccgccgaggcgaagaaacgcggttgggactggaaggacacttacgcggtgatcaacaccttcaacgagctcgataccggtaaaaagcgcactgacggctcgatcaagtccctggaagaagccggcatccccaaggatcacatcctcaccgctgccctcaagactcttgacgtgcctggcagcatggacgccaccaactcggccctggtcaagctgcccggcggcgctaaaaacctgatcatcggcggcatgaacgacaacaccgtgctgggcggcgtgcgcgccactgaaagcgccggcttcaaggccgccaacgtgatcggcatcggcatcaatggtaccgacgccatcggcgaattgaagaaagccgacagcggtttcttcggctccatgctgccgagcccgcacatcgagggctataacactgcgctgatgatgtacgagtgggtcaccaaaggcactgaaccaccgaagtacaccgccatggacgaagtcaccctgatcacccgcgagaacttcaaggaagaactgaccaagatcgggctgtggaaatgaccgctgcggccctgcgtttcgacgcgatcggcaaaacctttcccggggtcaaggcgttggacggcatcagcttcaccgcccacccggggcaggtgcacgccctgatgggcgagaacggtgcgggcaagtcgacgctgctgaaaatcctcggcggcgcttacattcccagcagcggcagcgtgcagatcggcacgcaggtcatggcgttcaaaaatgccgccgacagcatcgccagcggcgtcgcggtgatccaccaggaactgcacctggtgccggaaatgagcgtcgccgagaacctgttcctggggcacttgccgacgcgcctgggcgtggtcaatcgcgccctgctgcgccagcaggcgctgacgtgtctcaagggcctggccgatgagatcgaccccgacgagaagcttgggcgcctgtccctgggccagcgccaactggtggaaatcgccaaggcgctgtcccgtggcgccaacgtgatcgccttcgatgaacccaccagcagcttgtcggcacgggaaatcgaccggctgatggcgatcatcgcgcgcctgcgtgacgagggcaaagtggtgctctacgtgtcgcaccgcatggaagaagtgttccgtatctgcgatgcggtgacggtgttcaaggacggtcgctatgtgcgcaccttcgaagacatgagcaccctgacccacgaccagttggtgacctgcatggtcggccgcgatatccaggacatctacgactaccgcccgcgggagcagggcgaggtggcgctcaaggtcgacggcctgctcggcccggggctgcgtgagccgatcagtttccaggtgcgcaagggcgagatcctgggcctgttcgggctggtgggcgcggggcgcaccgagctgtttcgtttgctcagcggcctggagcgcgccagcgccggcagcctggagctgtgcgggcaagcgctgcagttgcgctcaccccgcgacgccatcgccgctggcgtgttgctgtgcccggaggaccgcaagaaggaaggcatcatcccgctggccagcgtcgccgaaaacatcaacatcagtgcccgcgcggcgcattccacctttggctggctgttgcgcgacggctgggagaagggcaacgccgagcggcagatccaggcgatgcgggtcaaaaccccgaacgccgcgcagaagatcctgtacctgtccggtggcaaccaacagaaggccattctcggccgctggctgtcgatgccgatgaaggtgctgctgctggacgaacccacccgtggcatcgatatcggcgccaagtcagagatctaccagattatccataacctggcggcgagcggcattgcggtgatcgtggtgtccagtgacctgatggaagtgatgggcattgccgaccgcattctggtgctgtgcgaaggtgccctgcgtggcgaacaacggcgtgaacacgccaccgaatccaacctgctgcaactggccttgccacgcggcgcggcgaactgagagaagacgatgacaacccaacccaatgcgttgccctcggcacgcaaacccctcgatatgcgcgcattgctcgacaactgggcgatgctgttggcggcagtgggcatctttgtgctgtgcgccttgctgattgataacttcctttcgccgctgaacatgcgcggcctgggcctggcgatttccaccgtcggcatagccgcgtgcaccatgctgttctgcctggcctcggggcacttcgacttgtcggtgggctcggtgattgcctgcgccggggtggtggcggcgattgtgatgcgcgataccgacagcgtgatgctgggcattggcgcggcgttgctgatgggcctgatggtgggcctgatcaatggcattgtcatcgccaagctgcgagtcaacgccttgatcaccaccttggcgaccatgcagatcgtgcgcggcctggcgtacatttttgccgacggcaaggcagtaggggtgtccgaggagcagttcttcgtcttcggcaacggccaactgttcggcgtgccggtgccgatcctgatcaccattgtctgcttcctgttcttcggctggctgctcaactacaccagctatgggcgcaacaccatggccattggtggcaatccggaagcggcgctgttggctggggtcaacgtggaccgcaccaagatcctgatcttcgccgtccatggcctgatcggcgcactggccggggtgatcctggcctcgcgcatgacctccggccaaccgatgatcggccagggcttcgagctgacggtgatctctgcgtgcgtattgggcggggtatcgctgagcggcggcatcggcatgatccgccacgtgattgcgggtgtgctgatcctggcgatcatcgagaacgcgatgaacctgaagaacatcgacacgttttaccagtacgtgattcgcggctcgatcctgctgctggccgtggtcatcgaccgcatgaaacaacgctaacccgagccatacgaagatccaatgtgggagggggcaagccccctcccacagttttaatcggcggagaacttgaagagggtgtgttgggtataggtctgcccagggttcaagcgagttgaggcaaagcctggctggttaggcgcatccgggaagtgctgggtttccaaggtaaacccgctccagtgctgatacgtcttgccccctttgcccttcaccgaaccatcgaggaagttgctggtatagaactgcacacccggttcgctggtgtagagctgcaagcgccggccggactcagggtcatgcacgtccgcggcgagctgcttgatgtcacccttggtatccagcgcccagttgaagtcgaacccaccctgtttcggttcggcgaacttgagctgcggatggtccgccttgatgtgctggccgataggcgtgggcttgaggaagtccattggcgtgcccttgacgggcgccagttcaccggtggggatcaaggtggcattaacgggggtgtagtggctggcatgcagggtggcgacctgcttgagaatgtcgccgttacccgcgccggcgaggttgaagtagctgtggttggtcaggttgagcaccgtcggtttgtcggtggtggccttgtagtcgatgtgcagttcgttgttgtcgttcaggcggtaagtgacttcggtcttcaggttaccggggaagcccatttcaccgtccttggacaggtaggtgagggtgacgcccaccgagtccttgtccttgaccggctgggcttgccatacctgcttgtcgaagccttgggcgccgccatgcagggagttgggaccgtcgttgagcggcacctggtagcgtttgccgtcgagttcgaaggcgccgccggccaggcgattgccgaaacggccgatggtcgcgccaaaaaatgccgtgccggcctgatagccctgcacgtcatcgaaacccagcaccacgtcgtcgaccttgccgtgtttgtccggcaccttcaacgactgcaatacgccgccgtaggtgatcaccgtggcttgcatgccatggctgttgcgcaatatgtactgttcgacggcggtgccgtcattggttttgccgaagggtttgtgttcgctggtcaggccggcggcctgggtgccgccgctggcgaccagcatggacagcgccagaccggacagcaggtaacgagggtgcttcatggtcgaacttccttttgttgttttggatggaatagttctactaatttgagatattttgtcgtaatgaccccggatttatagcctttaacggcgtatttgcaaaataaaataagactaattaagcagagcgatcactgatatgactacccagcaagcgatttatcccgacctcaaggacaaaaccgtgctgatttccggcggtgcctcggggattggcgagttcatggtgcgcgccttcgccgcgcaaggcgccaaggtgggtttcgtggaccgtgcgcaaagccagggcgaacgcttggccgcgctgttgaattcccaaggatttaccgtggagttcgagtgctgcgacatcaccgacgaaattggctatcgcgccgccatcgggcgcttcgagcagtcgctggggccgatcacggtgctggtaaataatgcggccaatgacgtgcgccacagcctggaagaaatcgactcgcaaatgttcgaccagttgatcgcagtcaacctcaagcacgctttctttgccgccaaggcggtggtgccgatgatgaaagaggccggtggcggttcgatcatcaacctgggctcggtcggctggatgatggcctcggccggttacccggtgtacgccgccagcaaggccgcggcccacggcatgacccgcggcctggcgcgggaactggggcccagccatatccgcgtcaatacgctggtgccgggctgggtgatgacggaaaagcaactggccatgtgggttgacgatgcggccaaggaactcattgcccgcagccaatgcctgcccggcagtgtgatgccggaacatatcgccaatatggcgttgtttttggcctcggatgcctcggcaatgtgctcggcgcagaatttcatcgttgacggcggttgggtgtagaaacgcgattatcaaaacaccactgttcaaatgtgggaggggcggtgcgacgattcgacttgctcccgatggcggcgggtcagctgatacatctgtagctgatccagcgccatcgggagcaagccccctcccacatttttgagatagggtgtttatgcgatggggtaacgcttgaacgccgggtgctgttcgaggcgttcagcatggcgcttgaggttggggaacgcatccgccttcaccaccgaggccacagtgaactggctgaacgaccaggcgaccgccgccgtaattgatgcctgggtcagcgcttcgctatcgcccagttgcttgtccaacaacgcataagccgccagcaattgcccgctgacgcgctcaagccacggcgcatgcagcttttcggctgggcgcaggttgtgttcatagacgatctgcacacttttttcgcaagccgcgagggccagcccgagcaagtgcagatcgtgggcgcgtgccgccggttgttgaggcagcagcttcttgtcagccggtgcgagggtttcgagataatcgaggatcaggctcgaatccatcagtaccgtcccgtcttccagcaccagggtgggcgccttgaccactggattgatctgggcgaactccgcgaaggtgctgaataccgacagcggttcatgcacaaactccaccccatacaagtccagggaaatcgccacgcggcgtacgtagggcgagtccagcattccgaccagtttcatgcagcctccattgctttcgcggtgtgagtggcttgcgagattaaggcttcatgataggggggcgcaatgcttgaaggggcggtcgctacattgaactgcgggccgccccgggcggttgcccggtgatacgcttgaaggcacggctgaacgccgcctgggaggtgtagccgaggcgttgcgcgacggtttcgatgggcatgcgctccagcgtcagccactggctggccaggcgcatgcgcagctccgtggcgtagcgtaacggcggtatgccgaggatggcctggaagcgatcggcaaataccgagcgcgaggtatggcactgcgctgccagttccgccacgctccagtcgcggcccggctgctggtgcagggcgaggagggcgcgggccaggcgtgggtcgcgtagcgccgccaccaggcccgaggcgttgccacaggcgcattcgacccagccgcgtacgatcatcgccgccaccacatcggccaggcgcgccaggatgccggcaaagccgatgcgggccgtggagacttcccgttccatcaccgccagtatcggcatcagcccggggtaacgctggcccccggcatcgatcagcatcagcgccggcatcaggttgccgagcccctggatgctgccgagttcgaactccatgcaggcgctgaacagcagagtgctgggaacggtttcgggtgacgcatccacggcgcagacggcgtctcccagcggtgcgctgtcgaaatcgccgatgtcttgcacatcgatgctcgcgtcggataacagtgcatgcgcgccgccatgggcgatgaacaccgcattgcccgccgacagttcgaaaaggtcgccatcctcgccgcgcaaggtcacgtggccggccgcgagaaagtggaaataggcatggccgggcttggcgccaaagcccatgccgaaggtcggcccggcctggatgcgccggtactgcacaccgcgcaggcgcataccgcgcaacagttcattgatcaggtcggaagacagggtaaaagcatccgcagcggtcatgttcggggtttcggtcataaactcaagggtttgcatcatagatcatcctgccaggcaaacctagacttgtcgccttgctaatgatctgaggatgacctgtgatgagtgaatatgcagctcaagcccctgccggggtggtgacggagccggcctggctggcggtattttctttggcaatgggggttttcggtttgctgacggcggaatacctgccggccagtttgttgacccccatggccttggacctgggtgtttcggaagcgctcgccggccaggccgtgacggtgacggcggtagtggcgttgtttgccggcttgctggtgcccggcctgacccgaagcatcgaccggcgcgtggtgctgctggggttctccacgctgatgattgcctccaacctgctggtggcgctgtcttccagcctgaccgtgctgctgttgatgcgcatcctgctgggcatcgccctgggcggtttctggagcatggcggcggcggtggccatgcgtctggtgccggcggcttccctgccacgggcgctgtcgatcatcttcagcgggattgcggcgggcaccgtggtcgccgtgccgctgggcagctatttgggtggcctgtacggctggcgcagtgcgtttatcgcggcggctgccgtgggtgcggtgaccctggcgttccaggcgttcaccctgccgcgcctggtgcccaatggtaccgcgcgcctgcgtaccgtgctggaagtgctgctgcgcccgggtatcgccatgggcatgttcggttgcgtgctggtacataccgcgcatttcgcattgttcacctatattcgcccgttcctggaaagcaccaccggcgtcgatacccaagggctggccctgatgctgctgggcttcggcgtggcgaatttcgtcggcaccttgctcgccggttggctgctggtgcgccacccgcgtgggacgttggtgttgatgccggtgctggtaggcattgcggcgctggccctggtctggctgccggtgtcactgccgggccaggcgttgctcctggcgctgtggggcatggcgttcggcggcgtaccggtggcatggtccaattgggtcgcccgtgccgtgccggaccaggccgaaagtgccggcggcatggtggtcgcttcggtgcagtcggcgattgccgcaggggctgccggtggcgggttgatgttcagcgtcagcggcattggtggggtatttgtgggtgcgggtgtattgatgttgctcgcggccttgcttatcgccctgcgcgtacaggtgcctcgacaagaccgggatgccggtgtgacgcaccacccgtctttggtttagtctggaacgcttcgttgatcacaatccctgaggagcagtggcatggctgactatctacccccaaaggtctggacctgggacaccgagagcggcggcaccttcgccagtatcaaccggcccatcgcgggtgctacccacgataaagagctgccgatcggcaagcatccgctgcagctgtattccctggccacgcccaacgggcagaaggtcacgatcctgcttgaagagttgctggccctcgggcacaccggcgccgaatacgacgcctggctgatcaagatcggcgacggcgaccagttcggcagtggcttcgtggcggtgaacccgaattcgaagattccggccctgatggaccgcagtggtgccacgccgattcgggtattcgagtccggcgcgatcctgcagtacctggccgagaaattcggcgcgttcttgcccagcgagcctgcggcccgggctgaatgcctgtcatggttgttctggcagatgggcagcgcgccctacctggggggtggcttcgggcatttctatgcctatgcgccgagcaagatggagtacccgatcaaccgttttgccatggaagccaagcgccaactggatgtgctggacaagcgcctggcggtgagcgagtacatcgccggcgatgagtacaccattgccgatatcgccatctggccctggtacggcgggctggtcaaaggccgcttgtacggcgactcggcggagtttctctcggtgcatgaatacaaacatgtgctgcgctgggccgacgcaattgacgcccggccggcggtgcagcgcggccggcgggtgaacagggtgtcgggtgaggagcagttgcccgaacggcatgacgcgagtgacctggactgattcagatccagtgtgggagggggcttgccctcccacactggatctccttagcttcggtttacttgtagcgctgttcgaataccgccacctgctcaggtttgatcagttcaaacggcacccacacttcggcttcaatcggttcgcccttgatcattttgatcgccgcttgcaccgcctgggtcgcctgggccttggggtcctggaacactgaggcagcaagcagcccacgcttgatcgccgccaaaccatcgggcaaaccgtcgatgccgacgatcgcaatctggcccttggccttgcccgcttgctgtaatgccatggccgcaccgattgccatttcatcgttgttggccacgatcgcatcaaactgcgtgcctgccagcagccagttgctggtcaggtccatgcctttgttgcgttgccactcggcgctttgctgctcgacgatcttgataccgggaaagtccttgagcacctgcctggcgccttcggtgcggtcatgggtggcgttctgcgcaaggtcgcccatgatgatcgccacgttgccctggccgccgagtttttccgcgaggtagcgcatctgcaattgcccagcctcgatgtcgttggacgccaccgtaaccacgccctttggcagcgtgcgttcatccgggtggcggttgacgtacaccagtggcgtcttggccgccacggcagcgcgggtgatgttggcagtggcagccgtgtcgaccggcagcacgatcaccgcatcgactttctggttgagaaaaccttcgacctggttgagctggcgcacgacatcgccctgggcgtcttcgaactggatctgcacgtcctgctgtttcgccgcggcctcaaggccgctacgtacataggtcatgaagttatcgtcgacccgggcaatgctcacgccaatgcggtacgcggcgaaagtccattggctgaacagcaacagcagcgcggccactagcaatgaataacgatgcataagggtgttccttttattgttatagggtgaatgcctggcggaagcgctccagggccaattcgctggtgccgctggcccagccctccaggccgaccacgccggtgtagcccatggcgtgcaacgcgcaggcaatcgtcgggtagtggatttcgccagtgccgggctccttgcgcccgggcacgtcggccacctggatttcaccaatggcgctgccggcgcgctggatcaattcgatcaggtttccttcgccgatctgcgcgtggtaaaggtccaggttcatcttcaggtgcgggctgcccacggcttcgatcagcgcaagggtctcgtcggcgcgggcgaacggcgtgccggggtgatcgacggcggtgttgaggttttccagcaggaacacacggctggcgtcttcccccaggcgcgcgattttttccagggtcttgcaggcgctcagccacatgcggccggtggcctggttgaccggctgcaccggcaggccgccggcgcccaggccggtgccgtgcaggttgaggctgggacaattgaggcgctctgcgatgcccagggattcgcgggcgctgtcgagcagttggcgactgccttcggggtcggtgagggtgccgctgatgtagccggtcatcgaggtgaagtccgcgccggtcgcggccagggcgtcgatgtccttgtcggtccagctccagatttcggcgctgaaccccagggcgtggatacgtttgacccgttcgatgaagggcaggtcgaggaacaccatctcggcgctgacggctaatttgaacggcatcatggccgcgccccttgcacggccacagacttgccggtttcgtacgactcgatgcaagcgcgcgcaatcgccagggccgcgcgcgcatcctcaccgctggccaggggcttggcgccgctgcgcaggcagtcgacaaagtggttgagttcggcaatgtaggcgtcgcgcagcaggtcagtgtccattcgttgggtgtcggcctggatgccctcggccaggtagcgcaccagatcgcagtcattgaggctgcccatgctcagcatgccttggctgccgaacacttcaccgcgcacatcgtagccatacaccgcctggaagttggcctcggcggtggcgatggcgccgttgtcgaagcggatcgtgaccacggcggtatcgagcaagccttggcttttgtacgctggggcgatcagcgcgtcggccatcacatatacctgcaccgcttcggcgccggggttgaggtagcgcagcgtgtcgaagtcgtggatcagggtctccaggaagatcacccattgtggtgaagcggcggggttgttcagcgccgggtcgcgggtcaacgagcgcagcaattgcggcgtgccgatgcggccggcggcgacatcgaggtgggcggtacggaagctcttggcgaaacgccgattgaaaccgacctgcaacggcacgcgggcgtcggtggcagcggcgatggcgcgatcggcttcatccagggtgatcgccatgggtttttcgcaaaagatacctttgccggcgcgggcggcgctgatcaccagttcggcgtggctgcgggcgggggcggcaatgagtacgccgtcgatctccgggtcgtccaacagctgttgcgggtcggtgtagaccttgtccacccccagctctgctgccaggcgtgcggcctggcctggggtaggatcggcgatggcggcgaggcaggcaccggggatgtggcgcgccgccgtaaggccgtggaagctgcccatgcgaccggcaccgatcaagcccaggcggatattctgtgtactcatgaagtgacccctttttattgttggccgcaggacagtcctggctggcataggggtaggagcaagggttatgccaattcataactcactgattggtaatggtttataaaatagattaaacaaaatatgttcatttggatgacatgcctatactgacatgtcaaaaacatgaacatggatacctcgatgactctgacgttcagcgggcaagacctcgattacctcacggccttggggccggctgcgttgaatgacggacccgtcgctgcgttggagcagggctggcgagcgtgtctgtccggccaggtcgaacgcccggccgaggtgcgccaggtcatctgggattcgtggcggcgcagtctcgaggcaaggatcgatcccgatcacagccactaccgtttcgttgccgcccaagcgctggcggcaaccctggccaatcaccgcgtactgatcgccgccgccgcgcaagtcatgcacggcttgctggcctataacccgcgcggccatatcaaccttaccgatgccgagggcaccaccctgtatttctgcgggctggacatcaccccagtgggcagtcgcctgctggaatcggtacagggcaccaactgcaccgggttggccttggccgaagatcgcctgatgtacgtgttggccgaggagaacttcgccggcgccctgcgccagcgtcgcatgcactgcgccgctgcgccgatcaaggatgcccagggcctgacattggccatgctcacgctgaccgccgagcccggctggtttcatttccataccctgggcaccgtccaggcggcagccgaagcggtgtcgcggcagatggcgctgcaggtgttgctggaagaacaacaagcggtgctcgaagtgctgaacgaaggcttggtggtactggatgagcgcggctgcatcaaggcactcaaccgttatgcgcggcagttgttcggggtggggctggagctgatcggcagttcgttccagcgcctggggcgcagtgagttgagcgacgtgctgggtgagccggtgcgcgacctcgactgcaccttcgagctgcacgaccgcagccaactcgcctgcctggtctcggtatgcccgctggagcagggcggggtgatcgtgtcggtgcgcgaaaaccgccgcatccgcgaaatcacccggcgccttatcggtactcaggcgcgctataccttcgacaccatccagggcacctcacgggcgatccaggacgcgctgcacctggggcgcattgccagtcgcggcgacgccaccactttgatcctcggcgaaagcggcaccggcaaggagctgtttgcccaggccattcataacgccagcgagcgttgcaacggcccgttcgtggcggtcaactgcggcgccatcccccgggacctggtgcagagcgaactgtttgggcatgtcgaaggcgcgttcaccggctcggcgcgaggtgggtcggcgggcaagtttgaattagccgatggcggcaccatcttcctggatgaaattggcgacatgtccttcgatgcccaggtcagcctgttgcgggtgttgcaggagggggaagtgacccgcgtgggcgcgaaaagttcgcggccagtggacgtgcgcatcatcgccgccacccatcgcaacttgagccaggcagtggccgaaggtgcgtttcgtgaggatctttactaccgcctcaatgtgttgaacctcaccgtgccgccgttgcgtatgcgccgcgaggatatcccgctgttggcacggcatttcctgcagcgctgtgcgcgttcgttgcgtaagccagtgcagggtttctcgccggaggcgctggcgctgctgtcagcccatggctggccgggcaatgtgcgtgaactggaaaacgcgattgaacgggcgaccaatctggcgatgggcgagttgatccagccggctgacttgccgctggaaacccagcaacgggcgacgctgcgcctttaccagccccagcccgcgcaggatctgagcagtcatgaactgcacgccatcgtcgccgcgctgaaaaacacgggcggcaatatccgcctggcggcccggcaactcaacgtgtcgcggggtgggctgtacaacaagatgggtcggtttggcttggatgcaggggattttcgcgggcgctgaatgattgcccgtgtgcagattaaaggtgggggcttcgatggcggcctgacagccgaccgctaaccagcggatgccccgcgatccaaatgtgggagggggcttgctcccgatggcggcctgacagccgacctggatgttggattgggccgagtacatatccgttatttgggtaacggccactatgggttccgctcttacagcgggtcacttttgaaaagcgcaaaagtaaccaaaacgctcctgccccaccactcggcacctcgcttaggctcggtgtgcccgtaatccgacatgcatttggggggccgccgccacgcgccatccatggcgcggggcggctaaaccggcatccctgccggtttaccccccaaatccctgtcgaattccggccagcgtggtttaacggggcgcctgagatcaaaagcagatcaagatcaaaagcggctcgcttcgcatcgtggttacggtcggcagctacaaagttgcgtagatacccatgccgcgatagcggtgtgtcagcctctgaatttttgacgggttcatcaccgtcggggcaaatcgaatcgtcgcaccgcccctcccacattgtgttctttgtgtatcaggtgcccatattttccgaggtcactatctgcggtggtatatgcacccgatgccgcaccggatcgaagccttcgtcattcagcaactgcaccagcagttgcaccaacgccgccgccgtctgccgcggctgcgagtccatcactacatcgatcaagccgcggctcaacgcctggcgcgacagctcggtcgactcctgcagaatgcaacacagcgccgggcgcttgggcagttgcgccagggcgttgatcacgccgtcaccgccgccgcccaccacgcacaggccgcgcaggtcggtgtggcgggcgagcaggtcgagggtggcttcctcggtgatgtcgcagttatccaggttgatcagcggttccaacggcttgagccctggcgcgtgttcggccaggtagctgtgcaagcctttgacccgtgcctggtgcccgagaaaacgatggccgccaagtaaaatgccaacgctgcctttgcgtgcgccgcaggtgtgtgccagcagccagcccatggtgcgcccgaccacgtggttgtcctggcccacatagggttcgagggcctgctcatggatatccgacagcagcgcaaccactggtacgccggcttcacgaatctgcgccaggcaggcgttgatcagcggatgggcgaagctgaccaccgccagggcgtcgcactgcaccgccagttgctcgatctgcgcgacgatggcattcggtgaacggtcgttgatgtagtcgaactggcagctcaggttggcggtggcgtgatgctgcgcggcatcgcttattgactgggcgaggttggcatagaaggcctgggcggtgcccagcaacagcacgccgaaacggtaggtgggccgccgttcgcggatgcgctggccgatcagtcgcgcggcgaagtagcccacggcttcggcggcctggaacacctgttcggccgtgctcgggttgaccggcgcgcgggcgttcaatacccggtcgacggtggccacgctaagccccgcgtgggcggcgacggtggcgatggttgggcgtttatggttgtgcattggcaggccccttgagcgtcttgatagaaaactatcaagccccgctgggcctggatgatagcttgatagggaatggattcaaggccttgagggtgatttggctgcgctctatggttggttccgcaaagcacctgaaaccccacgcttgcggagaacaataacaatgcctgaacacaccgcttaccgcgctcggcgcgactacagcctcactggccccgaagcggcccgcgccgccgaaaagggtctggtctcggccaactggtaccagtcgcctatctcgcgcaaacgcatgaaagaactgatgcagcgccgcgacggccctgccttgctcgacaccgccatctgggtctcgacgctgttggtcacaggctttggtggttattggttctggggctcctgggcctgcgtaccgttttttctcgcctatggcgtgctctacggcacggcgtccaacccacgctggcatgaaaccggccacggtactgcgttcaagacccgctggatgaacgacgggctgtaccaggtggcgagcttcatgtgcctgttcgaaccccacgtctggcgctggagccatgcccgtcatcacaccgacaccattgtcgtcggccgcgacccggagatcgtcgagccgcgcccgccgagcctgtggatgatggccctcagcctgttcaacctgcccctggcctggaagaccttcagcggcgtggcccgccatgcggcgggccgtatgagtgcccaggagcaggatttcatccccgagtccgagtggcccaaggtgtttcgcgccgcccgtatatggattgggatttatgcgctgatcatcggcaccgcgctgtacctgcacagctggctaccgctgatgctggtgggcctgcccagtctctatggtgcctggctcggctacgtgttcggcctcagccagcatgtgggcctggccgaagatgtgctcgaccaccgcagcaactgccgcaccatctacatgaaccgcgtgctgcgctttatctacatgaacatgaactaccacctcgaacaccacatgtacccgatggtgccttaccacgcactcgaacaactgcacgaagaaatccgcagcgactgcccgccgccgtacgccaatctgttcgaggcatacagggaaatcatcgcgacgatccgcaaacagcgcagcgacccgagctatttcgtccagcgcccgattcgcccgcaggcgcaatccgcccctgccgctctgcacgcagaagcctctgccggctgatcttcatcccccgaacaagagaacaatgccatgaacgatcaatggatcgacgtctgcgccgtgggcgaaatagaccccgaagacgtattgcgcttcgaccacggcgcgcacacctatgcggtgttccgctctgccgaggatgaattcttcgccaccgccggcctgtgcacccacgagaaaatccacctggcggacggcctggtgatggaccacgtgattgaatgccccaagcacaacggacgcttcgattaccgttccggcaaagccctgggcgcgccggtgtgcgtcaacctcaagacctacccggtgcgggtcgaagcggggcgggtactgctcgccgtcacggccgaaatatgagccaagccctgatcatcgttggcgccggtcacgccggtggccgtgcggcactgaccttgcgcgaagaaggctacaccgggagcctgatcctgatcggtgatgaagcgcacttgccctatgaacggccaccgctgtccaaggctgtgctgcaaggctcgacggacctggccggatgcagcctgtgcgacagcacacggctggcagcgctgggcatcgagcatatcgccggcaacccggtgagccgcctggacccgcagcaacaccggctgcaactggccgacggccaatggttgacctataccggtttgttgctggctaccggtggccgggcccgacgcttgcccgaggcgcagccccctgtgctttatctgcgtacccacgatgaagccttggccctgcgtgataggttgcgccccggcacccgggtggtcgtggtcggcggtggttttattggcctggaggtggccgcgaccgcacgggggctggggtgtgaggtcacgctgcttgaagccgggccacgcttggcgagccgggtgttgccggcgccgatcagtgcggcgctgctggcgctgcatcgtgagcaaggtgtggacgtacgtttgaacgtcgccctcgaatgcatccacgccgacgccgtacaactggtcgatgggcagcggctgccctgtgacctggtggtggcgggcatcggcatgcaacccaatatcgagctggcggcggcggcagggctggaagtcgggcagggcattcgtgtcgacgcgcaattgcgcaccagtgcatcggatatctatgcggcaggggatgtctgcgagtttcgcctcgctggcgtctatcagcgccaggaaacctggcgcaacgccgaggcccaggggcggcacgccgcgttgaacctgctggggcgcgcgctgccgttcgagacgctccccggtttctggtccgaccaataccactggggtttgcagactgtcggggtgatgactgcacgcacggtcagccgtgcgttgcctggcgctggcctgctgctgttttacctcgacgacgatgcccggttgcaaggcgcgtgcggctgggcaccgggcaacggtgcggccagggacatcaagttgtgcgaacgcctgattgccgcgggcactgtgctcaacccgggcagcctggcagatgccgatgtgtccctcaagctactgttgcgaggctgatatgcgtcaactcctggtattccaatcgatgtgggccatgcaaaccgagcctggcagcctcgacacgcagctggaccgcatcgccgccgccggtttcgacggcatcaccgatcattacaggacgcctgccgctgtcccgcgcctgcacgctgccgccacggccaggggcttgcagatcgaaggccagctgttcccgcaatcggtggatgacctggccgccgcattggaggtgatcagccgctatggttgtcaccacctcaccctgcaggccgatgtgcgcccgcgtacccaggccgaggcggccaggctgatcgaaggctggcaacgcctggccgaacaggtggacttcccgatcctgctggaaacccaccgttatcgactgaccaacgacctgttgttcaccctcgacctgctgacgcagatgcctgacctgaaactgctcgcggacctgtcccactacgtcgtcggccgcgagttgcccgagcccggagccttggaagacgacgagcagatacgcacgatcctgcgccatagctggggctttcatggccgcatcgccagcagcgaacaggtgcaggtcggcctggactttccccagcatctgccctgggtcgagcgctttaccagctggtggcgctatgggatcgacgactggctgacccgcgccgagacgccccagagcctggccttcacctgcgaactgggcccgccaccctatgcgatcaccgatgcaaagggtcgggaactcactgatcgctgggccgaagcgctcaagatgaaggcgctgattcgccaggtgtgggccagttgtcacggctgatctgctaacctgcgcgggttcaaaccgaccttagcctatggatccgcccgatgaaaacctgccctgtccagccacctctcgaaccgcagtccgtgtgccacccgatcaccagcagcgcgattttcatggtcgccaccttggcccccgacgcggttgaaaacgtgcgtggctggtgtgccgacatcgcaggtcttgtgcgttcggtgggtaagcgcgtgccgtcgggcaacctgacctgcgtctgcggctttggctcggatgcgtgggaccggctgttcggtgccccgcgcccggcatcactgcatccgtttcgcgaattcggtgtagaagggcgcagggcggtgtcgaccccgggcgatatcctgctgcatatccgcgccgagcagatggacctgtgcttcgaactggcgacccaactgatggcggccttgggcgatagcgtcaaggtggtggatgaggtccagggtttccgttatttcgatatgcgcagcatcatcggatttgtcgacggcaccgaaaacccggtagggcgcaaggccgaaagatttaccctggtcggtgacgaagacccccagttcgagggtggcagctacgtgctggtgcagaaatacctgcacaacatgaacgcctggaatagcttgacggtagaagcccaggagaaggtgatcgggcgcaccaagctggcggatatcgaacttgacgaagaagccaagccgagcaactcccacagcgccttgaccgtcatcacggacgagaacggcgaggaagtgaagatcctgcgcgacaacatgcccttcggccgcccgggcgccggtgagttcggcacctacttcatcggctatgcgcgctcgccaaaacctctggaacagatgctggaaaacatgttcgtcggccgcccggtcggcaactatgaccgcttgctcgacttcagtaccgccgtgactggcggcctgtttttcgtgccctcggccgacctgctcgaagaactggccgaccgccagtaacctgtaggagcgagcttgctcgcgaaaagcgtcaacgataacgcgggcatcctgaatgtacgcggtacctttggatttttcgcgagcaagctcgctcctacaaaaaatgatcgcgtcaggtaagcaacccggtgctgaccgccacaatcaggaagactcccagcagcgcacggtagatcacgaacggccaggtggagaagcgctccaggaacttcatcaggccccagatcgcgaagaacgccgagatgcttgccaccaccaggccgaagatcaagtgcggccaggcgtgggcgggcatgtcggcgtgcagcagcacccacagttctttcaagccggccagggcgatggccggcaggcccagcagaaaggaaaaccgcgccgcttcttcgcgtttgaaattcaggaacagcgctgcggtcagggtggagcccgaacgcgataccccgggaatcagcgcgccgatctgcgcaacccccacgatcagcgcatcgcgcaggcgcatctggctgacgttgcgggtgtgacgggcgcgtacttcggccagcgccagcaatatcgccatcaccacgcaggcaatgccgattaccatcagcccgcgcaatggcgagttgcaggtattcaaggttgaagacaacgccaggccggcaatgccgatcggcagggtcgccagcacgatcgccaccgccagcttgaaccacgggtcgttgtagtcgccccggcgtaccgcactgatgctgccggtggtgacctggcgcacatcccgccagaagtaactgaccaccgccgccagcgccgccaactgcatggctgcggaaaacgccgagcccgggtcttgccagccgagcagggcgggcaccacgcgcatatgcgctgtggaagacaccggcagcaattcggtaatgccctggattacaccgaggatgaaaatctgcaggtaatccagggaggcaaagcctacatccaggccggcggtacagacgttggtcaaaatacaagtccttgagtgaaaggtggaagccggcgaagtttattctaaatgtttcaggaaatttgcccgggcaagcgctatctgcaatcggttcagccaatagaaaggattcgacaatccattggcgtgaccggcacttttgtgaacaatggcgccctgcgttttttcaccgagagccccatgcctgaaaccaccgtcgaattgatccagaccggccccgaagacgccgagctgatccgcaatctctaccagtactacgcctacgagtcttcggactgggaacaggaagatgtcgaggccgatggccgtttctatatccatgacgagcacctggcccgctactggcacgacccacagtggagcgccaacctgttgctggtcgatggctatatcgccggtttcctgttgatcgaaggcagcgaactgccgggcatcgacgccttggaactggccgacctgtttatcctcaagcgctaccgccgcaaaggcatcggccgcgccattgccagccaggtgctgtgcagcgcagaggccaattggctggtgcgattctatgatcaggacgaagtgtcccaggcgttctggcgcaccgtgctggataacctgccgcgcccggtacagatgattgaactggaggatgagccgcagttggtgagctacctgattactcgggttttgctgcattgacgggcgggttttgctgaggttaaaggctgcacaccgtaactgatgccccgagatcaaaatgtgggagggggtttgcccccgatgccggtgggtcaggcccagtatcaggcgactggctcaccgccatcgggagcaagccccctcccacagttcgaacgccaacaactcggctacgggcctagcctggattgaacaacacctgctgcatcgcctggggcggttgcccgaaggccctgagaaacgcctggcgcatgcgctcgcgatcaccaaagccggtttcgcgggccaccacttccacggggtgacggctggtttccatcatcgcccgcgccgcttccacccgcagggcttcgatggccttggccggggtctgcccggtttcttcgcgaaacacccggctgaactggcgcgggctgagccgggcgacgtcggccagggcttctaccgataaatcgtgggtgaggttttcacgggcataggccagggccagttgcacgcgatcggacttggggtccagttccagcaaggccgacagttgcgattgctcgctgccgcggcgctgggcgatcaccagcttgcgtgcgatgcgccgggcgaggtcgctgcccaggtcgttctcgaccatggccaacgccaggtcgaccccggcgctcatgccggcgccggtccacacctggccgtccaccacgaacagcttgtcttcttccaggcggatatccgggtagcgcttgcggaacgccggcgcgtggatccagtgggtggtagtgcgcttgcctgccagcaaaccagcctcggccagcacaaaaatgcccatgcacaacgaggccacgcgccgcgattgagccgacgccgccttgaccagctccagcaggttggcctccggcaggcgaaactccaggtaaccgctgacgatcagggtgtcgtagccctctggccggatcgctgtggtgttcaccgaaaagccctgggaggtcatcaccgcgccgccgctttccgacaccaggtgaaactcgtaggccggctcaccgcgcagcaggttggcgcactcgaacaccgagcccaggctgaggctcaaggattggaaattcgggtaaaccatcagcgcaacgctgtgcattgcatctctccaaagggcgggggagaggcgattgtcggcgtgcgccaggaaaacggcaaccgactttggctcatgtccggaatccttgcggatatgacattgtgagccgttgcctcgctgcctaacatggcctcaacgaactagacgactggtctaatcggatgaggtcaagcatgaaccacccaagtaaaagtgcaaggcaggcgatccttgaacgtgggcaatcgattgtcggtgccaagggattttccgcagtgggcttgaacgaaatcctgcaggctgccgaagtgcccaagggctcgttttatcactacttcgattccaaggatgcgttcggtgtggtgttgctcgatacctatttcgaccattacgtccaaggcatgcaggctctgttcgatcagccggggttatcccaccacgccaagctgatgcgctattggcaatgctggatcgacaatcacacgggctgcaccgacaccggcaaatgcctggccgtcaaactgggcgccgaggtctcggacctgtcagagccgatgcggttggccctgctacgcggtactgcacgcaccattgaattgctcgccgtagccctgcaacgcggcgtggaagacggctcgctcaccttcgagcaagcccccgaaagccttgcccaacgcctgtatgcgctgtggttgggaaccagcgtcatggccaagattacccgtaccactgcgccgttcgccgaggcgctgttgctgacccgacagttgttgggtggctctgaaaaccttgttatccactttgatcgaggcactggaaaatgaacgtattaatggtactgacctctcacgaccagcttggcgataccgggcgcaagaccggcttctggctcgaagaatttgccgcaccctactatgccttcaaggacgctggcgccgaggtggtgctggcttctccagccggcggccagccgcctctggacccggtcagcgacctgccggacttccagaccgagcaaacccgtcgcttcgccgctgaccctgcggcgcaacaggccctggccaacaccgtcaagttgaacaccgtcaacgccaacgacttcgatacggtgttctacccaggtggccacggcccgttatgggatttggcggagtcgtcggtgtccatcgcgctgatcgagtcgttcgaacgggccggcaagcccatcggctttgtctgccatgccccaggtgccttgcgtcacgtcaaggcggtcaatggtgagccgttgatcaagggccgccgtgtgaccgggttctccaactcggaagaagcggcggtggaattgaccgatgtggtgccgttcctgattgaagatgaattcaagaagttgggcggcaagtatgagaagggtaccgactggcagtctttcgtgatcgtcgatggcttgctggtgacgggacagaatccgggtagctccagcgaagtggccaaggccctgctgaccctcatcgcttaactcaattaaccgctatgcgcatttggcgacttcccggagtcgccactgttttcgttcgccctgaatttggactaccccatgcctgactgcatcttgaacaccccgataaaactggggcatcaccgcttgaacaatcgcatcgtgctgccgcccctgacacgccagcgcagcgcccaaccgggggatatcgccaccgacctgatggccgagtattaccgccagcgcgccagtgccggcttcatggtcagcgagggcacgcagatcgagccccgtggccagggttacgcctggacgccgggcatctacagcccggcgcagatcgatggctggcgcaaggtcacgacggcggtgcacgccgagggcggggtgatctttgcgcagttgtggcatgtagggcgggtgtcccataacgccttgcagcccgatggtgcggccccggtagcgccctctgcgttgtcggcgttgcaagccaaggcctttatcgaaaccggcccgggtgtcggagagctggtgcaaccgcctgtgccccgggcgctcacgacgctggagatcgaagagttggttgggcactacgcccaggccgcacgcaatgccctggatgccgggttcgatggcgtggaaatccacgcggccaacggctacctggtcaaccagttcatctcggcccattccaacattcgtgaagatgaatacggcggttcgctggacaatcgcctgcgtttgttgcgcgagattgttgaggccgtgtgcaaggtggtcgggcctgagcgcctgggcgtgcgcttttcaccgttgttcagcggcaccgaccaggaccgtgtctacatcggcctggtagaggaagacccgcaccacacctatatcgaagcgatcaaggtgctggaagcgtcaggcatcgcctatgtgtccatcgccgaagccgattgggaaaacgcccccgacctgcccgaaacctttcgccaggcggtgcgcagtaccttcagcggcaggatcatctacgccggccgctacaccgccgagcgcggtgctcgattggtcgaggccgggctggcggacctgatcgcgttcgggcggccgttcattgccaacccagacttgccccagcggatcttcaatggctggccgttgaatgcgttgaaggcagagggtttgtatggcgggacgcaggcggggtatgtggattatccggtgtatgccgaaccagagtgacacacgcactaagtgggagggggctttgcccccgatgacggtgggtcagccaacatcaatgtttgctgggccgacgtcttcgcaggcaagccctaatgccggtcagtcaaggctttatgtaggagcgagcaagctcgctcctacagagggcgatgtacgcttaagccggtcgccagggattgagaaagcacctcactcgacccgcaacacaatcttgccaatatgatccccaccctccatccgtgcatgggcttgggcggcgtcggtgtattcgtagaccttgtcgatgatcggcaggcagcgtccagcgctcaataccggccatacgtattcgcgcagttgctcggcaatcgcggccttttcgtcgcgggtgcgggcacgcagcagcgagccggtgatcactgcgcgtttggccatgatggtcagcaggtcgacgtcatgggccttgccgccgccgaggaagccgagcatcaccaggtggccgtccatgcccagggacttgaggttgtcgttcaggtatgaggcacccatgatgtcgaggatcacgttcacgcctttgccgtcggtctgttgggcgatgacctcggcaaacgcctgttcgcggtagttgatcggcgtggcgcccagcttggcaatcgctgcgcatttttcagcgctgccggcggtggcaaacgcctggataccgaactcctggcaaagcatcagcgcggtggtgccgatgccgctggtgccgccgtggatcaaggcgcgctggcctttgtgcgcaccgcccaggccaaacaggttggcccagaccgtgaaaaaggtttccggcacggcagcggcctggatccagtccatgcctgcagggactggcagcgcctggctggccggcaccgcgcaaaactgggcatagccgccaccattggtcagggcgcagactttgtcgcccaggcggtattcggtcacacccgtacccagtgccaccacctcaccggccacttccagccctggaatcggattcatgcccggtttcatcgggtatttgccggcgcgttgcaaggcatcggggcggttgaccccggcggcgtgcacgcgaatcagaatctcgcctggcccggccaccggcacgtctgctcgacgtggctgcaggacgtcggggccgccaggggtggtgatttcgatcagggtcatttcttggggaagcgtcatggatgagttcctgtagcggtgagcgtatgagttgggaccgtggcgcatagtcggcagttcagccagatcatgccgggttacggtggcaatgcaaccctagggggcgcacacgggtgtctttcttcgctgcttagcatagcgtgctctggtgatgcaataatgcagcgaataagcagcgcaatgctgcaactacgcatcgttgggggtcgctatgaattgggatgatgcgcgggtgttcctggcggtgtgccgtgcgacgacatcgcgcggcgccgcccgggtgctgggggtggatcaggccacggtagggcggcggatcaatgctttggagaaatccttgggtgccaccttgttcctgcgcaccagcgacggctttgcactgacggctgtgggggaggcggcgttgcgttcggtggagaaaatggagcgctcagccctggacctcgagcgccagatccagggcatggatgatcgcctcaccggaactgtgcgcgtcagcaccaccgactcccttgccattgatttcctgatcccggccattgcgcggctgcacgaccagcatcccgatgtgcgcgtgcagttggacgcctccactcaattcctcagcctggccaagcgcgagaccgatatcgccgtacgcaacgcgcgcccggacagccccgacctgcttgcccgtcttatcgggcgttggccggtggggttgtttgcgtccaaggcttatatcgaccgccacggcgcgccggagccgggcagcttgttcgatgggcatgacctggtggtttaccagccgcacctgcaaaaccagaaggacctgaccctggcgtgcgaacctttgggtcgcgggcgcatcgtcgccgccttgagttccagcctgttggtacgccgctccatcgccgccgggatcggcatcggtgagctgccgattctcaccggcgagcgcgacggcctggtacggctgtggccgcaacgcacgcggccgttgccctatgacgtgtggctggtcacccacgccgacctgcgccataccgcgcgggtgcgagtggtgatcgatgaaatcgtcgcgggattcgcggccgcgatggcctgaggtcagcacaagcctgcaagcgcatgggtgcgactgtggggacactgcggtcagtcattgtcgacggacacaggtggtctatgaacgaagcaagaaatcagaatatcgggctgttgttcctgcgggccagcggggcgttgttcctgttgtgggtacatgggttgcccaagttgctcaacttcagcgaacagttgaagctgatcgaagacccgtttcatcttggggcccaggtcaccttgttgctggcgattttcgccgaggtgctgtgcccgctgctgatcatcgcgggtgtgctggtgcgcctggcctgcctgccgatcctggcggtgctggtgattgccttgctggtggtgcacccggagtggacgctgttcgagggacagttcggctggctgctgttgatcatctttaccagcatcctcattgccggaccgggccggctggtagtggctcagcgtttcgcctgagcaaaaaaaggccgggcgagcccggccaaacaaggagaggatgtttcaagcggttcagcggttcaggaacgccagcaggtcttcattgagccgctgggtgtgggttgcagcaaacccgtggggtgcatccttgtagactttcaattgcgcgtctttgatcatctcggccgcgaccttgccggtggtctcgaacggtacgatctggtcgccatcgccgtggatcaccagggtcggcacgttgatcttggccatgtcgggacggaagtcggtttgtgagaatgcggtgacgcagtccacggtggatttcagcgaggcttgcagggcgatctgcagggtttgggtgagcacgccctccgagacttcctggcctttgttgaggccgaagaacggggtgttgaaatcgctgatgaattgcgcgcgatctttcaacaggcccgccttgatgccatcgaatacgtcagcggggacgccctgggggtaatcaggcttctgaccaaagatcggcgtcaccgcccccaacagcaccaggccggcgacacgggcactgccatggcgggcgatatagcgcgccacatcaccgccacccatggaaaagcccaccagggtcacgtcctgcaggtccaggtgttcgatcaactgggcgatatcatcggcgaaggtgtcatagtcattaccggtccagggctggtccgagcggccgaaaccacggcggtcgaacgcgatggtgcgaaagccgcggctgctcaggtattccatctggtattcccacatgtcggcatccagcggccagccgtggctgaacagcacgggcttgccgctgccccagtccttgaagtagatctgggtaccgtctttggcaacgaatgtgctcatctgaatctccttgcttgagtgataagagcagtgaaaaatccgcgttactattgccgtaaacccaaccacaggcttgtacgggtgtgcttgcctgggcttaccaactgaacttgagctccatgcccaggtagttgctgtcgtgcccgccggcatcgcgcagggtttggccgacggcatagtgcacagcttcgactgcgccactgaggttggacgtaaaagcgtagtcggtgcgcagttgaccgtaggcgccagtccagcgttcaccctggccagcggtgccggcgatggccaggttgggctgggtgtagaccgcgtccgcggtggtctgccgccagagcaagccgatggcggtttgcacgctgagcttggcgatgggcttgacggtgatcgacggcttgacgtggatcaggttgctgtagccggtataaccggccagggaaaaatagtagccattggggaacagcgggttgaaggtgccgacgcgaccgtcaccgctcttgcggtcaccggaggcgacatccagttgcaggccgatacgtggtttccatgccagtgtgtcgaaggtgtagccagtgcggctgccgcccgcccaggcgcggatggtcttgctgcccaccgagcccctttgcagcatggcttcgatatcccagtcgaacccttgggccgcgccacccaggcgtgcgtcgagcagctggcgggtctcgtcgccgtcggcgtccagatagtgcgcggccctgcgttcgtagacgccgtaataggctgacagctcattgctgccgcccaccagacgctcgacccgcagcatgtgaaagcgcgcatcacggttggatttgtcatcgaaatgccggccatcctggtactgcaccggttggctggcaatcccgataaaacgccattgtggcgtttcccaatcggcccacaacgcatcgaaggactgccgcacattcgggccgtcccgtgacgagatgaagcgctgcaagtcgaaggcaaaatcctggcggccagcccgtgccttgaacgtgccggcgctgaaggtctttacgtactcggcaaaggccaggcgcaggtcgacacggttctggtcggcaccgccgatcgtggtcttgtcataagcccgcacatcctccagctgggtgaacagccgccaatgctcgtccaggtgcaagtcggcatgcacctggaaacgctggatcaggtagcggtcacgctgcacatcgcgcacgccgaacccgctggcgtcgttcatctcgaagcgttcgcgcaacgtcgcacccaaagacagataggtgaacgggttggcggcgggcagcgggatgtactttaggttgtccaatggttgcgtgcgcagtgccggatccttgagcacggaccagtcctcctgccaacgattggccttgatcgccggacgggtcggttgcgcgtcggcgtgggcgctgccggcaagcagcggccacagcacggccaggccccagcctgtacggcgaatcattttgccgcggtgagctggtggatttccgcgacgtagccgccggggaattccaccaacgcgctgcgacggcgtttgctgtcgaagctcggcaccagcactttggcccctgagccggtggccttggccagcgtggcggtcaggtcggccacctggtaaccggtggtttcatggccaaaggggtagggcagttggccgttggtgaccagcaccgccatgcgcccaaatggcgactcgatgtcgacgcgtcggtacataccgccggcctggccgacgtcggccccgggcgcctgcttgtcatcggcaatgactttgccatgggagaaaccgacgaaggccttgataaagcggtcggcacggtctgcgctgaggtacacgcggttttccggcaccgtctggaaggcggcgtaatccggagtcttggtgtgccagtagagttgcatgttcacgccgcctggccactgcaccacggcatcgcgaccgatggggtcgggaaagtcgctgacgatcaccgcggcaccgttttcccgggcggccttgagcgctacgtccatgtccttgaccaggtagccattgcgttcctgaccaaacggatgggggatgggcgtggtgaaaccgaacagcgacaccgtaccggccggggtctgcagcaattgcgaggtggtgctgcttggcactggcagtacattgaccactacctggggcgtactcttgccgccgaacgtggccaggaagctctgggcaaaacgctccacatccgccggtgccacatacacatggctggtgtcatattgcggcgctacggcgaccatcggcgtagccgcccaggcgctgcccatcatggccccagccagcaacgtcactgccagggataccgccctcacttgcctactcatgcctagtctccagcgctgtcaagaaagtcaaaagcttaggggctcaggcagtgacgccgattgtatgggcgtgcttggttgaacggttcagcgtctaagcgggtcaactgcttctcaacgtcagatcacacaggtgaacgaaatggccaagacttacagctacgccgcccagaacgccaaggacaccctcaagccctacaccttcgagcgccgtgcgccgggggctgacgatgtacagatcgacattctctattgcggggtatgccactccgacctgcacaccgtgcgcaacgaatggcacaacaccctttacccttcggtgcccgggcatgaaattgttggccgggtgacggcggtgggcgccaatgtgaaaaaattcaaggtcggcgacctggccggtgtcggctgcatggtcgacagctgtcagcagtgcgcatcctgcgcggagggcgaggagcagtactgcgagaacggctttaccggtacctataacggcccggtgttcggcggtgaaaacactttcggcggctactcggacaatatcgtggtcaaggagcagttcgtactgcgcatctcccacgacgcctcgaacctggcagccgtggcgccgttgttatgcgcgggcatcaccacttactcgccgctgcaccactggaaggtcggccccggccagaaagtcggtgtggtcggccttggcgggctgggccacatggcggtcaagattgcccacgccatgggcgcccacgtgacgctgttcaccacctccccgaacaaacgcgaagacggcctgcgcctgggtgccgaccaggtggtggtgtccaaaaacgcggatgaaatggccaaggtcgccaatagcctggatttcatcctcaacaccgtcgctgcaccccatgacctggatgccttcctcaacctgctcaagcgcgacggcaccatgaccctggtcggcgcccccgacagcccgcacccgtcgcctacggtgttcaacctgatcttcaagcgccgcagcctggccggctcgctgatcggtggcatccaggaaacccaggagatgctggatttctgtgccaagcacgggattgtctcggatgtggaaatgatcgatatccagggcatcaacgaagcctatgagcgcatgctcaagggcgatgtgaaatatcgttttgtaatcgatatggacagcttgaagcgagaaaaccacgcagcctgaaacgccgcggatccagtgtaggaggggcggtgccccaatgaccatgggtatttacacaactttggttacgccgctggacctgtgggagggggcttgctcccgatagcggcctcacagccgacgaggatgttggaccctgtacatatccattatgtaggtaacggccgccatcggttccgctcttacagcggctcacttttggaaggaccggaatgccggcccagccaaaagtaagcataaggtcctcgccccaccactcggcacctcgcccaggctcggtgtgcccgtaatccgacttggatttggggggcggccgccacgcgccatccatggcgcggggcggctaaaccggcatacctgccggtttaccccccaaatccctgtcgaattccggccagcgtggtttgacggggcgcctgagatcaaaagcagatcaagatcaagagcggctcgcttcgcatcatggttactgatggtggctgcgtgagttgtgtagatattcatgagccgatgagggagtgtcagatgaacatatctgaggctgtcccagcgtcatcgggagcaagccccctcccacattttgaccgagtaggctaaacagctcgcagttgggtatcacgccaccataatgatcttcgacaccaactccaccacggtcttggcctgcagcttcttcatcaaccgcgcccgatgcacctccaccgttcgatgggagatcgccaggcgcagggcgatttccttggacttgaagccattgacgatgtgcatggcgatctcgcgctcccgcggtgtgaggtcgccggtgccctggtgcaggcggtccaggcgttcgaagtgccagatcatcagtttgaacgggtctttgggggtgagggtgtagccgtgggacttggcccagaagacttcgccgttatgatgctgcatgaagcgctcatcggagtaaaagccgttgtcgctgtcgagcagccagtcatggctgcgcttgccgatggcgtggtagtcggcctgggacgggtagatcagcagtgtcaactgattgaccagcgcgtcgcgtgtatagccgaacagtttcaggaaggcgtcgttgcagtcgagtatcacacgattgctcgtgacgatctgcggggcaggagacagcttgaacgccaggcgttcgaggtcttggaattgttgtgctagcgcgttcatgggcgtcctgcctcgttgttcaataccctggcgcgctacttacctatgtaagtagttacacgaattggcgcgcgaccgggggtgggtcattgtaggtaaagtccggatcaagaacagaagaaattgattatgcctgctgattgcgtctccattgttgccgctggtcactcccgtttcggtcgcctggaaggcaccacgctggaagacttgatcgtccaggtcacccgtgaagccctgagcgacgccgcgattgacgcgtcgcaaatcgacgcgctgttcctaggccatttcaattcggggctggtgcccgatgggtttgctgcctcgttgctgttgcaggccgaccccgggctgcgcttcaaacccgccacccgctgcgaaaacgcctgcgcgtccggctcggcggcgatccaggcgggggtcaatgcgattctctccggcagcgccgaactggtgctggtggtgggcgccgaaaagatgacccacaccagcaccgccgccgtcacccaggccctcgccggtgccggctaccagaatgacccggccgaagccggcctgagtttcccgcagctgtttggccgcgctgcgcagcaatacgccgagcgctaccactgcccgctgggctcgatggcggccatcgccaccaagaatcactccaacgccatggccaacccgctggcacagatgcatcgggaaatgaatttcgagcactgcaacaacgtgtcccagagcaacccgttcgtggccgattccctgcgcctgaccgactgctcgctgatcagcgacggcgccgccgcgatcatcctggcgtcgcccaagcgtgcgcgggcgtttcgccgcgatgtgcagatccgggcgatgacccaggtcaacgacaccttgcccatcgcccagcgcgatatcctggcgtttgagggcccgcagcgggcaatacattcagccctgcgcggggcgaatgtgaccctggccgacctgagcttcgccgaggttcatgactgcttcaccatcgccgagttgctgatctacgaagccatgggcctggcgcccaagggcgaggggcatcgcgtgctcgacagcggcgtggtgcgcgccggcgggcgcttgccggtgaatctttccggtgggctcaaggccaaggggcatcccgtcggtgccacgggggtctccatgcatgccttggcgttccggcaattgaccggcgagccgattggcctggcggcgcccaacccggaatttggcctagtgttcaacatgggcggcatggcggtggccaactatgcctcggtcctgcaggcacgccggagctgagccatgaacattgccaactggctgcacgatacccagcgtcgtaccccccaacgcccggcgctgttcgacggccccgtgcaggtggccgactacgccaccttcgccgcccatgtgcgtcaacgcgctgcgcacttggtggaccagcacggcctggtgccgggagatgcggtggcgctgctgatgaaaaacagctgtgactacctggaattgctctacgccatctggtggatgggcgccgtggcggtgccgatcaacgccaagctgcaccccagcgaagcggcgtggatcgcggacaacgccgaggcgcggttgatctttaccgatggcgggggggtgttttcatcgcgggatttggccccgcgctgcaaagaactggacggccacctgcggccgccagaccgcggctggccgaccctggagcacccggtgccgcgccaggatcaggacctcgcctggctgttctatacgtccggcaccaccgggcgctctaaaggggtgatgctgtcccatggcaacctggtcgcgatgtcgctgtgctacgccacggatgtcgatgcggtcaacgctgacgatgcggcggtgtatgccgcaccgatgtcccacggtgcagggctgtataactttatccatgtgcgctgcggcgcacggcatgtggtgccggcctcccacggcttcgacgccgccgagctgttcgggttggcagagcaggtgggccaggtgtcgctgtttgccgcgccgaccatggtcaagcgcatggtcgagcaggcccgacgccaggattatcacggcgccggcatcaagaccatcgtctatggcggtgggccgatgtacctggcggacctgcgtgaagccgtcgacaccttcggctcgcgcctggtgcagatctatggccagggcgagagcccgatgaccatcagcgtattgccccgtgcagtgatcgccgaacgccagcgccctgactgggacagcctcgccgcctcggtgggccatgcgcaagcctgtgtggaaatccgcatcctcgataccgagcaccagccactgcccacgggtgaacgcggcgaaatcgccgtacgtggcgccacggttatgcaaggctactggcgcaacccgcaggccacgcgccagacactggtggacggctggctgctgaccggcgatatcggctacctcgacgcggccggctacctgaccctgacggatcgctccaaggacgtgatcatcagcggcggcagcaatgtatacccccgtgaagttgaggaagtgctggcccagcatcccgacgtatttgaagtgtgcgtagtgggagaacaggacgcgcaatggggcgagtcggtagtggccttcatagtcacccgtagcggccagcccctcgacgaaagcgaactcaccgcctggttcctggcgcgcatggcctcgttcaaaaaaccgaaaaagtacgtgtggcgtagcgagctgccgaagaacagctacggcaagattctcaagaccgacttgcggcagtggttgaaagcagcgagtatcgccgcgctttgacatggatcgacaatcagacaaggagtcccctcgatgggcaatcccgcacaagacactgtccgcaagcgccgccgtgcgtttctgggtgctacctccggccacttgatcgagtggtacgactacggcgtctacggttttctcgccgtctatatcggtcaggcgttcttcgtctccgatgaccccaccaccagcctgttggccagcttcgctgcgtttgccctgagcttttttatccgccccttgggcgggctgttcttcggcccgctggcggacaagatcggccggcgcaaaaccctgatcatggcgctggtgatgatgaccggctccacggtgatgctcggcctgttgccgacctacgccagcctgggcattgccgcgccgatcctgctgatcctggtgcgctgcgtacaaggcttctcggccgggggtgagatcggcaccgtcaccagctttatctccgaatacgccggccctggccgccgcggcttcgccacctgctggttgatggtcaccgccgtgcttggcctgttgctgggcggcgccgtggccaacggcatgacctgggtgctgggcgcagacgtcatgcaggaatgggcttggcgcatcccgttcctgatcgccgcccccctgggctttatttccatgtacatccgcctcaagctcgaagacagccccgagtttttagccctgcaacgcgccgggcaaacctcgcgagcgccactgcgggacgtgtggcagtacaagcgtgcgattgccctggtgttctttatcatcaccctgcacagctcgatcttttacctggtgctgaccttcgcctcgacctacatggccaagatcctcaagttcgacagcggtacgaccttgctctacgtgttcgtcgccagcttttcggcggccttcgtgatgccgtttggcggggcattcaccgataagtacgggcgcaagccgtttctcatggtgatcggtacgttggcaaccctggcaatgttctggctgttcaagtcggcccccaccgccacgcctgcgtcgttctttgcgccgctgatggcggtggcgattttgttcgggctgtatgcatcgtcgacctatgcgttgatgagcgagctgctgccgacgcggattcgctccaccggaattgcggtggcgtataacgtaccggtggcggtatttggcggcagtgcgccgttgatttccacctggttgatcaaggtgacgggggatattacttcgccctggtatttctacgtggcgaccggggttgtgtcgttggtagcgttggtggtgttgcgcaaggaggacttcgtcgccagcggtctgccggttgcagtgccggcggatgcggcattggcctgatgccaaaatgtgggagggggcttgctcccgatggcggtgagtcagtcacggatgcacttactgacacgtcctcatcgggagcaagccccctcgcacattttgagctgcatacgtctgcttaatggttaatagtgggcatgctgtaacctaccgaaaaccgagtgagttgcgatgctggctacccgtctgaccctgatctgccacgccgtcacccccctgcaaaaacaggggcgttttcccgacgacgaatccgtggccatggactggcagagtgcggcgttatccctggcaggacgctataaaaaaacaaccccgcctgctgtgcgcccccgaggccagagcacgccagacagccagcttgttcggcgataatgccgaggttgaaatggcgctgcgcgatgctgatttcggcttatggaaaggccaggacatcagccaactcgatagccaagagttgacggcctggaccaccgacagcaccagcgcaccccacggcggcgagtcggtggaacaggtttgcgcccgggtgggccaatggctcaaatccctcgaaacccatcccggccacgtagtcgccgtgacccacccgttcatcatccgcgctgcgatgctgtacttgttgcagtttccggtttcgatgttctaccggatagatgttgagccattatcgtcggtggagttacggttcaatgggtgttggcggttgcggttaatggcgtgaaacacgcatgccttaccgctcggtacaggcatgtggcaaaatggcattacttgtcggtgccagtgcccggtccacgacacacgactttttggattggcctaatgattgacgggttgcgtaagggattctatgcagatgaacaagttgattgcggtcaagacaggtacgaataaatttgaattcgaaaatgaagagagcctgaaatggaatggctttttcgatgtggatacgattcggttaattctgggtaataacggctctggaaaaaccgccttgttgtgtgacatggcagcgtatatttcatcgcctgtctctacccctcgaagagccgtttatgatgatcgggaaacatcgtcggagaaactgtctgacgaagagcttgaacgtattggtgtgatttacttttctcctgttccctaccgccgcaggctaccgtttcgtaaccgattcttcgatgcttcgcctcggtttggaaaggtagaagactctgcgcgagtcgagcagttctaccaagtggccagcgatctggaactgaacacaagcttgagggcagaagtatgttatgagtttgagctgttcaagaccgtgttggctcccgcgcttgtcgtcatgagcaagcttgccggttttcaaacagcgcacaagccggtgattacctttttatctgaatacgcgaaaattctaaaaaagcgccagtttttcagctcggattactatgaaaatgagcgctcgaatatccagattgagcgttcgctcgatacctgtgtgcttaggttggagcgttttgttctgtcgaagcttccccgcgccagaagcgaaaaaatagtcatgctcgctgccttaacgtcagtcgcaaagaaaattcctgatcatgatcgtattgggcgatttttctttaattttttcgagctcgccagcgatgttcgttacgaacgggatgaggaagtattcgatttactgatgacgactcagggcgccacgcttaagtctataaaggatggagcgaagggtgatattcgcaaacacccccgatcctattcatttgctataagttcggcagcagaaatcaaaaaaataaaaatgtcgaccgctgcagtcgaagtgcgttggacagatcaaagctcgggtgtaagagccttggttgaccagttttttttgctccgccaaggttttgtaaccatggccgcgaaaaaattaaaccacgtcatggtgcttatcgatgagggcgatgcctatcttcatctggaatggcagcgccgttatatttatttgctgaataaattcctggcaggggtgaaatccgagttccacatggagatcgtgcaggtagtggttgccacgcactccccggtgataacaggtgattttccagcgtgtatggtcactaacctggatcagaaggtcacgcctcagaatacgttcgcggctccattggaagacattatcctgaactcttttggaactgctgccattggtgagtttgcggcggaaaagataaatgcactcaatgagcgtcttgaacagggcgtttcttcggcattggataaactattgcttgagagcattggcgatattggcatcaaggacgcgctataccgtgctccggagaggcgatatttatgattattaatattgcgcgggtgtgggaggatatcgcggtcaggcacaggttattcatgcaatggaagctgcaacggctgactgatgtcttaagggaattcgtcgggccgggcatgattcagcatcgtcttgtcgagtttttggataaacaccggggcgccatatgtgggtgtgaccccgtgccgctgccgggtgtgattgttgccttcaaccagacttttactcgtagggttgatattgactatgtaaatgggtttttcaaaaaatatctgtgctataaggagttttcagccaaagagaaggttgtcttgttaaaaagatgggatgcctacgcgttgcttatatccaatcgatcgagaatttgtccttactgtcatatatcacccattgatacttatgtcagtcctgatgggttgaaagcgtacaggccaaatattgatcactattacccgcacgccgaatttcctttgctggcattaaccatggggaattttatcccctgctgcgaaaagtgtaacgggccgcaaatgaaaggcactacccggtttgacttgacgcctcacctgcaccccttggtggatccggagaacatatctttcaggcttgcacataagggcgggaagttggacttgaataaattaagacttcaggccgacagtacgtcctatgaaattgaggtgatggcaacccatggcacctgccagaaggtggacaattcaatcgcgacctttcgcttagtccctcgttatcaggtctgcgtacccgatgcgctatttgtggcgaaactctccagactagggggtagatacaggatgttgaccaagatactgacaaaactgaatttctctgacaaacaccccctgggctttaatgaagcggacgacagctataaaaacgtgatcgcaggtaaactcaaacttgacatcgcccggcagttcaaggtgatttgacccagcagggcaacccagtaacatggcagcattttcacgcccggcactgagagcaccccatgaaacgcatcctgatcatcggcattggcgccggcaaccctgactacatcacgatgcaggccgtgaaggcgctgaaccgtaccgacgtgttcttcctgatggataagggccagagcaaggacaagctgatcgacctgcgccgcgaaatctgcgagacctatatcaccgagcccggctaccgttttgtcgaggccgactgccctgagcgcgtgcgtggtgaggtcgactacaccactgctgtgcaggaccttaaccgcgataagcagcaaaccttcgaacgcatgatcaacgaagaaatggctgacggtgaagtgggcgcattcctggcctggggcgatcctgcgctgtacgacagcaccatccgcattttgcaggcgatccttgccagtggccgttgcgtgttcgaattcgaagtgatcccgggcatcaccagcgtgcaggccctggcagcccagcataaggtgccgctgaatcgcatcggcaagtccatcgagatcaccaccgggcgtcgcctggcagcggggcaggcgagtgatgccgataccctggtggtgatgctcgacgccgaagactcctaccgcagcgtcgccgaccaggacctggagatctactggggcgcctacctgggcacgccggacgagatcctgatcagcggcaaagtcggtgaagtagcgcaagagatcgaacgggtacgcaaggctgcgcgcctagccaatggctggatcatggacacttatctgttgcgcaaaccctgaggacgcttccccatgctcaaactgtttgccctggcgctgaccctggtcgcaagtgccgcccacgccgactccaccttgcacaccgacttgccgctggcgtacctggaacagacccagggcgatgcgcgcaaccagccgctggtgattttcctgcacggctttggcagtaacgaggaagatttgtttggcatcaaggacgcgttgccgtccacctggacctacctgtcggtacgcgcgccgatgccggtggagccgcagggttatcgctggtttaccaagacgcccggtgacggtgagtacgacggcgtgcccgcagacttgcagagcagcgccaggctgatcagggaatttgttacgaaggccacggctaaataccacacacaaagcgaccgggtgtttctggtggggttcagccagggcgcgatcatgtcttacgaagtagcgctgcgtgatccggagttggtacgcggtatggcggcgctcagcggcagtgtgctgcccatgctcaagtctgcgctcaaaccggatgaatccatgggcaaactggcgatctttatcggccacggcacgttggaccaggcgctgccatatacgtcagccactcgggcctatgaggtgctggcggggctgggcttgaagccggagtttcatggttatccggggatgaatcacacgatcagcgaggcggaagtgcaggatctgaaagcctggctagagaaaaacttgaagtgaaatgcggttaaaaatgtgggaatccccaccacatcttcgatgtgacgctgtcgcgcagcaacctgggccgcctccaaaatatccggcgttaagactgaattttaactatttaaaatcagtagcttacttgaagtttgataagaggggggcttgcccccgatggcggtgcgtcagttatagatgtatcaactgacactccctcatcgggagcaagctgcctcccacatttgatttgtgttgtctgggaaaattgggttacttaccgccagtaatctgcttcaccaactgcgcatgccccttcacatcatcagcccgggaaatcgcctggatcaccaacaattggttgccggaaccgccgaggatagtggagttcaaggtcttgccgccgccctgggtagcagtgctgtccacctggcgcagaccgaggcccttgtaggtgagtttcttctcgccctgtttcttgaagtcaggcagggcggcgctctggtccttgacgaaatcggccaccgcgccatcgaggaactgtggatcgttatccttgatggccgcgccgtctttgcgcacggtttcggcgacgatcaccacgcttttcgtggtcgggttggcgtacagggtgcctcgggtatcggcggtgccgtcatcggccttgccagagggcagggcatcggcactgtaggccttgggcaggtcgaaagtgaacttgccacccagggtggagatcgtctgcgtgtctggcttgggggccgcgaatacgctgccggcgctcagcgccaggctcagcagtagtgcggacttggtgaaagtggccatgaagcactccagggatgaacgaaattgcgatctattctgtcagaaaattcgtaacttcgttcatctccagcctcagaccttgccagactcttcctcaagcctgtccatctcgaacagtcgcgccagctccgcccgggcctcctgggcggtttgcatgactttggccgcgtcgtcgtacaccgcgtgttgggcggcgagcacttgctggtcgtgattcttgaagcggttgatgcgtgcgtcagcctgagcctgggtcaagcccaggccgaccagggtgcggcggctcatttccaggcttgaatagaaggtttcgcgcaccggtgaggcgtccaggtctaccagccggtgtacgtgctggcggttacgggcgcgggcgatgatcttcatatgcggatagaggttgcgcaccagttcggcagtcttgatgttgatctccgggtcgtccatggcgatgacaaaaaattccgcctggtcgaccttggccgcatgcaggatttccgggcgctgggggtcgccgtagaacaccggcatgccaccaaagctgcgggtcagctcgatggtttccaccgaggtgtcgagggcgatgaacgaaatgttctgcgcacgcaggatccgcgccacgatctggcccatccggcccatgccggcgatgaccacgcggggggcgtcgctctcgatggcgcggtattcctccggcacttccaccggcttgaccttgggcttgaacagcttcgggcacaccagcagcaacagcggggtcacggccatggacaaggtgatggtcagcaccagcacgtcgtagaggtgcggttcgaacaagccctggtcgcggccgatcttgaacaccacgaaggcaaactcaccgcccgccgccagcaccacaccgaggcgcaaggcgctttcgcggttgaggtcgcccaccattcgccccacggcatacaacaggggcagtttcagaccgatcaacagcaaggtcaggccgatcactaccagcggcgtgctgaacagcaggctgaggttggcacccatgcccacgctgataaaaaacagtcccagcagcaggcccttgaatggctcgatctgggattccagttcgtggcggtattccgagtcggccagcagcaggccggcgaggaaggcacccagggccatggatacgccgaccaactccatcagccacgcggtaccgatcaccaccagcagcgcggtggcggtggagacttcgcgcaggccggtcttggcgacgatgcgaaacaccgggcgcagcaggtagcgtccgccgatgatcaccacggcgatgctgcccagcacttgcaacacatgttgcaggccctgggcctcggtagtcgggtgatcgctgccggccagcaacggcaccagggcgatcagcgggatggcggcaatgtcctggaacagcaaaatggcgaaggccaaacgcccgtggggttggttgagttccttgcgctcggccaggctttgcaggccaaaggcggtggacgacagcgcaaggccgaggcccagtacgatggcgctgttcagtgactggccaaacagccacaacgccactgcgcccatgaccatcccggtgagcagcacctgggccaggccgacgccgaacaccgccttgcgcattacccacaggcgcttgggcgacagctccaggccgatgatgaacagcagtaacaccacgcccagttccgaaaactgcgccacgctttgtgggttgccgatcagccccagcaccgagggcccgatgatcacaccggcgaacagatagccgagcaccgcgcccaattgcaggcgcttggccagcggcacggtcaatacggcggcgaacaggaacaccacggccgcttgtaacaggttgccttcatggggcattgcgaactccattgtttacttggatcaacagctgaccgctcctacggggggacggaaacagggtgctattaaaactctttttcacattttgaaacttgtatttctgtcgcgacagtcaatggatgttgggtgtcatcccgttcttacgccgggtttacgaaagtattaataccatttaattcaatggctttcgggtagctctactaacgtttcgaaaactggatcagtagtcaccacggtcaggtttttcgaattcgatgcgtgtggagcgtcaacccagggttttcacgcattcatggacgaaacgcttggaccacaaggagtacaacgtggatagaagacttgcggctgccgttacacctcgtatctctgcgctctctcttgccgttcgcctggggatggcggggctggtcatgggcctggccagtcctgatgtgctggccgcctgtaccccagcaagcccggcgcccggcgcgacggttacctgtaccggtgtgccgtcgttgccactgttcctcaacaccttcagcagtgcagttaacaacctcacgctcaacgtcaacgccggcgcgcagctcaacgcgactctgggcggtaaagcgttgaccctgactggcaacgacacgacgttgaacaacgccggcaccattgacccggcactgctcgggttggtttcagtgctgagcggtggcgtggtgatcggcaacacggccgccagtgcgttgaacatcaccaacaccgccagcggaatcatgcgcggcaccggtgcgttgctcgggcttaacctggcttcgctcgatggcatggccctgaacgccaccaacggcgcaggcggcgttaccacgattgtcaacaacggcaccatcggctcttcgtccttgctcggcttgagcctgttcacctccgacacgccggtggtggcggtgcaaggcggcgggcaagtcaacatgaccaacaacggcaccctgaccgggcgcgtagcctttgaaagctctgctaccggcaacaccttcctcaacaccggcaccctctccggcggtgtgtcgatgggggccgccagtaccaacaccttcaccgccgtcaccggttcgagcgtgacggccggcggtggtatcggcttgagtctgggcgggttgattggcgtgaatctcacattcgcacccaccggccaggtggatggcggcgccctgggcagcaacaccttgatcctgcagaacaccctcggcgccggcggtggtattaccggcaccggcaccgcgtcgagcgccaattatgtcaacttcaacaacctgaccatcaacagcggcacctggactttgcaagggccactggtcagcggcagcaccacgctcaatggcggcctctcgcaattcaataacaacgccacgttcggcagtggtgtgctgaccgtcaacggcgggaccatcgaggccactggcaatggcctgaccctgagcaacttgctgaccctgggcactggcgggttgacagtgcagggtgcctcgaccgggctgaccttgagcggtgtgctctcgggaatcggcggcttgaccaaggccggcagcggccaactgatcctcagcggtgccaatacctacaccggcgcgacgaccctgggcggcggctcggtgcaactgggcaatgacctggcgttgagcactggcgcggtgaccgtcagcgcggccaccaccttgcaggccccgggtaccatcaacctgggcaacacgctggccttgaacggcaacctgaccactgacgtggctggcgcactgaccttgggcggtgcggtgtccggcgccagtggcatcatccacagcggcacgggcagcctgaccctcaatggcgacaacagcggctacagcggcaccaccagcctgggcgccggcaccttggtgctgggcagtaacactgcgctgggcagcggtggattgagtgtgaccggcgctgccaaccttgacgctggcggcgcgtcgttactcaccaataatgtggacctgggcgccaacctgacgctgaccggtaccaacccgctgaccctgggcggcgtgatgtccggcgccggcaccttgatcaaaaccggtgcaagcctgttgaccctgaccggtaacaacacccgtaccgggactaccgcgctgaatgccggtgggctggtggtgggttccgttactgcgcttggcacgggtgcattgaatgcggcggcggggacgacgctggatgccagcaccgcggtcactctggccaacgccgtcaatctggcgggcaacctgggcatcggcggcacggccgaccttactctgggcggtacggtcaatggcgccggcagcctgaccaaggatggcgcggccaacctgatcctcaacggcaccaatggcttcctcggcggcaccaccctgaatgccggcaccctgaccgtcggcagcaactcggccctcggccttggcaacctgatcgtcggcggtgcggcgaccctggacagcaatgcaagcgtcagcctgggcaacaacatagccctcaattcggggctgagtgtgggcggcagcaatgggctgacgttgggcggcgtcgtcagcggcaccggtgcactggtcaaggagggcggggccaacctgaccctcaatggcaataacagcttcagcggcggtaccacactgaatgccggcaccctgaccctgggcgatgccaatggcctgggcagtggtgcgttgacggtcggcggagcagccaccctggataacagcgcggccttcggcatcggcaacgccattgcgttgaacgccgacttgagcatcgccggcaacaacgacctggccctgaacggtgtgatcagcggcgcgggtgcgctgatcaaaaatggcctggctgatctggcactgtccggcagcaacaccttcaccggggccgtggatattctgtccggcagcgtcacgctgttgagcgccgatgccctggccggcagtgcgggtgccaacgtggcagccggtgccgcgctgaacctgaatgtcgattccagcctggccggcctcactggtacgggcgacgtggcggtaggtggcggttttaacctcagcgtgggtggcctgagcaccagcagtacctttgacggtggcctcagcggcacaggtggcttgatcaaggtcggcaccggcaccctggacctcaccggtatcaacggcattaccggtaacacgacgatcaacgcgggcaccctgaacctcagcggttccctgggcagcgctgtggtcgacgtcaatagcggtggcaccctcaccggcagcggttcgctgttgggggcggtgaatatcaacagtggtgggcaactggcgctgagcagtggcacgaccttgtcggccggcagcttgaatatgaatgccggcgccaatatgaatgtggccctcggcgcgccttcgctgacctcgctgctgaatgtcggcggcaatgtgaacctgggcggcaacctcaatgtcagcgatgccggtggcttcggtgccggtgtgtatcggttgatcaactacaccggtggcctgaccggcgcgttgaacgtcaacagcgtgccattgggctatggcctgggcgacttgttggtacaaaccgcggtcagcaatcaggtcaacctggtggtgtcggcgccgaacattcggttctgggacggaagcaacaacgtggccaacggcagtgttgacggtggcagcggcacctggacggcgggcggtactaactggacctcggccgacggcatcctcaaccagacctggggcggcggattcgcggtgttccaggggacggcggggactgtcagcgttgatggcgtgcaaaccctcaccggcctgcaattcgtcactgatggctacgccctggccaatggcactggcggccaattgaacaccggcagtggcaacttcgcggtgcgcgtcgacccgctggctactgcgaccctgggcgttgatatcaccggcgcgggcgccctggataaactcgataccggcaccctggtgctcaatggcaccaacggctacaccggcggcaccttgctcaatggcggcacactggtagtcggtggcaatagtgcgttgggcacaggcaccctgactgctgcggcgggcaccacactcgacagcaataccgcggcaacgcttggcaatgccatcacccttaacggcaacctgaacctggcgggtagcaacgccctgacgctcaacggcgtgattggcggcgcgggtggcttgatcaaaaatggcgcggccagcgtgaccctcggcggcagcaataccttccttggcccggtggccctgaacgcaggtgggctggtcctggcggcgaatacagcgttgggcagcggcaccctgaatgcggcaggcggtaccaccctggatgcaagcactgcactgaccgtcaacaatgcaatcaacctggccggcaacctgggcatcggcggcacggccgacctggccttggcgggcgcgatcaatggcgccggcagactgaccaaagaaggcgcggctaacctcacccttgctggcgctaatgcctttctcggtggcacctccctgaatgccggtacgctgaccctgggcaatgcgacggctttgggattgggcgacctcaccgttggcggtgcagcgaccctggataacaacaccgcgctgaccgtcggcaataatgccgtgttgaacgcggcgctgacggtggccggcagcaatgacctgaccctgggggggctgctcaccggcaccggcgcgctggtcaaggacggtgcagccaacctgacgctcaatggcatcaacacctatcaaggcggcaccagcctgaatgccggcaccttgaccctgggcacggccgcagccttgggcaccggcgccttgacggtcggcggcgcagcgacattggccaacactacaccgctggtgctggctaatgcggtcaacctcaatgccaacctgaacgtgggtggcggcaataacaacctgaccctcgcgggtgtgctggcaggcagtgggaacctggtcaaaaccggcacggctgatttgagcgttaccggcaacaacaccttcaacggcttgtttgatgtgcaatcgggcagccttactaccttgggcagcggggcattgggtgtcggcgccggcgtcaacctggcgagcggcacatccctgaacctgggcggcaccgccagcctgggcgcactcaccggcacaggtctggcgacagtaggtgcgggcaacacgttgagcgtcggggccaataacctcgacagttcgttcgatggcgtattggcaggcctcggcaactttgccaaagaaggcaccggcgccttgaccctcggcggcctcagcgcgttgaccggggatacgctggtcaacgccggcagcctgctcgtcaacggctcattggccagcgccaatgtaggcgtgggtagcggtgcgaccctgggcggtaccggcaccttgctgggtaatgtgagcatcgccgatggcggccacctggccgtcaactcgggcactactttgaccaccggttcgttgctgctcaacgccaactccaacctggacgcgggcctcggcgcgccatccactggcggtacggcactggtacaggtcaacggtaacctgaccctggatggcacgctgaatgtcagagatatcgccggcttcggcgcaggtatctaccgcttgatcgactacaccggcggcctgaccaacaacgggctgctgttgggcagcctaccggtgaatatcccggccgctgacctggacctgcaaaccgccatcggcaaccagatcaacctgctggtcaacggcagtaccaacgtgcagttctgggacggcagccaaaccagcggcaacggcgccatcgaaggcggcagcggcacttggagcgcaggcggcagcaactggaccggcgtcaatggcgcgttcgatacaggctgggcgccgaacagctttgcagtgttccaaggcactgcaggcacggttaccgttgacggtgcgcaaggcgttactggcctgcagttcgtcaccgatggctacaacctggccggcggcgcggcgggtgccttgaccctgttcaatggcgtcggtggcaacaccgccgtgcgagtcgatcctggcgtcaccgccaccctgggcgtcacgcttaacggcggcggcaccctggccaagctggataccggcaccctggtgctcaacggtgccaacagctacaccggcggcaccgcactcaatggcggcaccttgatagtgggcaatgacagtgccctgggcagcggcttgctgaccaccgccaacggcaccaccctggacagcaatgccgcggtcagcctggccaacgctgtggacgtcaacggcaccttgactgtcggtggcagcaatgccttgaccttggccggtagcgtggcgggcaccggtagcctgatcaagaacggcatcgccagcttgaccctcagcggcaacaacacctacacaggctccaccacactgaacgtgggcgggctgatcctcgcatccagcaccgcactcggcagcggcgccttgaacgcagccgccggcactaccctggacagcagcaccgcagtggccttggccaacacggtgaacctggccggtaacctgggcattctgggcagcgccgacctgagcctgaacggcttggtcagtggcgccggcagcctgaccaaaaccggtgtgggcaacctgaccctcaatggcgccaatgcctacctcggcggtacggctctcaatgccggtacgctgaccctcggcaacgccacggccctgggctctggcgccttgaccgttggcggtgcggcgagcctgaccaacagcgcgccgctggtgctggccaatgcggtcagcctcaatggcgacctcaccgtcgctggcaacaacaacctgaccctggccggtgtactcgccggcaatgcggcgctgatcaagaatggcgcggcagacttattgctgactggcaacaacagcttcggcggcccactcaccgtggcggccggcagcgtgaccacgctgggcaatggcgcactgggcaatacttccggcgtcaccgttggcacaggcgcgagcctcaacctgggcggcaatgccagcctcaacagcctggccggcaacggtgcggtgcaagtggctggcggcagtacgctggcagtgggtggcagcaacctggacaacaccttcggcggctcgctgggcggtgccggcagcctggataaaaacggcagcggcgtgctcaacctgaccggcaccaacggcatcaccggcgcggccaacgtcaacggcggcaccttgaatgtcacaggttccctggccagcggcacggtggcagtgaacaacggtgcgaccctggccggcagcggtgcccttgccggtgccgttaccgtggccgacggtggccatatcggcctgaacgccggcagcacactgtcggtgggctccctggtgctgggtggcaatgccgacctcgatgtcggccttggcgctccagtcgtgggtggcggcagcgggctgctgaatgtcggcggcgacctgaccctggacggccacctcaacgtcaccgatatcggcggctttggcagcggtgtctacaacctcatcaactatggcggggcactcaccgataacggcctgacgctcggcacgctgccgggcagcgtgatcccgggcgacctgcaagtgcagaccgccatcagcaacaaggtcaacctgctggtgactgcgcctaacaccaccgtgcagttctgggacggtaatagcctgatcggcaacggtgccatcgacgggggtaacggtgcctggaccgcaggcaccactaactggaccaatgtcgacggcacgctcaaccaaaactggaacaacagcttcgcggtgttccaaggggcggcgggcactgtgacggtggacggcacgcaaaacatcaccggcctgcagttcgtcagcgacggctacaacctggcctccggcacggcgggcgtgctcaacctggtcaatggcggcaccggcaacaccgcggtacgcgtcgacccgaacgtcaccgcgaccctgggcgtgaccctcaacggcgccggcaccctggccaagctcgacagcggctctctggtgctcaacggcgccaacggctacaccggtggtaccgcgctgaatggcggtacgctggtggtcggtaacaacaacgccctgggcaccggcgcattgtcggcggccgctggcaccacgctggacagcaacgcggcggtcaccctggccaacgcggcggtactcaacggtgccctggcggtgggcggcagcaatgcgctgaccctcaatggtggcatcagcggcagcggcagcctggttaaaaacggcgctgcgacgctgaccctcaacggcaccaacagttacagcggcggcaccggcctgaacgccggtcaattggtgctcggcaataacgccgccctgggcagtggtgcactgacggtaggcggcgccgcgcaactggatggcggcactgacctgcaactggccaatgccatcaatctgggcggcccgctgagcctggccggcagccacgacctggccctcaacggcgtggtcagcggcagcggcagcctggtgaaaaacggtagtggcgccttgttgctcaccgctgccaacacctacagcggcggcactaccctcaatggcggcagcaccaccggcagcaccaacagcctgcaaggcgccatcgtcaacaatgcagcattgaccttcgagcaagccactgacggcacctacaccggcaacctcaccggcactggcgtgttgaacaaaaccggcaccggcgcattgctgctgaccggcaacaacacgtttaccggcacgaccaacgtcaacaccggtagcctgttggtcaacggcaccttgaacagtgctgcggtgcaagttgccagcggtgcgaccctcggtggcagcggcacgctgggcggtgcggtgaacatggcggacggttcgatactcaaagccggtgcagcgacgccactgacgctgggcgcgctggccttgtcgtcgggcaccaccctggactttgccctcggcgcgccgggtgcatcgagcacggcggtgaatgtcggcggcaacctgaccctggacggtacgctcaacgtcagcgatgcgggcagctttggccttggggtataccaactgttccgctacggcggcagcctgaccgataacggcctcaccttaggtaccttgcccgtcgccttgagcaatgtgagcctgcagaccgctctggccaaccaactcaacctggtggtgcagaccgcccccgggcagatccagttctggaacggcggcaccaccaacccggatggcagcattgacggcggcagcggcacctggggcccaggcaccaactggaccgatccgaccggcacccagggccaggtcaccactaatcagttcgccgtatttggcgggcagggcggcaccgtgacagtggtcggcaaccaaggcttcaccggcctgcagttcctcgacgccggctacacattggcggcgggggaaggcggcagcttgagccccaccaatgcggcggatggcagcctggctgcggtgcgggtcaactccggcgtgaccacccagatcgatgcaccgctggtgggcacaggcgggatcaacaagctcgacgccggcaccttgctgctgaccggcgccaatacttacaccggtggtaccacggtcagcggcggtaccctggcgggtaccaccaccagcctgcgtggcaggatcctcaacaatgcgcggctgctgtttgtccagcgcaccaacggacagttcagcggcaccttgagcggtaccggtgcactggtcaaacaaggcgcaggcgcgctgttgttgaccggcaaccagcccttcagcggcaccgtggcggtggacgaaggcgtgttgcaggtgggtaacgcggccaatcctggcgcagtgcttggcggccaagtcagcgtggccagcggtgcgggcctcaccggtaatggcagtgtcggttcgctggtcaacaacggctcggtgacgcctgacggcggcaagttgagcgtggctggcaacttcaccaacgccagcaccggggcgctgaacctggtgatcaccccatccaccaccggctccctggccgtgggcggcactgccaacctgggcggcaccttgaatgtgatcaacctggcaccctatgctggcgcgaccacctacacactgctgacagcaggtgcggtcaacggcaccttcgccaccactaacctggagaacctggcgtttctcaataccgccttgaactacagcccgacccaggtggccctggcggtcagccgtaacaacgtcagctacgccagcgtggcggccaccgataaccagcgcggcgtggcggcggcgttgggcagcggggcggcagtcggtggtgcggcagtgcagaacgcactgcttaacgctgacgtggcaggcgcacgtgcagccttcgacagcttgtccggcgagatccacgccagcaccgccagtgcgatgctcgaagattcgcgttacgtacgtgacgcggtcaatgagcgcctgcgccaacccggctgctaccgcgaggacgacccacgcaatgccttggcgccaagcgaaaaccgcctgaccagcgccggttgccatggcgagatggtcggttggatgcgcgtactcggcacctggggtcacttgggcggtgacagcaacaccgccaagctggatcgcaacctcagtggcttcctgctcggcaccgacaagcaagtggatgacgcctggcgcgtaggcgtggctgccggctacacccgcagcgacctggatgccaagcgccgcaactccagcgccgacgtcgacagctaccacctgatggcgtacaccgcctaccagcaggaagccttcgccgcacgcatgggcgtggcatatagctggcatgacatcgaaagcaaacgcaacgtggccgtgggcggcgagggccaacgcctgaaagccgactacaaggcacgcagtgcgcaggtgttcggtgaagtcggctacaccatccagacagccagcgtcgccctggaaccgttcgccggcctggcgtatgtcaactacgacagcgacaccatcaaggaaaaaggcggttcggcagccctgcgcggtgatgccgaccaggacatcacctactcgaccttgggcgtacgcatcggccagaccatcaccttgggcaacggctcgaaactcaccccacggggcagcatcggctggcgccatgcgttcggcgataccaagcctgacgccgacctgagctttatcaacggcggtggctcgttcagcacccagggcgtgccgattgccaaggacagcgcggtggtggaagcgggcctggactaccagatcagccagaacggcaaacttggcctgggctattcgggtcaactctcgcgcaatgacaaggaccatgcggtaacggtcagtttctccctcggtttttgatcaaggtcgagttttttgagccgcccgaaagggcggttttttttgaagtaatactggctcctgagtgcgcagagtttattgctcaagcgtcaggctgaagaatgcacacacaatttattccggagcgcggttggctggctaaccaacgtcgacctaaagttatgcccttgagtttatattccttgggtggcatatttgcatggtctgggacattgaatacacggatgaattcggggactggtgggatggcttggatgcaaaggagcaatcttcggtggctgccagtgttgatttgctggggctgttcgggccggggctgcgctttccctatagcagcgatatcaagggcgctcgacatggcaacctgcgagagctgcgggtacagcatgcaggacgaccttacagagtgttgtacgcctttgacttccggcgttgtgcggtgctgctcataggtggcgataaaactgcacagcaccgttggtaccacgggtacgtacccttggcagagaagttgtacgacgtacatttagaaacattgcgtaaagagggccgtgaccatggctaagaaattcgcggaactgaaagctcgcatgacgcccgagtcgcgcgccgatgccgagcagatacttcagcaacatttgaaagaaatgccgctgcatgagctacgcaaggcccagcagttgagccaggcaagcctggcgaaggcattgaacatcaatcaggctgcagtttcgaagatggaacggcgtactgacatgtacatcagtacgttgcgtgactatattcgtgcgatgggcggtgagttggaaatcatcgctaccttcccagatggccaggtcaagattgacaactttgcttgctgatactgatacagctaccgtatgcccggccaagccgggctttttgctatctgctttgtagtgggacagtcaaagttccagattcctgacatgactatctatcgtcgtgcacgatcactcttgcagcgcatttaccgcgatgttccaccgtaatctggaagactccccaacgccctgcctgggcaggtccaaggcggcactcttgttctgataggaccgaacgctggtcaggattcaccttctttttcggctcggtttgttactatcgccctcccttgccaccaggagtcaccggcccatgcaacaccagtgggatgaaatgcaccgcacccgcaagccaacgtttgtcctgtgtggcgagccccagggggatgtgctcaatctctatgttcacggttactcggccttcttcaaccgccagcaactgggcaatttcaaggcacaactggcaggtatcgaaggctcgaccaacctgatgttgttctggccggcggggcatttcctggaaaacctgtttgcaccgttcaaggatgtgatcacctcgatgcttggcggcggtggcctgggcgcggcgacggtaggcgtaggcaaggcgattgcctattttcttgaccattacaaaagtgtcgaagcgcgggtcgacgaggtggccaagaccttgttgcccgagctggccggctacctgcacgccgagtcgctgccggtgcggcgcatcaacctgatcggccattccctgggcgcgcgcatcctggtcaagagcctgctggccagccccgaagtcgcccgtgaactgccgttgaataacctattgctgatgggcggggcgatctgtacgtcgagcccttgggatgacgtgtcggcgccgctcaagggccggctgatcaattgtcattcgagcaaggactgggccttggcgatgaagccggataccgagcgctgtatcggccgttatgccattgacgtaacgcccgcattgaagactaaggtcactaatgtgcacctggccagcttcgatcacgccgcctactggccgcaattgaagacggtggtgcaatacaccgacctgctgcaggagcggcgcggtttgatccgcgccgacctgcgcagcagtgaagtgcgttttgccgaggaggatggggacctgtacccggcactggtgcaggcgcggccggaagagttgaagtttcttgccgagctgatggcgcaaaaacgcagtgcctccattgatgccagcgtgcgcgaaccgctgaagctggccatcgagttgcagcgcatgggtggcgacagctttatgaacctggcccgtggccatggcgtgggctatcggcagattgccgaagatgtggcgcaacgcttgggcatcaagttcgacgctgcgcttgaaagcgtggcgctggcggatatcgaagggcaggtcgcagaaaagctcatcgagcagtacaaggacaaactcagccgcgccgaccgccaggcgttcgacgccgaactcaaggctgcggcgcaaaaagagcaggggctgttcacccgcttcgatgtgggccgctcggccaccaccgccttgagcggcaccgcgctggcagggctgaccgggtttatcctgcgccggggtgcggccaccgcgattccgctggtgggccaggcgctggccgcggcgatgctgctggtcagcggtgtccgggcgttttccggcccggcgtattcgatcaccaccttggcggtgttggtgattggcgtgattcgccagcgcatggagcgcgaagcgctgaaccaggagctggacctggtggtgcaagtggtggaggcgttcgacttgccgcgggatacagtgatgcgcacggtcgcgtccgactgataagctgctgccaatgtcttgtgtatttgcctggaataccgtgtgaaattcagcctgcctaaaatcgctaccgccccgttctgcccgccggaagtggccggctccgtcatcgtcgacccgaaggcatcgtttttcaaacggatgctgatgttcgccggccccggcctgttgatctccatcggctacatggaccccggcaactgggcgaccgccatcgaagccgggtcacgctacggctacagcctgttgtttgtggtgctgctggccagcctggcgggcatggcggtgcaatgcctgtgctcgcgcctgggtatcgccactggcaaagacttggcgcagctgtgccgtgagcgctacagcaagcgctcttcgcgcacccagtggctgttggcggaaatctccatcatcgccactgaccttgccgaagtgctcggctgcgccctggcgtttcacctgttgcttggcgtgtcgctgaccaccggcatcgtcatcaccgcctttgatacgctgttgatcctggccctgcaaaaccgcggttttcgccgcctggaagcgatcatgctggcgctggtggcgaccattggcgtgtgtttctttatcgagctggtgctgatcaaaccctattggcccgatgtgctcagcggtttcaccccgtcattgtcggccatcagcgacgctgcgccgctgtacctggccatcggtatcctcggtgccacggtcatgccccataacctctacctgcacacctccatcgtgcaaacccgcctggtcggcaaggacctggcgagcaagcaggacgcggtcaagctggcgcgtatcgacaccatcggctccctggccctggccttgctggtcaacgcggcgatcctggtgctggctgcggcggcgttctacaagaccggtcataccgatgtggtggaaatccaggacgcctaccacctgctcgacccgctcgtaggcggcgcctttgccagcatcctgttcggtatcgccttgctggcctcggggcagagctcgacctttaccgggacgattgccgggcaagtgatcatggagggctacctgaacctgcgcataccctgctggcaacgacgcctgattactcgcgggctggcgctgatcccggcgttcctcggcgtgtggttgatgggtgacgatgcgatcggcaagctgctgatcctcagccaggtggtactgagcctgcagttgccctttgcgctgtacccgctgatccgcatgaccggcgacaaacaattgatggggccgttcgttaacaggctgcccacgcggctgttggcgtggtttctgttcgcggtgatcagcggcgcgaatgcgtggttgattgggcagtggttgttttgattggacatagcgctactggggcatgacctgaaccaacatcgctaaggatgtgtattgggcaacctgcggatcggctgttagtagcttcattggttcactcatcgcggttgcaataatcagccgatcgaaagggtccttgtgatgatgttcgagatccttgaccgcaatggcgtgctccgaggtgatggggagttcgacgaaaccgctttccaggcaatactcacggatttcatccaggtctacggcaagctttccaacgccaaccttgattgccatttcccagaatgttgccgcactgacgtagacgtctgcggcattttcaatcagcttacgggttttgccagatagtctggggtcatcgttgagtgcccacagcaggatatgggtatccagcagcagtctcatgaaggactgccctcaaacgcatctgacaaatcgctgggcagcggtgcgtcgaagtcatcagggatgaccagcttacccttcattgcaccaattcgccggcccttgggtttaccgatggggacaagctgggccattgcacggccatgcttggcaatggtgatgactttgccggcggcggcttcatcgaccagcttggacagattgttttttgcctcacccaacgcaacggtaatcatgtggtcttccccgtgttttggccaaatatagccaaaactacgggcgctatcaaagacggctcgaccactggtcaaggccgctcgttcggcacgtgatggcttgtaatacacgacatccatggcatctctccaaaaaagaattcgccaaagtctgccccaacgcaccgtgcccaaaaatactggcccgcaaaatcagaacggacctacttttcctacgaggaaatttccctcaccagtggcgtctctggagcgcaataggcctcatcgatcccaatacggcaccgtcccaaaacactccacgaaataatcaatcaccgtacgcaccttcaacgacagcctccggctgcctggccacaacgcagcaatctgctgaggctccagggtcgttgcgacttcatagtcggtcagtacggcctgcaaggtgccggcgcgcaggctttcgccaatcaaccaggaaggaaacaccaccagccccaggccctgttcggcggcgtgggtcagggtgtcggcgtggttgccggtaatcgggcccttgacgctgtagggtgtccagtcgccctggccgtggcggaagaaccagcgctgctggccggtgatgcctttataggccaggcattggtggtgggccagttcgtcggggtggcgcggcgtgccgtgttgcgccaggtaggcggggctggcggcgatgcgaaagcgctggggcgcgaagatgcgtgcctgcatgccggagtcattgagcacgccaatgcggaacaacaggtcggtgccatcttgcagcgggtcgacgaaggtgtcggtttgctggatatccagttgcagctttgggtagcgtcggcacaacgcgcccagccagggagacaggtggcgctggccgaataccatcggcgcgttgatccgcaccagcccgctgggctcgttgtcctgttcttgcagggcctggttcgccatttccaactgttccaataccaggcgcgcgtgccgcccgagcaggcgtccggcttcggtggggctcacggcgcgggtatggcgatacagtaattgctggccgagggcctgttccattagttggatctgccgtgaaatggaggagggcgccaggccctcgcggcgggccacttcggaaaaactgccatggtccagcacggccacgaacaggcgcagcgccttgaagctcagttcattcaagccctgcatcatgcctccaggctgtgcgtattgcgcaaaggtgttgtccgtatactcccatttatcgcacagggcggccaccggataatgcgcgccatgtttcttttcttgatacgcaggtgatgtatgcaggcacgcactatcgagggcatgacgcaggccaggccgaataaaaacctcctacggctgctgttgttgccgttggtgatcctggcgggcatggggctgtcagtggaggccggattgcttgggccgttgggcgcgcaggtcgggcatttgtgggcgaccttgagcatcttcggcgtcggcacggcgatcctgcttctactgctgctgttcagcggcccgcagcagggcccggcatttacccagctgccgcgctggcaattgatcggcgggtttttggggccgatgtatgtggtagtgctcacactcgccacgccgcacatcggtatcgccatgaccatgattgcgatcctgtcgggccaggtgggcaagagtgtgttgatcgaccacttcggctggttcggcacggcacgcaagcgcgtcaatggcgaacgctggattgcgctggcgttgattgtggcggcattggtcctgattgcacgagggtaagacgatgaatctgattctgttattggtggtggtgattgcggcaggggcggtgttgagtgtgcaggctgcgatcaatgggcgcctgggccagacggttggggtgttgcgcagcagcctgctgacctttgccgttggcgcgctcatcacggcattgttgatatttttcttcgagccggcccaggccgtcagcctgctggacgtgccgaaatggcaattgaccggcgctttgttcggcgtggtgtacatgctggtgatggtcggcgcggtgccggtggttggcacggctgtcgccacggtggcggtgattgtcgggcagttggggatgggcatgttgatcgacaacttcggctggctgggcaacccagccattgaattatcagggagccgcatcgtggcgatgctctgcttggccctggcactggtgttcatgtatcgcagtaatacccgcgcggccgactgatggcgctgaaccttggcgtcgtgtacgcagtcactgcttaaggtgcggtgttcgccgcatcgcgacgaccatgaaaaaggagtctgaccatgccagatcaaacctgtgcttgcccacactgcaaatgcgtactgggcagcgatgcgatcatgaaggacggtaaaggttattgctgccagggctgtgccgagcaccatgcccacggtgagccttgcgccgccgcgacgggctgcgagtgcgccaagtcggctcacacctgaggtgttcgacctgcaggcccgggcaacccggtgcctgcagggtgagttaaaacagttcgcttgtcggcggtgagtctttaccatgctcacctgtcttcgattaatgtgtacccgccatggccctggctgcgcctcccgaccttagtaatcacgccatccctgtgcagccgttggcgcgcacctatccgcgtgggttgtacgtggagccccatagccacgaatggggccaactgctctatgccatgagcggtgtgatgtgggtcgagacgccccgcgaagccctggtggtgccgccccagcgcgccgtgtggttgccgccgggggtggagcacgggatccgtgtggtctccgatttgcaaatgcgcaatatctacctgcgtccggcattggcggcgacgctggacagccaggtgcaggtcatcgaagtaggccggttgttgcgtgaattgatcgtgacgttggtcgaacaaggcgatcacggcgatgccggctactacgaggcggtcgtcggcctggctctgctggagctgcaacgcgcacgtcgctcgccaatccgcatcgccatgccggtggcggctgatcggcggctgatcaaggcatgccagacggtcatggctgcgccctccctggaaatccccatcgagcagcacgccgaggctgcgggcgccagcgtgcgcaccctggcgcgactgttccagaaccacctgggcatgggctttgccgagtggcggcgccaggtgcagttggcgatggcagccgcggagctggtccagggccagtcggtgagcggcattgcccgcggcctgggttattcgccgagcagtttcagcgacatgttccgcagggaactgggggtatcgccttcgcagtacgcgggttggccgaaatcctgaagcacttggccgatgccgacctcaggcgcgctttaagctgagcccatcaatcaactgggtctagcctccatgaactatctgatttccctggccatcggcctgtttgtcggcgtgatctacggcgcgctggactttcgctcgcccgcgccgccagccattgccctggtgggcctgacgggcatattgctcggcgaaaagatctggcccatggggcggcagctgctcagcggttggtcgtcctgattcctcttcccttcgacggatgcccccgatgaaagcactgcaatttagcgccactggcgacctcgcccacctgcatttggtcgatgtcgccatgcccgtgccggctgccgatgaagtactggttcaggttaaagccgcgggcctgaaccccagcgacgtaaaaaatgtactcggccgttttccctacaccacgttgccacgcattcccgggcgtgactttgccggcgtggtggtggaaggcccgcaagcgctgctcggccaggaggtctggggcaccggtcgtgacctgggtttttttgctgacggctcccatgctcaataccttcgggtgtcagccacaggtgtggcgcataagcccagtcacctgagctttgcccaagccgccagcctgggtgtgccgtataccaccgcctgggatgccctggagcgtagcggtgtcggtaagggcacgcgcttgctggtgattggcgccaatggtgccgtcggcagtgcggcgttggcgctggccaggattcgcggcgcccaggtattggcggcggtgcgcaaggctgatcaggtcgaggcattgcgggcgcaaggggttgacacgattggcctgggcaagccggaagcactcggtgcccaggtgcatgcggtgttcgagggcggcgccgaggtgatcttcgacaccaccggtttctggcttccccccgcggtggcggggttggcgcctttcgggcgtatcgcgattattgccgcaccggtcgacggtcatgtgcaactgccggccctggcgctgtaccgcaagggtggggcggtggtgggggtcaattcgttgctctatagctgtgagcaatgtgcggtgatgctggaggcgttcgggcggttcttcgatgaaggcttgttgccggcgccgaccggcttgcgtgaggtggcgttggctgatggcgttgaatgctatgggcaagtgaacagcggtagcccggataaaatcatctttctgccgtaaaccgtatcaaatgtgggagggggcaagtcgaatcgtcgcaccgcccctcccacattcagatctttacttggtctcaggtacgcctttttcccacgtcgaccaatccttaacaatcgcctggaccaacggattgcctgtgcgatacaggttttccagcgccggtacaaagccgccctggtccgcatacttgagcaggttgtctacctcgctgtaacccgggtaaggccggtcaaagtcggagcccgcgcgtaccacggccaggcgctggatatccaccaagccttcacggctggcacgcagcagcgcttcataggtggagttgtcttcctgctgggtggtgcagtactcgcctttattgtcggtgagcaacttggtccagacttctgctcgctcgctcaagcgtgtgccggaaaaccaggtgttgcccgccagggtgtcgcagcgcgtgacttgcggcggctggttggccggggcggcagggtagtgtttgcgccaggcggccgactccttgctttccgtcagctccacccggtgcgacaaggcaaaggccttggcttgcagcttggggttgagctcgaacacttcggtcttgtagtccagtggtggtttttcgttgggccccttggtgttgatgccgatataaccggtcggccaatccttgggcgcatcccgggaatcaagctcccactgggtgccaaactccaccaggtaatgagcccaggctgcggtgccgatggtgccgtgcttggggctgatgccggcgatcccggcgatcaggaagtaactctggcgcaggtcgaacttgggtgacagggccagggccagggtcgacgcggcagcattggtctggcccatgccggtcaccagcaggcacacgtcctgggtattgcagcgaatcaccggatagtcggcagacaagcccggcacgcgcacttcttgcttgagctccaggcggtcgatccaggtttgcgcctcgggggcgaacatcgcgatcaacatcaccttgggcttgatcggcgccgggttgtccgccagcaccacgtggggcagcagggccaggccgacggccagcgagacacgggtaagtgctttcatctatagctccttgatcagaattggtagcccacgccggcgtagtaaccccagccgtcggagcgagcgcggaagttgccttcgccgaaattcagctcgctgccgtcctcccagttaccgccgttatgaaagtaacgccccaccaaggtaaaacgcaggtgagtgaatgagtacagcagcacgttggtggccaccagggaattggcggtgcgcgccgggttgtccttgtgcaggtcggaaccgaaatcgtagttggtgaagccgatataagtgagcgaagcaccattgtcgaacttgccgatgggcacgatgtacttcatttgcgcacggtagccgtcccaggaatattcattgctggcgccgtagttttcccactggtagcgcccgtagaagttggccgacaggttgacccgcgagtgggtctcgatatcggtgcccaggccgctgtacagggtgttggcgcggttttccttattgctgccatggtcgtagatccagtcaaaggccacataccactccttgaacgggccaatcgccaggctgcggcctgcgaggtagtcgatggagatccgcggctcatgctccatgaacaccggcgagccatggtcccacacgcctttgtcattgctgttaccgatggtaaggatcttcggtacgtcgatatagccgtacaactcaaagggccctttgcgcccgaagtattcgtattccaggtagacgtcgtcctggggcttggggccgaagctgatgtctttgctgccgatcagggtcaggtcctgattgaaccattccgagagataagcgccttttttcgccggcgggttggcctcagggctgagggcttcgccctgtgctgagtcatcgacgggcttttcctgcgccaaaatgggtgcactgagtactcccgtaacggcggccagtagcaaggaaacaccaaagcaagcgcggggccttgaggtggggtgcattgaaaatccttattcgtacgcggttggagcccgatttggcgggtaggtgtgaacttggtgcgcaagttcgttccgcaaacgtttgcacaggctgtaccaactttcttcaatggcttgaactgtttagaaaaatcgcgaattagccgacgatatggtcagaaaaccaacaggctcagaccttggtgatggggttgaatagatgcagtgcggtctgccgccgatattcgctcggcgtctgatgcatttcgatgcgaaagtggcggttgaaattggacaggttggcgtagcccacttcaaagcagatatccgccaccgacatctggctttgcagcaacaaccggcaggcacgctgtatacggaacttgcgcatcaggtcgataaagccgtggccggtattgcgcttgaaaaagcgcgagaagcccggttcgctcatctccaattgccgggcaatgtccgacaggcgcacatcccccgtcagttcgcgcatcagataatcgaaggcttggttgatgcgttcggcactgcgcgcatccagggtcggcgcatagcatgggctggccagggccttggcctgtgagggcggggcatgtttgagactatcgagcagttgcaggaacaggatcaggcgttgcaggccatgggcaccgccgatggcttccatcagcctggcagcgttaaccgccgcctcaccggtgaattcgacgccacgtcgggcctgttcaaacagcggctgtaaatcgccaagttccggcagggccttgcgcagggcgaggagggcggcgccgtcgaattgcagcaccacatcgcggccactcaggtattcgccgggggccaggtcgccgatccaatcgtggggcaggtccgggccgatcagcgcgacatgcccggcgctgaatgcgccgatatagtcgcccgccaccaacttgccgctgccttggcggatcaggtggatttcaaattcggggtgatggttccagcgcgccagctcatagggatagtcatgttcgaaccagcgaaagcaatgctgcggttcgggcaggatcacttccagttcggcagggcggtgctcaaacagtttggcgcgactgacgggcatgctgatgcctcttgtaggtatgcaatggccttaaaaatacgcgcactggcaatcagcgcgctactcccggtttaacctggcactgatacttttttgatcctgggcccgaggttaaaaagtatcaggcgctgattcgccaggcgtttgtgagggccaggccaagctgctgtaatcggggctcgacaacaaaaacaacaggtggaaaccgccatgctcaagctaccgcaagcactgttcctgctgaccggcctggccctggccatacccagccatgccgctgaaaccgtcaccatcgccacggtcaacaacagcgacatgatccgtatgcaacgtctatccaaggtgttcgaaacgcagcacccggatatccagctcaagtgggtggtgctggaagaaaatgtgctgcgccagcgcctcaccaccgatatcgccacccagggcgggcagttcgacgtgctcaccatcggcacctacgaaaccccgttgtggggcgccaagcactggctggagccgctgacccaactaccggccgactatgacatcgaggatatcttcccctcggttcgccagggcctgtcggtcaacaataccctgtgtgccttgccgttctatggcgaaagcaccgtcacctactaccgcaccgacctgttcaagcaagccggcctgagcatgccatcacacccgacctggacagaactgggtgaattcgctgccaaactcaccgccaaagacaaagaccagtacggcctgtgcctgcgtggcaaggccggttggggcgaaaacatcgcgttgctcagcaccatggccaatgcgttcggcgcacgctggttcgatgagcagtggaaacccgagctgaccagccctgaatgggctgcggccgccaacttctacgtcaacaccctcaagcaatacggcccgccaggcgcgtccagcaatggtttcaatgaaaccctggcgctgttcaacagcggcaagtgtgcgatctgggtggacgccagcgtcgccggctccttcaccaccgacaccagccagagcaaagtcgccgaccgcgtaggtttcgccgccgcccccaccgaagtcaccgacaagggctcgtcctggctctatgcctggtccctggcgattccggccacctccaagcacaaggatgccgccagggcgtttatcagttgggcgacatccaaggcctacatccagctggtcgccgaaaaagaaggtgtcaccaacgtaccgccgggcacccgccagtccacctacagcgcggcgtacctgcaggccgcaccgtttgcccaggtaaccctggagatgatgaagcacgccgaccccgcacatccttcggccaaacccgtgccgtacgtaggcatccagtacgtgaccatccccgagttccaggccatcggcacctctgtcggcaagctgttctcggcggcgctcaccggcggtatgtcggttgagcaggcattgcagcaggcgcaggccagcaccgaacgcgagatgaaacgcgccggctacccgaaatcactttgacaggacaccccgatgaaacgactcgaaggtaaaagcgcgctgatcaccggatcggcgcggggcattggccgcgcgtttgcccaggcctatatcgccgaaggcgccactgttgccattgccgacatcaacctgcaacgagcccaggccactgccgccgaactggggccccaggcctacgcggtggtgatggacgtcaccgaccaggcttccatcgacatcgcaatcgccacggtggtggcccatgccggcaagctggatatcctgatcaacaatgcggcactgttcgacctggcgcccattgtcgacatcacccgtgacagctttgagcggctgttctcgatcaacgttgccggcaccctgttcaccttgcaggccgccgcccggcagatgatccgccaggggcatggcggcaagatcatcaacatggccagccaggcggggcggcgtggcgagccgttggtggcggtctattgtgcgaccaaggcagcggtgatcagcctgacgcaatcggcggggctgaacctgatcaagcagggtatcaacgtcaatgccatcgccccgggtgtggtggacggcgagcactgggatggggtagatgcactgttcgccaggcatgaaggtttggcgccgggcgagaagaaaaagcgggtaggggacgaggtgccgtttgggcggatgggtacggccgaagacctgaccggcatggcgatcttcctggcttcgaaggaggccgactatgtggtggcccagacctacaacgtcgatggcggtaactggatgaactaaagccccgcggatttacccatcgccgttcttgcaagaacgtcagtcagcaaagcttcgatcaaagaagtaaaccgccccaggcttcaagttttctaccgtcgcctgggggcggccaccttcgccgttcttcttgcgccccgtctcacgcagataccccgcctccatgagtttcaacaaacgctggcgaatactggtcttcaataccggccgcgccagcaccagggagaagatcgtagtcgcttccggcgcgctgaattcatggcccaggaacatcagcggcaagctgctgtacagcgacttggacaacagccgctcgtgcacggccgccacaatgctgttgtgatcgaatggcagcttgatactgccatcggccaccgcctccagtgaaaaccagccctgctgctcaccaagcttcactgcatccgccacgattgccaggtagtaagtcgacgacgaccagcagcgcgggtcgcgaaacgcatcgcccaccgtgcccacctgttcgctccaggccaggtccaggccgaccttgtcactggcgcgcaggcgttccactgcatccttgaggctcaggtcttgcacgtcgccgtttaccaccacacccggcagtgcccaatgcccggcgaacggctcggcttcgcgtttattcagcagcagcttcaattcgccagcggcgcggcagtagcacagtacgcagagatcgacggtgtgcaggtaggcgctaagtggcatgacaggtcctcatcaacggtggccggcatagtctaacggatcgaacagatatgtcatgaactgacggccgcctaaataaacaaatgtttcttgctatgaaagtacatgacgtgtacttttgtttccaggccaccggagaatcaccatgacccttgctaaaaccgccatcgcttcattcgacgtcgacgcccagaaaagcttcacgccgctgtgccccaatgaattgccggtggccggtggcgaccgcatcggtgccgagctcaactacatggccagcctcgccggccatcgcatcggcagcaaggacgcccacacgccccacgcgccctgggtcgtcgcgcagcacagcgagatgctgcaacccaccggcctggcccacgccgatgtcacctgggtcagccactgtgtgccgggcaccgagggcttcaccttgctcgacgagttgcccagcccctataactacgactacttcatctggaaaggcgtcgaacccgacctgcacccctacggcgcctgctaccacgacctgcacgacaagctgtccaccggggtgatcgagtacctcaaggcccagggcgtcgcccgcgtgatcgtcggcgggctggccctggactactgcgtcaagaccaccgcactgcaactgctcaaggctggcctgcaagtcgtcctgcacctgccggcctgccgcagcatcagtgaggagggtggtgtacaggctgtgaacgagttgctcaaggccggtgctgtcatcagcagtacccgcgaagaactggccgcgatggccgcgcgttaaggagacccaccatggaaagtgcctacgacaagcaatccccagtgatccagggcctgctcgataccgactactacaccttcaccatgatgcaggcggtgttgcaccagcaccccaatgtcgatgtggaatacaacttcatcgtgcgctccagggaaaaactcggacacctgatcccgcagctgcgcgacgagctggaaaaactcgccggcctgcacatgcgcgaaggtgagctgcgctttttgttcaacccgcgttttcgcgaatacctcaccccggactacgagcgcttcctcggcctgttccgcttcaacctgcgctatatccacgtcagtgaggtcgacggccagctcaacattcgcgtaatcggcccgatgctgcactgcatcatgttcgaacaaccggtcctggccctggtcagcgaattgcgcaaccgtgacaaataccccgacgtcaccctggaggacgtcacccgcaagctctaccagaaattcgactggctggaaaaaaacctcagccgcgatgaattggccgacctgcgcgtgtctgacttctctacccgccggcgcctgtcgttcaaggcccagcgcgaagtggtggacatcatgcgtcgcgactttcccggccagtttgtcggcaccagtaacgcgcacctggcctacgagttcgacctgccgctgatcgggaccatggcccaccaatggctgatggtgcaccagcagttggggcgcctgcgtgaaagtcagaatgccgcgctggaaaattgggtgcgcgagtaccgtggccgcctgggtattgccctgaccgactgcatcagcacggattttttcctcaaggacttcgacctgtacttcgccaagctctacgacggcctgcgccaggattccggtgaccccatcgcctgggccgacaaggtgctggccagatacaaggaactcggcatcgaccccatgaccaaagaccttatgttctccgatggcttgaacttcgaaaaatgcctgccgatcctgcgccacatccgtggcaaggccaggttcggctttggcatgggcaccagcctggcgtgtgatgtgcaaggtgtggagccgctgagcatcgtgatgaaactggtgcgggtacacggcgaaccggtggtgaagttctccgatgacccgatcaagaacgtttgcgaagacgcctcgtttttgcagtacgcggcgcaggtattcaatgtcggcaatgtggaggtgtgacatgcaggaccgtatcgcacaggaactgaatatcaatcggcagctggtgaaggggggcgaagccaaggaaatccaacgtcgcatcgacttcatcaagcgcaccttgcgcagttcgggctgcaaagccctggtgctgggcatcagtggcggcgtcgactcgctggtcgccggccgtctgtgccagctggcggtcgagcaactgcgctcgcaggattacgccgcgcggtttatcgccatgcgcctgccctacaagagccaggctgacgagcacgatgctaccgcgtccctggactttatacgcccggaccagatcgataccctaaacatcgctgccagtgtcgatggcatgatgagcagcctgcctgccggcgaagtcgatgccgaacgcgtggacttcatcaaaggcaacgtcaaggcgcgcacgcggatgattgcgcaatatgccgtcgccaacctgcaaaacggcctggtggtcggtaccgaccaaggcgctgaagcgctgatgggcttcttcaccaaattcggcgatggcgcctgcgacctggcaccgctgtccggcctgaccaaaacccaggtacgcctgctcggcaccgcactgggcgcccccgacaacctggtcaaaaaagccccgaccgccgacctcgaagaattggcgccgggcaagctggacgaagtcgcctacggctgtacctatgacgacatcgacgcgtatctgatgggtgagcctgtgagtgagcacgtaagaacgattgtagagagcgcctacagcaagaccgcgcacaagcgtgcgctgcccatcgtgcccctttaggcaaagatgtctacgcagcctggatctgcaggagggggcttgccctgaagccggtcaggcaagaggtagcgcttgcaaaagattcttgcaagtcggccaattcagcctaatataacccgggtaaaacaaataatatccgggtaataagccatgcctacgcacaacatttttctatgcaccgctttcgcaggccatcaacgcatcgccgccggcacttataccgatgtggccgaggcccttgccgctcaagcgttgcccgccggtagcttcctggtcttcgatgacgccgccggcacacaggtcgattacccgtggccagcgggttacgcgccgcagcctgcggccccggtcgagagcgacgacgagccacctgccacgccctcggtgggccgcccgaaattgggcgtggttgcccgcgaagtcaccttgctgccacgccattgggagtggcttggccagcagcgcggcggtgcgtcggcggccttgcgccggttggtggatgaagcgcgcacggcccatgccagcgttgatcaactgcgccaggccaaggaagccagctatcgcttcatgagcgcgattggcggtaatttgccgggttttgaagacgcctcgcgcgcgctgtttgcccaggacagggccgccttctcgcatagcatcgcgcactggcctgcggacgtgcagacgtacctgggctggctgtcgcgcaatgccttcccagcctaatcactccgggactctaaccatcatggaagttactcagcaacggccgttgtggcagatctacctgatctttctggcacccatggtgctgtccaattttctgcagagcttttccggcaccctcaacggcatctatgttgggcaaatgctcggcacccaggcgctggcggcggtgtcgggcatgttccccatcgtgtttttctttatcgccctggtgatcggcctgggggcgggcgcttcggtgttgatcggccaagcgtggggcgcccaggagacagggatggtcaaagtgattaccggcgccaccctcacgttgggcgcgctggtgggtctgatcgccgcggtacttggcagcctgtttgcgcgtccggccttgcaggcattgggtacgccgctggatgtgctcgacgatgcggtgggttacgcccagatgatgatgttgatcatgccgttgttgctggtgttcatcctctacacccaattgctgcgcggagtcagcgacacgatttcgccgctgctggcgttgatggtctcgaccctggtgggcttactgctgaccccggcgctgatccgtggctggatcggcctgccgcccatgggcatccagagtgcggtgtacgcgggtttggtgggtaatgccttggcgatgctgttcctggtcctgcgcctgcggcataaaaaccatgtgatggcgccggatcgtgaattgctcgcggccttgcgcctggaccgggtgatcctcggcaaggtcctgcgcatcggcttgccgacgggcttgcagatggtggtgttgtcgttgtctgaattggtcatcctcgccctggtcaacggccacggttcacaggccacggcggcctatggcgcggtgacgcagatcgtcaactacgtgcaattcccggcgctgtcgatcgccatcactgcatcgatcctcggtgcccaggcgattggcgccgggcgcctggagcgcatcgggccgatcctgcgcaccgggctggtgatcaacctgtgccttaccggtgccctgatcgtgctcggctacggtttgtcgcactggctgctggggctgttcatcaccgacgacagcgcacgggtcagggccgaacacctgctgcacatcatgctctggagcatcctggtgttcgggttccaggcggtgattggcggcatcatgcgcgccagtggtgtggtgctgatgccggtggcgatctcgattttttgcgtgctctgcgtggaactgccgatggcttacctgttcaacgcccacttcgggttggaaggggtgtggatggccttcccggtgacctacctggcgatgctggtgttgcagaccgcgtactaccggctggtgtggcggcataagcagatcaagcgcttggtttgaggctcagcccgcgcaaaagtagctccaggctttgcaacgcttcttccaggcgtgtgcccgggtggtcatcccgggcaatccacaacgcggtattgaccaggctgccgttgatcatctgcgccagtgcttggctgggggcctgaggaatcaacccggcctgcatcaaggcctccagcaattggcgcaatgattcgacgcaatgttgttgggggccggtatcacccagcaccgccggcgcatcctgcaacacgatgcgttggatttcagggtcctgggccatgcgcagataagcccggcagcgttcgcaaaaaccgctccagggttctgcggcctgctccgagatgcgctgcaagcgctcgtccatctcgctgtcgagctgggcgaccacggccgccagcaagccttttttatcaccaaagtgatggtacaacgcaccgcgtgtgagcccggcctgggcggtaaagtcatccatggaggtattggcatagccttgggtggcgaaggcccggcgcgcgctgtctatcagacgggcgcgggtggcttcgatcatttcggcgcgggctcggctcatgggaatctcttggctgagtgattgacatacgctgcgtatgcgaagcatgattcgttacatacgcaccgtatgtattttgccctgatagcttcagatagcaagcccggggctccaagcaagaggtcaagcaggatggcaaacccctacgccgaattattccaggtccccggtgcccgggcctttgtgctcgccggcatgctggcgcgcatgccgatatcgatgaccggcatcggcttgatcaccatgctgtcccaggtgcatggcggctatggcctggccggttcggtggcggcagtgtttgccctggctacggcgttttgtgcgccgcaagtttcacgttgggtggaccgctacggccagggcaaggtattgccgattgccgctttgatcggcggcggggcgttgttgatggtgctgctgtgtacgcgcttacaggcgccgaattggacgctgttcctgtttgccgcgctggccggttgcatgccgaacatgtccgccatggtgcgggcgcgctggaccgagctgtaccgcggccagcccaggctgcagaccgcatttgccctggagtcggtgctcgatgaggtgtgcttcatcattggcccgcccatttccgtgggcctgagcgtggtgctgtttcctgaagccggccccttggtggcggcagtattgctggccataggtgtgaccacctttgtattgcagcggcaaaccgagcctccggtccacgcacaccacgatgcgcacgggcgctggctgatagcttcgccctcggtgctgatcctgatgatcctgctgctggccatgggtgtgatcgtcggcgtggtggatgtggtcagcgtggcgttcgcccagcatcagggtcagccggcggcggcgagtatcgtgctgtcggtgtatgccatcggttcatgcctggccgggctggcctttggtgccctcaagctcaaggcaccgttgccccggcagttcctgtactgcggcgtggccacggcgctgaccaccttgcccttgttactggtgagcaatattccgggcctggccgcggcgatttttatctccggcctgttcttcgcgcccaccttgatcgtgtccatggccatggtcgagcagatcgtcgcgcccagccgcctcaccgaaggcatgacctggctgatcactggcctgagcatcggcgtggccatcggtgccgccagctccggttggatgatcgatcattttggggccgccagcggattctgggtggcgttggcggcgggggcagtggtgttgggctcggcggtgttgggttaccgacggttgggttagtcagcctatcgccgggcatggctctggatagtgatgttgtagaaactcgctcaacgcttggcgcgtcagatcattcaacgtcactttcttacgggttgctgccagggctgctgccaagtgcaggtcatgcccgacgcgcacgttgaatgaacctttgcaaggcttctccggcgtttgcccaagggcctggcaggtcgcgaggtaatcgtccaccgcttcacggaaggcggcttccagttctgcgacggttttaccttcgtagctcactaatgccttgatgaacaggaccttgccaaacaggcagttgtcttcaaggctggcttcgatagagccgatatagccattgtgtttcagttggttgttcactgaatcagttctcctgatttcaattgttcgatgatctggcgacgaatgtagtgcttcagttcgttgccggggtgaggcctgtgcaacgtgatcattgcactggggtcgccgatgtcgaatttgacccggcttccggccccttcaatctgtgtgtatccgagccgtcgtaacagtgtgacgagctcgggccaggtaaatgccatgtgctcattgagcagtttggcgagcagcttttcatttttggacacggcgttccctgcgtgcaactaaatgtagttgcaaaaagtggtgttcgtcaatgctagcttggcttcgcgtgccttgcctggaattgatgtaacccttgttgacagctcgcccgacgccacccatccccgcgctaatttttccccttccggttcgttttatagggacgacgtgcctttgtgcttcccgcctattgccccggattcgaagaaatgaatgctgaagactccttgaaacttgctcgccggtttatcgggttgcctctggaaaaacgccagctgttcctgcaagccttgcaaaaagaaggcgtggagttttcccggtttccgattccggcaggggtagaggcgcaggaccgccaagcgctgtcctacgcacagcagcgcatgtggtttctctggcaattggacccggccagcggcgcctacaatctgcccggcgcggtgcgcttgatcggcgcgctgaacctgccagcgatggagcaagcattcgccagcctggtggcgcgtcacgaaaccttgcgcaccgtgttccaacgccaggctgatgagcatctggtgcaggtggcgatagaaccgtcgcttgcggtcgagcaactggacgtcagcgccttgcccgccgccgagcgcgagcaggccgtcaacgatgccgctacccgccaatccttgttgccattcgatttggaacacggcccgctgctgcgcgtgcaattactcaaactcgacgatcaggaacacgtgctgctgctgacgctgcaccatatcgtctccgacggttggtcgatgaatgtgctgatcgacgagttcatccgttgctatgacgcccatgagcgcaacgaaacgccgcagctgcccgagctgccgatccagtacagcgactacgccctttggcagcgacgctggctggaagcgggggagcaggcgcgtcagttggaatactggcaggcacgcctgggcgacgagcatccggtattggagctgcccaccgatcatccgcgcccggcgatgcccagctatcaaggcacgcggtataacttcgcgattgatccggcgctggctgcgcaactgcgcagttgcgcgcaaaaacacaacgtcaccctgttcatgctgttgctcggtgtcttcaatgtgctgctgcatcgctacagcggccagggtgatatccgcgtcggcgtgccgattgccaatcgcaaccgcaccgaagtcgaagggctgatcggtttcttcgtcaacacccaggtgctgcgcaccgaactgagcgggcaaactcgcgttgccgagctgttgcaaggcatcaaggagcacgccctgggtgcccaggcccatcaagagttgcccttcgagcgcctggtggaagcgctgaaactcgagcgcagcctgagccacacaccgctgttccaggtgatgtacaaccaccagccggtggtcgctgacattgctgcggtgagcaccgcgtccggcctggaattggccctggtggagtggcaaggccgcaccacccagtttgacctgaccctggacacctatgaaaagtccggcaccctgcatgcggccctgacctacgccagcgacctgtttgacgcgccgaccatcgagcgcatggcccaacactggatcagcctgttgcaggcgatggtggtggatggcgcacagcgtatcggcgaattgccgatgctcgatgcgagcgagcagcagcggctggtgcacacctggaaccagactgccgagtcgtatccgaccgagcgcgggatacatcacctcatcgaagaccaggtgcaacgcaccccgaatgcgccggcactggtgttcggtacgaccaccttgacctacgcccggctcgacgcccgcgccaaccagttggcccatgccctgggcgagcagggcgtaggtcccgacgtgctggtgggaatctgtgtcgagcgttccgtcgaaatggtcatcggcctgctggcgattctcaaggccggtggcgcctatgtgcccctcgatcccgagtatccccaggaacgcctggcctacatgatcgaagacagcggcattcacttgctgctcagccagcaaagcctgttggccttgctgcccgctgccggtatccaggtgattgccctggatcagccggcgctgtggctcgacggttacagccgcgaagcgcccgccgtggcggtccatgccctcaacctcgcctatgtgatctacacctccggctccaccggcaagcccaagggcgctggcaacagccaccgtgcgttggtcaaccgtttgagttggatgcaacaggcctatgatctggatgccggtgacgcggtgttgcagaaaaccccgttcagcttcgacgtctcggtgtgggaattcttctggccgctgatgaccggtgcgcgcctggtggttgccgcacctggcgaacaccgtgaaccggcgcgcctgatcgaaaccatcggccggcacgccatcaccaccttgcactttgtgccgtcgatgctgcaggcgtttatccacgagccgggcgtgcaggcgtgcacccgcctcaagcgcattgtgtgcagcggcgaagccttgcccctggatgcgcaactgcaggtgttcgccaagttgccgggtgcggcgctgtacaacctctatggtccgaccgaagcggccatcgacgtcacccactggacctgcatcgacgaaggcgcagacagcgtgcccatcggccgcccgatcgccaacctcggcacctatgtgctggacgcgcaactcaacccggtaccggccggtgttgccggcgagctctacctgggcggcaccggcctggcgcgcagttaccaccagcgcccggcgttgaccgccgagcgctttgtgcctagcccgttcgtgaccggcgagcgcctgtatcgcaccggtgaccgcgtgcgccagcgcgccgatggcgtgatcgaatacctgggccgcctcgatcatcaggtcaagctgcgcggcttgcgtatcgagctgggcgaaatcgaaacgcgcctgatgcagcacccgcaggtgcgtgaagcggtggtgttggtgcagggcggcaagcagttggtcgcgtatctggtgctggaagacgaagaaccgaccgatctcaaggcctggctcctcagcagcttgccggaatacatggtgccgacgcacttcatcacactggccaagctgccggtgaccgccaatggcaagctcgaccgcaaggcattgcccgtaccggacgcgacgctgcaacaggcatttgtcgcgccggaaaatgccttgcagaaggccttggcggcgatctggagcgatgtgctcggcgttgagcaagtcggccaggatgacaactttttcgaactgggcggcgactccatcgtctccatgcagttggtcagccgggcacgccaggccgacatcaacctcagccccaaggacgtgttccagcaccagaccctgcgtagcctggcgcaagtcgcaagcctgcgcctgcatactacgatcgaccagggtgctgcccagggccaggcgatcctcagccctgtgcagcactggttcttcgcccaggacatcccccagcgccagcactggaaccagtcgttgttgctgatgccgcgcgagccaatcgtggcggctttcctgaacggcgcgttgcagcaactggtcaaccaccatgacggcttgcgcctacgttaccaggcgaacggtgaggggtggcaacagcactacagcgagcctgtgggtgagtccttgctgtggcagcgccaggtagacagccacgaagccctggctgagctgtgtgatgaggcccagcgcagcctcaacctgcaagacggcccgttgttgcgcgcactgttggtgcagatgcccgatcacagccagcgcttgctgttggtgatccatcacctggtggtggacggagtttcctggcgcatcttgttggacgatttgcagcagttgtacgtcggcttgcgcgagggggcagcgccagcactggcgggcaagaccacctcctatcaaacctggacggcccggctgcaagacgccgttccacgctttctaccccagatggaaggctggcaagcgcagcttgggcaggcgtcgaccgcggatttgccctgcgataacccccagggtgccttgcatcaatacctggaggaaaaggtcagttgcaccctggatgccgagaccactcgccaactcttgaccctcgcgccggccgcctatcgcacccaggtcaacgacctgctgcttaccgcactggcacgtgtggtgtgccgctggagcgggcaggccagcgcgctgattcagttggaaggccatgggcgtgaagacctgtttgacggcgtgaacctgacccgcaccgtcggctggttcaccagcctgtttcccgtcaacctcactccggcacacgcgctgtcggactcgatcaagacgctcaaggaacaactgcgtgcggtgccggacaaaggcgttggctacggcgtgttgcgctacctggcctcgccatccgtggtcgcggccctggcggcgctgccccagccgcgcatcacgttcaactaccttggacagttcgaccgccagttcgacgaaggcgcgctgttcgtgccttccgccgaaggcaacggtctggcccaggacccgcttgcgccgctggccaactggctgacggtcgaggggcaggtatacggcggcgaactgtccctgcaatggggcttcagccgtgagatgttttcgtgcgcgacgatccagcgactggctgacgactatgccgccgagctcaaggcggtgattgcccattgctgcgggcttgaagccgggcaggcgacgccgtcggatttccccttggccggcatcagccagtcccagctggatgcgctggcgcagataggcgccgaggccgaagacctgtaccccttgtcgccgatgcagcagggcatgctgtttcacagcctttacgagcaggacgccggcgattacatcaaccagatgcgcgtcaatgtgcaggggctggacgtcgcacgttttcgtgccgcctggcaggccaccgtcgacgcccaggacatcctgcgcaccggcttcatctggcctggcgactggccgcaggcgcagcaaatggtgcatcgccaggtgcagttgccgttcagcgtgctcgactggcgcagccacgaggcgcttccggcagcccttgacgcattggcccaggcgcaatcgcagcaacctttcgacctggcccggccaccgctgttgcgcctggtcctggtgcaactgacggacagcgactggcacctgatttacacccatcaccacatcctgatggacgggtggagcaactcacagttgctcggcgaagtgttgcagcgctacagcggccagaaaccgccggccgcagtgggccgctatcgcgattacattgcctggctgcaagagcaggacagtgccgccagcgaagcattctggaaggcccagctattgcccctggaacagccgacccgcctggcccaggcacaggtgccggcgccgtcggggccagcctatggcgaacactattgcgtggtggacgccacccagaccctgcgcctgcatgaatttgcccgtcagcagaaagtcacgctcaatacgctggtacaagccgcctggctgttgctgctgcaacgctacagcgcacaagccacagttgcgtttggtgccacggtagcggggcgcccggcgcatttgcccggggtcgagcaacagattggcctgttcatcaacaccctgccggtggtggcgaccccgcaggccgagcaaagcctcggcagttggctgcaaagcgtacaggcgctgaatctgagcctgcgcgaacacgaacacgcaccgctttacgagatccagcgttgggccggtcgcggtggcgaggcactgttcgataccattctggtcttcgaaaactacccggtctctgaagtgctgcaacgcggggcacccgacggcctgcaattcgaggccttgcacacccatgagcagaccagttacccgctgaccctgacggtcaatctgggcgataccctgaccttgcattacagctatgcccatgggcacttttcaacgtccacggtgcagcgtctcggtacgcatttgagcaacctgctccagcatatgctcgatgcggccgagctaccgttggcggaactcagcctgctggacgcccaggagcaccagtcactggtgcacgactggagcagcgccactctcgattaccccagtgagcagcgggttcaccaactgttcgaagcccaggtggcgcagcaaccctcagcaccggccttgctcttcgaagaccgtcagctgagctacgccgaactcaacgcccgggccaaccgcctggcccggcatctggtgcgcctgggcgtcggccccgacgtgctggtggggatcgccgtggagcgcggcctggacatgatcatcggcctgctggcggtgctcaaggccggcggcgcctacgtgcccctggacccggaatacccccaggaccgcctgctgtgcatgatcgaagacagcggcacccggctgatgctgacccagagtcacttacgtgaacgcctggcgattcccgactatgtcgaccacctgtgcctggaccaggaccaggcctgggtcgacttggacgccagcaacctgggcaaccgcgcccatgcccagaacctggcgtatgtgatgttcacttcgggctccaccggccggcccaaaggcgtgggcatcaaccagctgtcgctgactcgccatgcctatgtatcgctggattttttcaacctcaagggcgatgaccgcatcctgcagttttccaccttcaacttcgacggcttcgtcgagcagttgtacccggcgctgatctgcggcgcctcggtggtgctgcgcggcaccgagatctgggacaccgagaccttctaccgcgaactgatcaagcaccagatcagtgtggtcgacctcaccaccgcctattggaacctgctggccaaggatttcgccacggccggtccgcgcgattatgggcgcctcaagcaagtccacgccggcggtgaagccatgccgcccgaaggccttgccgcgtgggccgaggccggccttgggcacgtcaagctgctcaatacctatggccccaccgaagccacggtgacggttaccgccctcgactgcaccgactacgtgaccggcgcccgccccacacccttgaccatgcccatcggcaaggtcctggccgggcgcagcatctacctgctggatgacagcggtgccccggcaccgatcggcgtggtgggtgaactggtgatcggcggcgagttgttggcccgtggttacttcaaccgcccggacctgaccgccgagcgcttcatgcccgatccgttcagccagaatggcgggcgtttgtaccgtactggcgacctggcgcgttacaacgcctcaggtgtgatcgaatatgtcgggcggatcgaccatcaggtgaaaatccgcggtttccgtatcgagctgggggaaatcgaggcccggttgctggagcaggagcaggtgcgagacgccatcgtccttgcgcagccggtggccagtggcttgcagttggtaggttatgtggtgcctcacgccaccgcgttgccggaagctgagttgcgccagtcgatcaaggcggccttggcggcggtactgccggactacatggtgccgggcttgctgatgttcctcgacgtgctgcccctgagccccaacggcaagctggaccgcaaggccctgccaaaaccggatgccagccaacagcaaaaccactatgtggcaccgcgaacggcgttggaaatccaggtcgcgggtgtctggaaaaacgtgctggagctggagcaggtcgggctggacgatcactttttcgagttgggtgggcattcattgctggccactcaagtggttgcacgcttgaaggcgttgctgtcctgcagcctgaccctgcgcgatctgttcggcgcgccacgcctggccgacttcgtggtcacagtggctgcccggagcgggcgtgacgcatcggcggggcacatcccgttgctggctcagggtgataaatccagtgtgatcctgtccctggcgcaacgccgtctatgggtggtcgagcagctgtcggatgcgagtggcgcctatggcatgccgctggccgtgcgcttgcgcggcgaactgtcattgccgttgctgattgacagcctggcgcaagtggttgcccgtcacgaaaccctgcgcacggcctacgtcagcgacgaggagggtgacccgctggcaatcatcgccgcgcacgcggatgtcgacttgccgatggtggacctgtcgtccctggatccggccgaacaagagcgccggatcgcggttgccgttgaagccaatacccgccaacccatcagcctgttgcaggcgccgttgttgcgcgggcaagtgctcaagctgggccccactgaacacgtattgctgtattcgatgcaccacatcatctccgatggctggtcgatggccgtgctggtcaatgaactggtgggcatttatgcgcgcgccaaggccggtgtgcttgagccgctgtcacccttgccgatccagtattccgattacgccctgtggcaacagcaactgcaagaaaccggcgtactggctgcccaggggcgctactgggagcaggcgctggccggtcacagcggtgtgttgcaactgcccaccgataaagttcgacctcaggcacccacctacgaaggccgggacctggcctttacgctgcccaccgccctgcatgacggcttgaaggcactctcggccaaagccggcgtcaccctctacagcaccatgctggcagcgttccaagtcatgctgcaccggctcagcggttgcgacgacgtgctggtcggtgccgacgttgccgggcgccagcagcccgagctggaaggcctgattggtttcttcgtgaacattctgccgttgcgttccagctttgcggcgcaacaaccgttcagcaccttcctggccagcacccagggcactgcgctggacgccttcgaacatcaggacctgccgttcgacatgatcgttgaagcctcgtcgcgtccgcgccaacggggtttcaacccactggtccaggtgctgttcgtcatgaacaacctgcccgtgcagggcggccagatcgacggcatagacgtgcaggtgctgccgacccgtggcggttattccaagttcgatatggccctgttcatcgatgaagatgccggccacctgcacgggacctggcagtacgccagtgacctgtttgaacaacaacgcattgagtcattcgtcaacgcctggacgggaattcttgagcagattgtgtgtgatccgaacattcaattaggggacatcaccatgcctaccaataccctggagcaacccaccacgcccgtaccgccagccatcaaggccgacaagttgggcaagttcctgaaaaaatcgcaaagccgcaccgacaagcctgccggcgcactggtgcgtgaaacgctgctggtcccggagcaggacttccccttgctgatggaacctaccgatccgggcctggacctggtggcctggatcaaggaaaaccgcacgttggtggaagccaaactggctcgtcatgcggggattctgtttcgcggctttgccctgcgcgacattcatgacttcgaagcgtttgccgaagccgtacaaccggggttgtacggccaatacggcgacttgccgaaaaaagagggcggcaagaacacctaccgttcaacgccgtaccctgaaaagaaaatgatcctgttccataacgaaagctcccatcaggaccgctggccgcgcaagcagctgttcttctgcgagcaaccctcgcctgtgggcggcgcaaccccggtggtggattgccggcagatgtacctcaagctgccggtggcgattcgcgagcgcttcgaagacaagggcttgctgtacgtacgcacctttgccgacaagctggacgtttcctggcagcacttcttcaagaccgatgtacgtgccgatgtcgaggcgcgttgccgggctgcgggcattgaatggacctggctggacaacgatgaactgcaaatccgcacaccgtgcccggcgatcatccggcacccggtgacggaggaaaaaaccttcttcaaccaggttcaactgcatcacatcttctgcctggacccggatgtccgcgaggacttgctcgcattgttcggtgagcagcgcatgcctcgtcacgtgtactacggcgatggttcgccgattgaagacgaagtcatggcgctggtgggcgagttgtacgaggcctgcgcggtgcggttcgactggcaaaagggcgacgtgatcctgctggataacatgttggctgcccacgctcgcgaccccttcgaagggccgcgcaagattatcgtggcgatgggcgaaatgattgaacgaagcgcgctgcaagccgcgcacagcgagaccgcaaaggaagaggccggagcatgagtactgcacaacagggaatgatggacccaggattggcgttgctggccgagcagcaacagtacctggacgcccgggagcaaggggcgagctggggcgacctggctcactgcctgaaactggacattcgtggcgaactggacccgctgcgcctgcagcacgccctggacagcctggtgtcgcgccatgaggccttggcggcgcaattcacaccggtcagcggctaccacgggctgcgtcagcgagtcgcggcggctgaggcggtgagctttacccagtggcctgaagtggcgtcgccccaacaggtgagtgagcgtcggcaacaatggttgcagcaaccgctgccggtgatcggcgcgctgttgcagcgtctggaagcggaccactggcaactactggtgggcgtcgcacgttacgcgaccgatgctgcgaccttggcgctgatccagcaggaactgctgacggcctatgggcagcaagaatttgaagaggaggagccggggcagttttcgcagtacctggaatggcgcagcgaggtgatcttcgacgaagacgccgacgtggccaaggcgtactggcagcaggtgcaagccaccgagccggtgctcgtcggcccggacttgccttatcggctgaccggcggcaccgcacctgcggagcgtttaagcgtgccactggaccaagccctgttgactcgcctgcaagcgtcgggactggcgctggacgtggtgatgcaaacggcctggtgggtgctgttggcccgcatcagcggtcgcgaaacattcctggcgggctggcggcatgacgcacgccaggactatgaattctttgagcatagcctgggcctgttcgagaaaaccttgcccctggcgattcgtatcgacccggccagcaccttcggcgacctggctgcgagcttggcgacacagttggaccagcaccgaacctggcaggaatactgggcgcccgtggcgtttccgcagcaggccaggccagccatcggttttggctgccgacgggtgtcggcgccgcgtgaagtggccgggctgatttgggccggcagcgacctgccagccggcctgccgtcatttgaattggcaatgcagctggatatcggcgcagccggcgagccacaaggtgtgtcgctggacttcaatcccgcgtgctactgcgcccaagcagtcgagagcctgttggcccagtaccgtcagttgctccatagcattgccgacaatccacaggcagtcatcgggcgcttgaacctgttggatgctgccgaaaaaaaccggctgctggcactcaatccgccagtgcaggcgctggaggcgccgttgttgccccggcgcattgccgcctgggcacagcagacgccacaggccatcgccctggcgcatgcgggccagaccctcagctatgccgaactggacgcccgcgccgcgcagttgagtggcgagttgctacgccagggcgtggggcctggctcgatcgtcggcctggcgttgccgcgttctgtcgagctggtcgttgcgatccttgccacctggcgtgccggcgcagcctacctgcccctggacccgcaatggccagcggcgcgccaggcggaaatcgccgggcatgccgccgcgagcctggtgctgatggcgcaagcgccgagccagggcgacccgatggcttcgttcaaggtcctgaaccctggcgcgtcgactgctgacactccattggcaccggaagtatccgtgcaagcctgggacgccgcctatgtgctgtttacctccggctccaccgggcagcccaaaggcgtggtggtcgagcatggcgcgttactcaactacaccgcaggcagcagccagcagttgggcctgtctgcctgccgtcactttgcgttcagctcgacggtcgcggcggacctgggcaataccgccttgttcggtgcgttgtacaacggtgcgaccctgcatatcgctgacgatgccatcctgcaagacccgcaaggctttgccgagtttttgcgagaccagcgcatcgactgcctgaaaatcgtgccttcgcacctggccgccttgctggaagccgaaaaccccgtattacccgcgaccctggtgctgggcggtgaagccatcggtgccagcctgatccatcggattcagcaattgcgccccgattgccgcctgttcaaccattacggtcccaccgaagcgacggtgggggtgatgatgcatccgctgctgcccggtgacgacctgacccagggcgtcccgctgacacaggtgctgccgggcaaccaggtgtttgtgcttggcgctgacgcgcaattgctggcgccgggcgaactcggcgagttgtatatcggtggccaccagttgtgccggggctacttgaatgccgaggctgacgccgacgcgtttatccgtagcccgctggtggcaggcgagcgtctctaccgcagcggcgacctggcccgttatcgggtggacggcggcgtgcagctgtatggccggcgggatcagcaggtcaaggtgcgtggttttcgcattgaactggcggagatagaggcgcaactgctgcgcttgccccaggtcagcgaggccgtggtggttctggtccaggacgagccgcaggcgtttgtggtgctgcgtgtggcggcggatgaggcggtattgacccagctcaaaaaccagctcgctgaacgcctgccggcggccatggtgccgcgccagatactgagcctggagcgcatgccgcgcctgcccaacggcaaggttgaccgcaaggcattgctgcacacccagccagtggtgtcccagcatgtctacgtggcaccacgtgacgcccttgagcaactgctgtccacgcgcatggcccagttggtcggactggaacggttgagcatcgaccaggactttttcagcgcaggcgggcattccttgctggtgatcaagctggtcgcgggtattcgcaagctgctgcaatgcgagattcaccccggtgtggtgtttgatcaccccagcgtggcggaactggcgcgggcattgcgcgagcgtgaaagtgtcgcggggcaactggagaagatcgcccaggcacgtttgcgcctggatgcaatgagccctgaagagaaggcggcgctgatggaaaaggcccgccagacgcagcagggatagtggcagtgtccggggctggcaatcagccccggttctaatcctgggacgctcaggcgctactcagcgctgttcctccaaccagttcaacacctctgcataaataccggcaacggcgctggtgattccgttcatgcgcaggaagtcatgggtcagcccagactgcacctgcagggtgacggcagtgccgctcgcttccagcaactgggcataggcctggccttcgtcatacagcgggtcgtactgggccaggctgatataggccggggccagcgcggtcagccctccggccagcagcggcgagaccctccagtcgaggcgctgttgggcgtgcgggcaatagtgctggtagaaccattccagcgttgcggtttccagcaggtaatcctcggcatattgtcggtgggaattgcgttgccgcgaggtgtcggtgaccgggtaaaacagcaattgggcccagggtttgaacgccaattgttgcggcgtcttcactgcggtgatcgccaagaccgtcgccagcgtcgccccgacactgtcccccgcgacggttatccggcggctgtccagttgcaggttgccggcctgttcggccagccagttggcggcgtcaagggtgtcattgacggcggtggggaagcccgcttctggcgccaggcggtaggcgggtgcgaacaccgcgtattggccactggctgcaagcctgcggcagatggaatcgtgggagtccaggctgcccaccacgtaaccgccaccgtggatatacacaatcgccggcagttgcgccgtgcccggtgcgcggtagaggcgggcgggcaatacatggccatcgcgtgcggtgaccgtcagctcagtgaccgccaccgaacccggtgggctgggatcgagaatggcggaggtctgttcgaactcccgccgagcctgttcaacactgagtgtgtgcatgggttggcttttgccggtcaggcgacccatttgtgccagttccagaaagccttcgaggtcagggtccaggggcattgcatcttccttgcgaaatggagtgaagcgccgcccctgaccagcaggggcggcaacggtttcagctggctacgggttgcagcgccaggtgctgcaacagcccgtgaagcagggccgggtgattgagtatgtcgtagtgaccggcctggatctgctcgttgctgcgggcgcagggcaggttcgaggcgggctggccgggcgtcgcactagcccaccagcaatcggcctgggtccgggtgggcggcagaccttgcaggcgctgggacaatgccttgagtttcatcgccacctggaaggtgtgggccagttcctcggcactgattgcggcgtacaccgattgcgcggcggcgcccgcctggacctgcgcgatcagttgctcaaggaccgcgctgtcggtggtcgccctgacctcaaaggtcggcaggctttgcgccggcagaccgaacagcaccgccaggaaaccgcgcaagtcttcgctccaatcgtcgctgacgacgtcttcgcccgtgggaatgaagctgtcgaccaggcccaggaacgccacccgttgaccctggctttccagctcctgggccaccagcaccgccagcgtgccacccagcgaccagcccatcaggtgatacgggccactggcttgttgctggcggatgtattggctgtaatcgatggccatggattcaagggattcatcctcccactggcggtccagcaacatccggcattgcaggccatagacgctgcgctgcccatccaggcggcgggccagaggctcgtagtcgaacactgtgccaaaaccggcatgcaggcagaacagcggcgggctctggggcgtttcactgttgagcaacagcagcgggttcaggctcgcgtcatcctcggcaaagccggacagctcggcgatggtgggcttgccgatcatgtcgcgcagcttcaattcgatgccgatatccggctggctgcgcaccttcgacaggaccttgagaatgcgcagcgagtcgccgcccaattcgaagaagttgtcggtgacgcccacactctccagttccagcacgtcctgccagatcgccgccagttgtgcttccaactgattgcgtggcgctacgaaggcacggcccttgaagtccgggtcgggcagggcctggcggtccagtttgccgttggggttgagcgggaaggccgagagcacgaggatttgtgccggcaccatgtagtcaggcagttcgccctgcaagactgtacgcaggcgttcgcccaggctggtcgaggtgtcggccaccacgtagcctatcagttgcttgccgccgccggtgtcgcgggcgatgaccacggcgtcctgcacttcggggcactcgcgtaagcgtgattcgatttctcccagctcgatccggaaaccgcggattttcacctggttgtccagacggccgaggtagtcgatcacgccgtcggggcgttggcgcaccaggtcgccggtgcgatacaggcgggtgccgtcggccgcgaacgggtcgaccacaaaacgctcggcgctcaggccggggcgccgatggtagccacgggcaacgccttcgccgccaatatacaactcgcccgccacgccgtcgggcaccgggttgaggtgttcatcgagcacatacagggtacgttcaccgatgcgtgtgccgatcggtgcgtacaccgccgcgcaagtttgatcggcactcactttccacagcagcggggtgaccacggtttcggtaggcccgtatccgttggtcaggaactgcggcttgagcacgcgcttgaccagctcgaagttggcctcggccaccgcatcgccaccaaagcagtagatgcgcacgggcggcggcgcgccgttctggctgtcgccatactcggccaactgctgcagatacgccggcgggaagcaggcaatgctgatgtggtgggcgtgcagcgcctgccaggtttcttccggggtccacagttgattgccacgtaccaccaggcacccgccgctttgtagggtagataaccagcgctcctgggcgccgtcgaaagcgaacgacatgaacagcaactcacgggtgctggcgtccatctcgtaacgctcggcaatcgcctggcagtgcatgcggatctgcccatgcgccacggccacgcccttgggcttgccggtggagcccgaggtgtagatcaggtaggccaggttgtcgtcatgtgccgtgtgtatcgggcaagtcgccggccagtccgccagtggcaggcgatcaagttcgatcaggttggcaccaccgaggtcatcgaaacgcgagcgcagcgcgtgctggctgagcagcacccgcatgcccgagtcttcgacgatccactgcacgcggtcttgcgggtagtcgatgtccagcggcacgtaggcggcgccggttttcatgacgccatagaaggcgacgatgacatccaccgaacgttcgagcgcgacgccgacaaacatttccgcaccgataccctgggcgataaggtaatgcgccaggcggttggcgcgggcatccagctcgccatagctcaattcgattccgtcgcagaccaccgccactgcgtcgggacgctcctgcgcgtgctggccgattacctgggccaggtgggcgcgcggcgccgtgcgggggctcagcaggttacgttggcgcaacaagtgctgctcggtgtcggccagcatggtgaggctgccgaggttggcctggctgttgttcagcagctccagtagcagggtttcaaagctgcggcggatttgcgcggtggcggcctcggtaaagcggttgcgcaggtacaggaactcgatcttcagggtgtcgccaaggttgattgccaggtccatggcaaagttggtgacatcgcggctgttgacttcgccaaagctcaggcgctcctggccggcttgctgcaggcgctcgtccaccgggtagttttcaaacactaggatgctgtcgaacagcggctggccaccctggcccgaccaacgctggatgtccgccagggacgcatgctcgtggtcgcgcacctccaggttgtaggcttgcaaggcttgcatccattgggcgacgggcatgtgcggctgcggcgtctggatgatgggcagggtgttgataaacaacccgagcatgtcttccgagcccggcaggctggccgggcgtccggcgacggtggcgccgaagcacacggtgtcctggcccgtgtagcgctgcaacagcagcagccaggtggcctggataagcgtgttgggggtgacgcgcaggcgctgggcctgttcacgcagtcgagcggtttgcacggcatcccaatccagatacagcgccgcgtgaccgtccagctcggcgctcggtttgggtgaaacgctgttggccagcgacgaggtgccactcaagtcctgcagcctggttttccagaattgttccagcacggtctgggactgcgcttgcagccagcggatgtagtcgcggtaatgcccgcgcttggccggtgcggcctggccgttgtagatcgcgaagacttcaccgagtaaacgcgagttggaccagccgtccatgaggatgtggtggctggtccagatcaggtagtgggtctgcggatcgagctgtaccagggtcaggcgcgtcaggggtgcacgcaggagttcgaagcctcgagcgcaatcctggctggcgagggcttgcaggtcttgcgcgctgacctcgcgctgctgccagtcgagaacttccacgggcatgctcgcagcgcgatataccacttgcagcggctcggccagttggttatcggcccagaacccggtacgcaggatttcatggcgctcgatcacggcgttccaggccgcagtgaatcgcgcgacgtccaggccgctgaccgagacggccatctggttcacatacagtgcactttccggggcttccagggtgtgaaacagcatgccctgttgcatcgccgacaaggggtagaggtcttccacctggggcaatggcaccggcagccggtccagttgcgcctggctgatgcgcgccagcgggaagtcggagggggtcacacccaggttcgcgctgtcgcagcaatgctcgatcagggccagcagctcctgcttgaggtcatcggccagttgggcaatggtggcttcgtcgaacatctcgcggctgaactgccagcccagggtcagctcctcgccgtacacctggccattgaggctcagccagttgcccagcggtgcccccagcgcgtgctcgcggccactgccctcggcagcgggcgccagccacgagccctgtgctgcatcgaagctgccgtcgaactggccaaggtagttaaacgtgatgcgtggtgccggcagggcagcaaggctcgcctgtgcctgcggcgtgcccaggtagcgcagggcgccatagcccaggcctttgtcggggatcgcgcgcaactgttccttgatctgtttgatcgaatcgccaagacccgccgccggtgacagcttgaccgggaacaggctggtgaaccaacccaccgtacgggtcaggtcgatgtcatcgaacaggtcttcgcgaccatggccttccagctcgatcaggcaatgcccggtgccggtccagcggctgatgacgcgcgccagggcggtcagcagcaaatcgttgatctgcgtgcggtaagccttgggcgcctgctgcagcagttggcttgtctgccctgcgtcgaggtgggtgtacagcgtgtggctatggcgattgtccaggctggcgttcggacgctcgcacggcaggtcgaccacagcgtcgcgcagttgcgcctgccagtagctgagctcgtcccgatcgcggtcggcacgctgttgcaggcgctcggcccaggccttgaccgagctggtgcgggccggcagttgcagcggttgtccgttgctcagctgttgataggcgttttgcaggtcttcaaagaggatccgccaggacacgccatccactgccaggtgatggatcaccaacaacaagcgttgcgtgccatcggccaggtgtatcaacagagcgcggatcagcgggccgtgttgcaggtcgaggctgccctggacctgatcgcacagttgcggcagtcgctcgacggtggtgtccacctgttgcagctgccagtcgcccattggccggtaatgcgcgctccagttgccggactgctgttgaaaactcaagcgcagggcatcgtgctgctcgattacggcgcacaacgcccgttgcagcgcctcggccactagcggttgcgcgggtttgagcagcaccgactggttccagtgatgacgctcagggatcgttgttgcaaaaaacagctgatgaatcggcaacagcggcagggtgccggtggcggggccctggtcgatcacttgggccgtcgcaccgctacgggcgacgctggccaggccctgcacggtctggtgttggaacagctccttgggggtaaaggcgatgccttgctgacgagcgcggctgaccacctggatggagatgatcgagtcaccgcccagctcgaagaagttgtcgttcaggccgacgcgttccagtttgagcacgtcttgccagatggccgcgatctgctgttccagcgggttttgcggcgccacgtaagctttttgcaacaggctcgcatcgggtttgggcagggccttgcggtccagcttgccgttggggctcaggggcagttgatcgaggaagatcaattgcgccggcaccatgtagtcgggcaagtgttcgcccaggcgctgtttgatctcgctgcgcagttcatcggcttcgcgggtttcggtcggtacggcataggcgaccaattgaccatcggcggcgatcaccacggcttcgcgcacacagtccagttccatcaggcgggtttcgatttcccccagctcgatacgcaggccgcggattttcacctggtggtcgatacgcccacggtattcgatcacgccgtcaatgcgatagctggccaggtcgccggtgcggtacaggcgttgaccgtccccaaacgggctggtcatgaagcgctcggcggttagggtcgggcgacggtggtaaccgcgggccaggcctgcaccgcccaggtacagctcgccgatcaccccgggcggcaccggttgcagctcggcgtcgaggatgtaggtgctgaggttggcaatcggctggccgatgggcacgctggccttgccttcttcgcggcaggtccagtgggtcacgtcgatggcggcttcggtggggccgtagaggttgaacagcccggcgttcggcagcttggcgaagacctgctgctgcgcgtccacgggcaaggcttcgccgctgcacacaatgcgtttgaggctggtgcagcgggcgacgttttcatcgagcaaaaacacctgcagcatcgacggcacgaagtgcagggtgctgacttggtagcgctggatcaaactcaccagggtagccgggtcgcggtggtcgcccgggccggcaatggccaggcgtgcgccggtcatcagcggccaaaagaattcccacaccgacacgtcgaagctgaacggggtcttttgcagcacggtgtcggcgtcggtcaatgcgtacgcttgttgcatccagcacagacggttggtcagggccgaatgtcggttgccggcgccttttggttggccggtggagccggaggtgtagatgacataggcgaggttttcgccatcaacggcaatctcaggattgacctcggcataggcgctcatatccagttgatccagcgccaatacgggcagcgccgccggaatcggcaattgcgagagcaaatgctcctgggtcaacagcaggccaatgccgctgtcctcgatcatgtaggccagacgatcctgggggtattcggggtccagcggcacataggcgccaccggccttgagcacggccagcaggccgatcaccatgtccaggctgcgttcggccgcgatgcctaccagcgcatccgggccgacgccgagttcgatcagcttatgcgcaagctgattggcgcgccggttgagctggtcgtagttcagctgttgctcaccgaacaccagcgccggtgcctcgggcgtggctgccacctgggcctcgatcaactgctgtacgctgtggtcgagcgggtagtggataccggtgttgttccactcgttgacgatctggtgttgctcgccgctatccagcatcggcaggtctgcaacccgctgttgtggatcttcaaggaggctgcgcaacagctgttgccaatgccgaccgaggcgctcgatggtggcggcgtcgaacaggtcggtggcgtaggtcaggctcgcgctcaggccttcggccgactcactggtgctgagggtcaggtcaaattgcgaagtactgccttcccagtccaacccctcgacctgcaacgccgaaggcagtgattggccatcggtgctgctgcgcttgtcggcactctggtgattgaacatcacctggaacaacgggttatggctgaggctgcgctccggttgcaatgcctccaccagttgttcgaacggcaggtcctgatgcgcctgggcatccagtgcatgttgcttgacctgttgcagcagctcttcgacgcgtaattgcgcgctgaactcggctttcatgatctgcgtgttgacgaagaagccgatcagcccctcggtctcgatgcggttgcggttggcgatgggtacgccgacgcggatatcgtgctggccgctgtagcggtgcaacagaacctggaacgaagccagcaacagcatgaacggcgtgacaccgaggcgtggggccatgtgctgcaccgcgtcgctcagctcaggcgccagggtgagtgacaggtgggcgccacggtagctttgttccgccgggcgcgggcgatccgtcggcaactccagtacgctgttttctccggccaactgggcggtccagtaggccagttggcgctcacgctcgccggcgtccatccattggcgttgccatacggcatagtcggcatactggatcggcaaggtcggcagtggggcaggttgcccagcctgggccgcgccgtacagggtgatcagctcttcaaccatcaactgcactgaccagccatcggaaacgatgtggtgctgggtaagtaccagcacgtggtcatcatccgccaggcgcagcagcctgacccgcagcagcgggccgcgttgcaggtcgaacagctgtctggtttcgtgttcaacaaaagttttgagcgtggcgtcgtccggcgtgccgtgcaatgtctcgaccacgagggccagcggggcctttgcggcgatgacttgccgggggtgttcgttgtccactacaaaggtggtgcgcagtgtttcatggcgggcgatgagttggttgaaggcttgctccagcgccgcgacattcagcgcgcccttgagacgcaaggcagccggcaggtggtaggcggcgctgtgcgggtccagttgccagaggaaccactggcgttcctgggcgtaggacaggggcagcgcctgatcgcgtgcgatgggcgccagaggcagctcatcctgacgggagcggccgtgcaggccggcgacgaaatccccaagcacgctgcgttcgaacaggctgcgcagggccacgtcaaggttcagggcctggcgcaccctggagatgatctgggtcgccagcaacgagtggccgccgagggcgaaaaagtcatccgtgaggcccacctgctcaaggccgagcacactttgccagatcccggcgacctggatttccagcgccgttcgcggcgccacgtagtggttttgctgttggctggcatccggttttggcagggccttgcggtccagtttgccgttggggctcaggggcagcacatcgaggaacatcagcaagcccggcaccatgtagtccggcagcaccgccgccaaggccgccttgatcgactggcgcaactccgcttgcgatagcgccgtggcgtgaggcaccacataacctaccaactgcaagccactggccactggctgcgcgaggacgatggcgtctcgcacctgctcctgctccagcaaccgggcctcgatttcccccagctcgatacggaaaccgcggattttcacttgatggtcgatccgcccgacatattcgatcacacccgaggcgttgtaacgcgccaggtcgccagtacggtacaaacgcccgccattctggctgaacggatcgggcatgaagcgttcggcggtcaggtccgggcggttgaagtaaccacgggccaacaactcgccgccgatcaccagttcacccaccacgccgatcggtgccggggcaccgctgtcatccagcaagtagatgctgcgcccggccaggactttgccgatgggcatggtcaagggtgtggggcgggcgccggtcacgtagtcggtgcagtcgagggcggtaaccgtcaccgtggcttcggtggggccataggtattgagcagcttgacgtgcccaagaccggcctcggcccacgcggcaaggccttcgggcggcatggcttcaccgccggcgtggacttgcttgaggcgcccatactcgcgcggaccggcagcggcaaagtccttggccagcaggttccaataggcggtggtgaggtcgaccacactgatctggtgcttgatcagttcgcggtagaaggtctcggtgtcccagatctcggtgccgcgcagcaccaccgaggcgccgcagatcagcgccgggtacaactgctcgacgaaaccgtcgaagttgaaggtggaaaactgcaggatgcggtcatcgcccttgaggttgaaaaaatccagcgatacataggcatggcgagtcagcgacagctggttgatgcccacgcctttgggccggccggtggagcccgaagtgaacatcacatacgccaggttctgggcatgggcgcggttgcccaggttgctggcgtccaagtcgacccaggcctggtcctggtccaggcacaggtggtcgacatagtcgggaatcgccaggcgttcacgtaagtgactctgggtcagcatcagccgggtgccgctgtcttcgatcatgcacagcaggcggtcctgggggtattccgggtccaggggcacgtaggcgccgccggccttgagcaccgccagcaggccgatgatcatgtccaggccgcgctccacggcgatccccaccagcacgtcggggccgacgcccaggcgcaccagatgccgggccaggcggttggcccgggcgttgagttcggcgtagctcagctgacggtcttcgaagagcaaggccggtgctgagggttgctgcgccacctgggcttcgaacagttggtgaacccgctgctcactggggtaatcgagagtggcggtgctccagtcatgcagcatcaggtgatgttcttcgcggcccagcatgtccagttcaccgaggcgttgctgcgagtcacgcacgatcgcctgcaacaggttctgccaatgcgcggccaggcggcggatggtcgaggcctcaaacagatcgatggcgtaggtaagggttgcctgcagtgtgtcggtggactcgaaggtgtccagcgagaggtcgaactgagtgctgggcaacgtgccttccagcacttcgaggctcaggccaggtagcgtgacgcgggtttgcggttgcacgctggcatggttgtacatcacttggaacagcgggctgtggctgaggctgcgttgtggctgcagtgcttcgaccaattgctcgaatggcaggtcctggtgagcctgggcctgcaaggcatgctgtttgacctgttgcagcaactcgacaaaccgcacctggccgtcgagcgttgcgcgcagtacctgggtgttgacgaaaaatccgatcaatccctcggtttccacgcggttgcggttggcaatcggcacgccgacacggatatcggtttgcccgctgtagcgatgcaacaggatctggaacgacgccagcaatagcatgaacaaggtcacgccttgctcacgtgccaattgcttgagcgcctgattcagctcgcggtccagcaccagttccagttgcccacctcggtagctttgctcggacggccggacgtggtcggtaggcagttccagcaccgtttgctcatcgcccagttgaccggtccagtaggccagttggcgctcgcgttccccagcgtccatccattgacgttgccacacgccatagtcagcgtattggatgggcagttcgggcaggctgacatcctgttgccggctgaaccccgcatacagggcgaccaactcctggatcatcacattaatcgaccaaccgtcggagacgatatggtgctgagtgatgatcagcacgtgatcgtcaggtgccagtctcagcaacttgacccgcagcagcgggccgtgctgcaagtcgaacaactgtcgggtctcgtcttcgatacacgcacgtatcgtctgcgcgtcggcgtccgggcacgcctcgatggtcattgccaggtgagcgtgggaggcaatccgttgcacggtgcgttcaccttcctgggagaacgaggtgcgcaggctctcatggcgggcaatcaggccgtcaaagctgcgttgcagggcctgggtgtccaggtggccgcgcaggcgcagggctgccgggatgtggtaggccgtgctgtcaggatccagttgccagaggaaccactggcgttcctgggcataggacagaggcagcggctgatcgcgctcaacccgcaccaatggcggctcatggcgcgccggctcctgcgccaggctggcgacgaacgtatgcagggtgctggactcgaacaggttgcgcaggggcacatcggtgttctgggcgtggcgcacccgggagatgacctgggtggccaacagggaatgaccgcccagctcgaagaagtcgtcgttcaggcccacacgttccagtttgagcacgtcttgccagatggccgcgatctgctgctccagcgggctttgcggcgccacgtaagctttttgcaacaggctcgcatcgggtttgggcagggccttgcggtccagcttgccgttggggctcaggggcagttgatcgaggaagatcaattgcgccggcaccatgtagtcgggcaagtgttcgcccaggcgctgtttgatctcgctgcgcagttcatcggcttcgcgggtttcggtcggtacggcataggcgaccaattgaccatcggcggcgatcaccacggcttcgcgcacgcagtccagttccatcaggcgggtttcgatttcccccaactcgatacgcaggccgcggattttcacctggtggtcgacacgcccacggtattcgatcacgccgtcaatgcgatagctggccaggtcgccggtgcggtacaggcgttgaccgtccccaaacgggctggtcatgaagcgctcggcggtcagggtcgggcgacggtggtaaccgcgggccaggcctgcaccgcccaggtacagctcgccgatcaccccgggcggcaccggttgcagctcggcgtcgaggatgtaggtgctgaggttggcaatcggctggccgatgggcacgctggccttgccttcttcgcggcaggtccagtgggtcacgtcgatggcggcttcggtggggccgtagaggttgaacagcccggcgttcggcagcttggcgaagacctgctgctgcgcgtccacgggcaaggcttcgccgctgcacacaatgcgtttgaggctggtgcagcgggcgacgttttcatcgagcaaaaacacctgcagcatcgacggcacgaagtgcagggtgctgacttggtagcgctggatcaaactcaccagggtagccgggtcgcggtggtcgcccgggccggcaatggccaggcgtgcgccggtcatcagcggccaaaagaattcccacaccgacacgtcgaagctgaacggggtcttttgcagcacggtgtcggcgtcggtcaatgcgtacgcttgttgcatccagcacagacggttggtcagggccgaatgtcggttgccggcgccttttggttggccggtggagccggaggtgtagatgacataggcgaggttttcgccatcaacggcaatctcaggattgacctcggcataggcgctcatatccagttgatccagcgccaatacgggcagcgccgccggaatcggcaattgcgagagcaaatgctcctgggtcaacagcaggccaatgccgctgtcctcgatcatgtaggccagacgatcctgggggtattcggggtccagcggcacataggcgccaccggccttgagcacggccagcaggccgatcaccatgtccaggctgcgttcggccgcgatgcctaccagcgcatccgggccgacgccgagttcgatcagcttatgcgcaagctgattggcgcgccggttgagctggtcgtagttcagctgttgctcaccgaacaccagcgccggtgcctcgggcgtggctgccacctgggcctcgatcaactgctgtacgctgtggtcgagcgggtactggataccggtgttgttccactcgttgacgatctgtcgttgctcgccgctatccagcatggccagttcggccaaacgctgttgtggcgcctcaatcagactttgcagcaagcgcagccaatgccggcccaggcgctcaatcgtagccgggctgaacagtgccgtgctgtactcgatgtccgtcgtgatctgttgcggcgcgtagtccacgtgcatcgacagctcgaatttggcttcatgctgcgccactggcaggaacgccaaggtcaattcgcccagcgtcagcgtgtccgtttgatcctggctgacacgccagttgaacagggtctggaacagcgggttggcctgggtgctgcgttgcagttgcaagcgctcgatgagcagttcgatcgggtagtcggcatgttccatggccgcccgggattgctgacgcagcgcctggagaaaagcttcgacggtcaggtcgtcggtgagttgtgcgcggtagatctgactgctgacaaagtaccccaccaggtcctgggtctcgctctggttgcgaccggcattcggtacaccgaccgtgaagtcccgctggccgctgtagcgactgagcagcagttgccaggcgccaagcagcacgataaacggcgtcaagtcgtgttggtggcagaagccctgcaactgttggctcagggttgcaggtaatgacaggcgcagattgccggcgcggtgatgttgttcggtgctgcgggggtaatcggccggcaggtccagggtgggaatcccctgtcccaggtagtcggcccaatactcggcggcacgcagttgttcgggcgtgccggggtattcctcgcgctgccagcgggcgtagtcggcgtactgaatggaaggtcgcgccaacggcgtggtatggccctggcaggcgcgccggtaagcctgggtgaggtcttgcatcaggatcggattggaccaggcgtccgagacgatgtggtgcatgttcagcagcaggatgtggtcatcgtgttcgagcgtgatcaatgtggcgcgaatcagcggggccaggctcaagtcaaacggcgtgccggcctcggccgcaatacgctgggcgacggcagcggcccgggcgtcgggcgcgagacccgacaggttctcttcgtgcagatggattcgggctttcgggtcaaatacttgccgaggttggtcgtccagggtctggaacgcagttttcagcacatcgtgtcggtcgataacctgctgcagggccgcgcccagcgctgcgatgttcaaggcgccacgcaggcgcagtgcgttgggcaggttgtaggcgctgctgccgggcgacagctgttgcaggaaccacaggcgttgctgggcgaaagacagaggcgtggggctgcgatggggttgagccttgatggaatgctctgagccggcgtcgtcggccatcaacagggccagcaagtcgtcgtcggggagttgattcagtgggttcatgttgggtctcgtcgccatcggctgcgtaaatatgcgttgtcagaaagacgaagcgtggccgacgagatttaggtatgacacgggacttcaatggccggcggcgaacggcagggcgctcgccacagggtaggttcaggcgacggctttttcgctgatgacgcgcccggcctgcatgcgcaccaactggtcggcgacgtcgaagtaacggtcatcgtgggagatgacgatgatggtcttgcccaggcgcttgaggtccggtagcagctcggtatagaacacgcggcggaaggtcgggtcttggtcggcggcccactcgtcgaataccagcaccggccgttcgtcgagccaggcgttgatcaaagccaggcgcttgcgctgcccggtggagaggtcggtggtggtgaacgcgccgtcacgaatgctgaccttgtgggcgatctccatgcgctccaggtactggttggcatcctcgggtagggctttatcgctctgcaccagttcgtcgaacaggtaatagtcggcaaaaatggtggtgaacatctgtcggtaatcatccaggccacgcgcgtccacggccatgccgttaagacggatttcgccactctgtggggtgtacagccccagcagcagcttgatcagggtggtcttgccgcagccgttttcaccgacgatgaacaggatctccccgggctcgatgctcaagttgaccgggcccagggtgaaaggctcgctgcctgccacgggcgggaaggcgtattgcacgtcgcgcaattccaggtgcttcatgggtgggatgctgcgctcgtcggcatccagcagcaggtgaggctcgggcgatgaaaaacgctcggacaggtcggcgatgcggcggaaagctatctgcgcacggctgatgatcggcaggttggcgatcaagttttccagtgggcctttcatatagagcagcaccagcacaaagccgctcatcatcgccgggttgctgctgggccagaacgattgcagggtcagcgccaggccgatgactacaaagaacagcatcgaacccaggcttttggcgatcacgaaaatgttgatcgagcgtacgtgcgtgtcgcagatgtggtcggcggtggcctggatattgcgggtcaacatggcgtggcggcgcttgcggtgaatcctcaactccttggcgccttcggcgatggccgagtagtgcttttgcaggctgtcttccgcgtcgcgtgcctcatagaagcctttgatgcccttgccttgtgcgatgaactggatggccgagccgatgccgatggccagcaatgtcatgaggaaaataggcagcgacaggctcgccagatagcccaggcagccaaggatcaccgtgatcgaaatggccagcggggcgaaggcgaaggcgaaatcgctgatggtgtcgacatcgtgggtcagcaccggaataagccggtggctgcgatagcgttcgatctgctcgatcggtgccgacaataccttcgcacccagatccttgcgcagtcgggcaatgactttttgcccgacaaagttgctgccgatgtcggcggcaatgctgctgagcagcgcgagtacgcacaggccggcaaaggccagcaccaccgcagtggtgaggccggactcgctgtgcaggccctggttaaccgtggccagcagcgcggtgacgctcaggcctccaaggatgccgaacagaatcgagaggatgacggtgtagcgatagggcttgagcaggctcaagagttcgcgaagggcgctacgcggttttgcagtcatgaaactacctcggtcgcgacgtggctacgtgctatgggcgagtgggggctgcgtcgatcgagctgatcgccggcgggcttttgtaggagacgtttcgactctggcgggatttagctttatcgcgccggacctggaggtggtgggcccttgtaggcgctgatcagcaagggcgggcgctgcattgggacaagattttggtggcgcgcctaaattttttctgccgacaagcgttttagtcctgataaggccggattccatttccggtggggcggttaaaaaaaacaggtaaatgagtctggttttcattaggccatccgtctcattcaccagaggcgctcaaagacgccgctatttctgccaatcacacgcctcattgctcaaggattgctgtcgatgtcttatcccctttggttgtctacgcccaagcgttacgcgttgaagaaattgccgcaggccgtgcgcctgatgatgctgggggctgtactggtcgtgccggcggctgctacgttgatgccgggcgctgcgttcgcccagggcgaggcgggcaaggtcgccttcgcgattccggccggtcaattatcgcaagcgctgatggcgttcggctcggcggccggcgtctcgatctcctacgacccggcgctggccagccagcaaaccacccgcgggctgagggggcaattcagcgtggatgaagggctgtcccggttgttgtcgggcagtggcttgcaggccagtcgcgaagccagcggcagctatgtggtgatgccgcctgccagtggttcggcggtgatgatgctgggggcgaccaatatcagtgccgaggggctcggggcaacgaccgaaaacagcggttcctacaccacgggcgcgaccagtactgcaaccaagttgccattgtctctgcgtgaaaccccacagtcagtcagtgtggtcacccggcaactgatggatgaccagcacctgtctacgctcaacgaagtgatggccttcacccctggtatcagcatcaaccatcgcgacagcgaacggttcgatttcaactcccgtggctttaccatccagaacttccagtacgacggcattccgtcgcaagtggccaacgagtcccagcaatacgtcggcgccatttcggacatggctatctatgaccgcgtcgaagtgattcgcggcgctaccggcctgatgagtggcgcggggacgccgtccgccaccatcaacctggtgcgcaagcgtccgaccaaggacttccagggctacgtgtccggggaggcgggggcatgggatcgctaccgctccgaagtcgatgtctccgggccgctgactgagacgggcaatgttcgtgggcgctttgtcgcggcctaccagaaacagaattcgtttatcgactggtacggccaggaaaagcgcgtgatgtatggcgctttggatatcgacctgaacgacagcacgacgctgcgcaccagcctcgactatcagaacaatgatgccaatggcagcagttatgggcatatcccgctgttcttcagtaacggcaagcaaaccaatttctcccgttcattcaacccggcctcgcgctccagttacatggacaacaccagctacaacttcaccaccatgttggatcacaagctggacaatgactggagcctgaaaacggcttacagtcatcagtattcttaccgtaaaggccagggcgcatcggccagcggtggctaccctgacccggcgacagggcagggcacaggcgtattcatttatcgcctggacagctaccagacccaggacaccctcgatacctacgcctccggcccgttcaacctgggcgggcgcgagcatgagctggtggtcggtgccagtgcctcgcgtacgcaccttaacttccccaactacgccagccacaacgatgacggcgattatgggtcggcgaatatcttcaactggaatggcaatgagtacgggcgtcgtcagtacttcaaggatggcggcaccgtcaccaccttgcagcagaccggcctgtatggcgccttgcgcttgaaaccgttcgatccgctgaccatcattctgggcacccggctcagttggtggaaccaggaagacgaggtcagtaattacctcaatggcaccaaggccaccgacaagaccaagaaaaccggggttgtcacaccctatgtcggcgttgtctacgagctgaacgacacctattcggcgtacgccagttacaccagcatcttcctgccgcagaccttctacaaaactggatcgggcggctcactggctccgcttgagggcgacaactatgagatcggtctcaagggtgagttcttcaacggtgcgctgaatgccagcatcgctgtgttcgacattgagcagaaaaacacacctgagcaagcgggcgtggattctgccggccgcgcggtgtacaaggccatcagtggcactaacacccgtggcgtcgagaccgagatctccggtgaagtggccagcggctggaatgtgtttggtggctatacctaccgtgagtcccatgacaaggatggcggtcgggtccagaccaaccagccgatcaacctgttcaagttcggcacgacttatcgtttgccgggtgaatggagcaagttgaccgtcggcggtaacgtgacctggcaaagcgagatgtacgcgtcttcgcaaatcaactatacaggcccttattacaaggcgacccaggatccgtttgcggtggtcggcttgttggccaagtacaaggtcgatgagcacctgaccgtaggtttgaacgtcaacaacctgtttgaccagaagtactacgatggcatgggtacattcaactcgggctcctatggcgaaccgcgcaatgccatggtcaacgccaagtggaccttctgattcgctgaggtgctggggtcgaagaggcgggagggagttgactccctcccgctttcgttctgtattggtgggtagtaaagcggtctggatcagaggtcgcgaacgactctgaaaccgagccagtccccgcgggtatccgggtagatggtgttgcggttgcccgagcgggaaaacaccggtgcctcgccccaatcattgccgcgaatctggtatccctcacagtttggctccacccacgcactgccatcagtcggtgcgccgatgtagtttggatgttcgcagtcagccacccgttcatacacattgccgtgcatgtcatacatgccaaacgcattcggcgggtagctgccgaccggcgacgaatagctatagccatctgccgggccgtaggtgttggcgtgcttggcgatgctgtagcccttgccctcgtcgaacgggaaggggaacgggccggttgtgccggcacgagcggcgtattcgcgctgggcttcgctgaccatgtggtactgctgcccggtcttcttcgacagccagctcacgtactgcttgatgtcgtccatatccatgcacaccgccggctggcgcgggccttgagggtagcgcggcttgctggcgatgcattcgcggccagggcgatcgtcgccgttggcgatcttcacgccggtctggcgcacgtagctgtcccattcagcggcggtgatatggaaacggctcatggcgaagggcttggcgaaggtcacggcatgcatcgggccttcgtccggttcgcggccgacctcaccttccggcgtgcccatggtgaaggtgccggcaggcagtaccaccatttccgggcagtccttgcagtctttgaataccttgccgggttgtggtgtggcggcctgagccaggttgggcagcagcgcgccgcacagggcggtgagtgccagtgcggtcaggggtttgagtcggaatggagtcatgtgggcatctcgtccaaagggaaaaaggtcatagccgttggctcagcaaggtcacgaagcgctggagctcatccgagctgttgagcaggccgggcgcggtacgaatcaccgggccgacgtcacgatcgactgcgtccaccaccacgcggtttttcatcaggtaggccgccacctcgtcgctgtcctggcccttgactcgaaagaaggtgaaacccgccgacagctcagggctgcgcggcgtgaccagctcgatctgcgggtgggccagcaactggtccttgagttcggtgttgagggcatggatacgtgcctgcaccggtgctttgcccagctgcaggtgcagcttgaaggcttcgtcggcggcccagcgatgttcgaaggcgtggtaaccacctggcgtcatggtggtggcgaagtccttgtcctcggaaaaagtcggcaccatcggcgtgacgtatttgttctcggcgtcacgggcgcacaccaggccggtgccgcgcgggccgaacatccacttgtgggtgccggcgataaagaagtcgcaatgcatgtccgggaaatcgaggttctcgacgccgaagccgtgtacgccgtcgaccacatagaggatgcggtcgttgtcgtcacggttgcggttatgttcgttcaccagttggccgatctcgccgatgggcagtttcacaccgctgccggattgcacccaggtcatacccagcacgcgggtattggggcggatgttgcgcttgatattgcccatcacttcgtcgacggatacctgggcggcgttcttgaacaggtggatacgacgcacccgggtgccctgcttgagcgcacgaaaatccaggctgctctgcgtggcgtagtgctcatgcaccgtggtaaggatttcctggtccggtcgtaccttgatcccgccataaatcatcgccagcccttcggacgtgctgccggtaagggcgatctgtgccggtgttgcattcaggtagcgaccggcccattcgcgcacctggccttcacgcttccaggtttcctgcaggtcccagtccattgccagccctgggttgcggtcgatttgcatgcggtagcgttcaatggcctcgcgcaccggcttggggtgcgaggccaccaggaagttggaaaggtgcaggtaatccgggtcctggttgaacagctgtttcaatcccgtccatgggtcattcgtagtggctgccattgcggggggtagcagggcggcgcccagtggcaggctcgcggcaaagacgccggcctgcttgagaaatgtacggcggtcggtcatggacttacttcgtggtgattagcggttggccaagggtttggcggctttttgtacctggtcccacacgcgcaggaagttgcctccccacagcttggcgatatcggcttcggagtagccgcgctggatcagttcggcggtgacgttgcgcacctcgccgacgttctcccagcccttgaggccaccgccatcgttgaagtccgaggcgatgccgacgtgatcgatgccgatcttgcgcacggtgtagtcgatggcgtcccccaggtccttgagggtggccttgggttcttcctcgaggatggcgtacagcgcactggcgtattggccgaagcgttgctcaggccaggccgcaatgattgcgtcgccgggcatcaaggccatggccaggttgggcaacggcggcaggtcgaagcgcgcacgcagggcgttgagcttgttctgggtcggttggctcaaggggcgcaggtatgcggggaagcccaccacctgcaccacgccgccgctgttcttgatcagttgcagttccttgtcactgaggttgcgcgggatatccaccgacgcccgtggcgccgagtgggatgccaccatcggcgtgcggctcaattgcgcgacttgctccagggccttggtcgacatctgcgacacgtcgatgatcactcccaggtcattcaggcggtgcaccgcttgttggccgatgggcgacaggccctcgagggcgtcggtcgaatcattgaaaaacggcaacgggcgcgacgagtcggaccaggcgttattgccgatgtagctgaaaccgaacatgcgcatgccgcgtgcggcccacaggtcgagctggttcagatcattgcccagggggtaggcgttgagcatgctgataaagatcgcaaacttgccttcgccgtgcaggcgccgcatatcgtccggggtgtaggcgatgcccacctggttgggaaagtcgcggaccatgccggaaatgattttgtagcgcacctcctgctcatggcgggcctcttcgacaaaaccgtcggtgggcttgtggggggcgttggggccgctccagatttccggccagccaaaaatcgtcagcgcggcgccggacaatcggccacgcgctgccttgaccaggtcgaactggccgctgccatccttgtcggcctcattacccgccgtgccgaaatccaggggcacggtgatatggctgtcaaacgacaacaggcgatcctgcatttcattggcttgcttgatcacctccagcgagtagccggcgttgcccttgaaccactggtcccagatcagaaaaccggacccggcgccgatagccagggccaacggcaggccgatatacagcgcctttttcgaacgtgattttgtcattgccatctcagtcagttgaggcctttgctatcaggaaagaacgagcgatgacgggggaaatttaggtgcggggggcgcggcggtaaatttcagcgggctgcaaacgttctagctctgattaagccgtttcctaaggtagacaatgacaatctctcgacgtgggttcatcgcaggcctggcgctgaccggcgcggccgtgccggcggccttttacgcccatcgcgagctgacgcgggaagaattccccatcacccccggcgaagccacggtcgacctggccgatacccagggccaacacctggcggacaccctgcgcggtgtgtggagcctgcgcctggaagggcgcgatgccgggctcaagggcttgccgcgggacggcttggaactgctgctcgacatcgccccccgtggccgcggcctgcgtggttacctggacaccgccgagaacctgcgcgccgacggcgagccgcgctaccgcgtattgggcgatctgctcaccggcgatggcgccgtgctctattggcggttgatcgaccgcgatgcgcaggccgatgtgcccgcctatgagttcaagatgaccctcgatgaagtctgggccgacttcggcaatgccggcagcggcaccctgagcgggcagattctcgaccttgagcgccccctggccttgaccgagcgcgacaaccgtttcatcgcccacaaacagctgtttcccgaagcccgccagcgcattggcctgaatccgaccttgctggcctggctggtgtctcccgaacaccgcctgtttcaccaactctggcacgccagccgtgatcggtggcacaagctctccgaagaacaacgcgaagccctgcgcggcatcggctggcaacccgggccccggggccaggagcgcgacgcccgaggcaaacgcaaggatcgcaacggctcgggcatcgactttttcttcatgcaccgccatatgctcggcaccgcacgctccatgcaggatttgccctcatggccgcaattccccgaaccgcaaccggcgctggagcgtgatcgcctgggttttgtgcggtacttcgacaaccacgacggttttgcgctacccccttgttggtcggcaccggatgacgctgactacacccagtgggtcagcgacatcaaggcggccgagacctaccacagcaacttccaggtgtgggaatcccaataccgcgatccgcgttacctggccaagttgaccctgggccaactgggctcggagatggagctgggcctgcacgactggctgcacatgcgctgggcctcagtgccccgcgacccttccaacggtgcgccggtgccgttcgcccgcgaccctgaggacttcgccccacgttggtacgcgccggaaaatgactttctcggcgatccgttttcatcccatgtaaacccggtgttctggcattttcatggctggatcgacgaccgtatcgaagactggttccgtgcccacgaacggttcaaccctggcgaggtgactcggatgaaggtcaacgacgtggcctggtttgctccgggtcgctgggtggaggtgggcgatccatggctgggcccggacacccacggctgcagcaccacaccagggctgcaacaggggcgctcgatggaaatggacccggaaatcatgaagctggccctgcgcatcacctttggcgccgatgaggagctgctcgaggggttgttcaagcgcgtaccaaaacggccgtggtatgcacggcacttgaagctcaagcgccagacataaagtgtggcccaatagatgttttcaaacctgctcttcatcccgcagttgcacgctcatctcatcgcaactgcgcgcccagtcgcttagccattgcggcatcggctgcgaggtttcgttcaaacccagttcgcgcacgaattccgccggaggcagggtgccctttgcggagcgaaacaccccgcgtatcaccaccacgccaatcacccggccgttactgacgaaacggtgctccatcaggctccacttatggtcccagccgagcatgcgggtgtgcacttcgaagacctcgaacagcttcaactctcgacgaaacttgccccaggtgtcgcccacgatcggcacggccttgtgacgcagcgccacgcggaaggcgcccgtgcgcaagacaaaatccatgcgtgccacatccgccagggtgaaatatcggccattggtgacatgccgattgaggtccaggtccagcggccagacgcgcatgcgcaccaccgtggtgtccaggccatgtaccggtttgcgccagggacggcgcaacagcatgtgcagtaatcgaaaccagagattcatgaaactacccgacagttgatcaatggcagcactgtaacggtgcgggatcggctaaggtaggtgcgcaaatgacttattacatgcgaaaagcgcaaatcgggttcttatatgcacattactctgctcttggctgatcaatgttctggtgcgggtgccaccttggtcatggagatgctaagcgcagccaacctgttcgccgaccgcccacctttcgaggtgatgctggcttccctggacggccagccggtgacggcctggggcgggcagcgcctgcacgtggattgctcactggagcagattgcacacaccgatctcgtactgatacccggttttctcttcaccctcaaacaagccttgccgacgtttgcagcctatggcccctggctgcgtgagcagcacgggcgaggtgccgtgctggcctcgatgtgcacggccaccttcatgctcgccgagaccgggctgctgcacggcttgcgcgccacgacccattgggcgtttgctgagttcttccggcgtcggtatgcccaggtcagcctggatgaggcgcagatcctctgcgaagaaaaccgcctgatcactagcggcggcgccacggcggcgatggacttgatactgcacctgatccgtcgtttcggctcaccggaactggcccatacctgcagcaaatacttgctgatcgatgccgggcgcaccgagcagtcggggtacgccatgtggtcgttgcccaagcaccacggggatgttgagatcctgcgcgtgcagcattggttggagcagcacttcgctgaatcactggtgatcgatgaggtggcccagcgctttggctttggcgtgcgcaatttcaagcggcggttcaaggacgccactggttgtacaccgattgcctacctgcagaccctgcgtctggagcgggccaagcagatgcttgaaaccacccgcatgaccctcgacagcatcacctatgcggtgggttatgaggacagcaactcgtttcgccgattgttccagcaacgggtggggatgttgccgacggcgtatcgcaagaaattcctggttgcccagggatgaagatggcagcagacctgcctgatggcctcggtccaaatatagaaggggacttgccccccatggcggcctcgcagccaaccggtacctaaatgatggtctcggtccaaatgtgggagggggcttgcccccgatgacggcctgacagccaaccagaatgttggatcagaccgagtgcatgccccaccactcggcacctcgctcaggctcggtgtgcccgtaatccgccatggatttggggggcgcctcagatcaaaagccagatcaagagcggcttgctgcgcatcgtggttagcgttgagcggtgcaggattttgcgattttcatgcaaatcgcagacgaaaaaaaaccggctgatcaggccggtttggggtgtcccgccaacagagcggggttatacgtgggtgctcagcaaacgttcggcaccaccttcggcgaggccacgttcctgcaggcgatctgcaccgccttcagccaggccacgttcctgcaggcggtcagcaccaccttcggcgaggccacgttcctgcaggcggtcagcaccaccttcagccaggccacgttcctgcaaacgatccgcgccaccttcggcaacgcgggtttctatcaggcggtccgagccgccttcggcgactacggggtgggcaaaagcgtttgcagcgagtaccgagaaagcgaggctaagcaagagttggcgtttcatggtggtgtgctccgaatgttttagttgggtgccgtttggcatgggtttgatgttacgcgttgcattttttaagagaacttcattgcgctgatggtgactatcgatgccagcgatggtccttgccgaaccatcactgcaagcgtcacggcatctgcggcagttcattggggcgcaggtcgaacaccagcacctccgcgtcctcgccatggctcaggcgaagctggcgctcatcacgcacccgcacaccgtcgccttcctgcaagcgttggccattgagttcaacgctgccgcgcgctacatgaacgtaggcgtagcgatccggcgccagctccaggcgtgtgctttcgtcgccgttgaacagcccggcatacacccgtgcatcctggcgaactttcagcgagccattggcgccgtccggggagatgatcagctgcaagcgcccgcgtttctgcgcttgactgaagtgctcctgctgatagcgcggcttggcgccagcctcgttgggcacgatccagatttgcaggaagtgcacccccaggcgttggctgtggttgaactcactgtgggccacgccgctgccggcgctcatcaactgcacatcgccagggcggatcaccgagccggtgcccagggtgtccttgtgttccagggcgccttcgagcacgtaggagaaaatctccatgtcgcggtgcgggtgctggccaaagcctttgccggcggcgacgcggtcatcattgattaccagcaggtcggaaaaaccctgttcgttggggttccagtagttggcgaaagagaaggtgtggaacgacttcaaccaaccgtgattagcggcgccgcgttcggaagctttgcgaagggtcagcatggtccagtcctcaagtgagcgcgggctgcgagatgcagggcgcttgggtgaggagaagattaatggttatcgaattattcattaacgagctgaaaatagaataactgtctccctctggttgacactcaaagtcgtgccataatgcccgccgcatttctgttcaatggactttccccgcttatgaaaaccgtggccatggcgctgttcccggacttcctgctgctcgacatggccgggccgctggaagtgttttcgattgccaaccgctacctgccggcagccgaccactatcagatcctgaccattggcactgagcccggtccgctgcgggcctccaacggggtgatggtgcagaccgatttgctcttggagcaggaccatgccgcctatgacctgctgctggtgccgggcggcccgggcgcctataacgaatgccatcccgcgctgctgccctggctgaaagcagcggcaccacggtcccggcgtttcggctcgatctgcaccggcgccttcgtgctcgggcatgcgggcttgctcgacgggcaccgcgtgactactcactggcattacaccgagcggttgatcaaggcgttccccaacgccattgtcgagaccgatcgcatctacttgcaggacgggcgcctgatcacctcgggtggcgtcaccgccggtatcgacctggccctctcggtggttgcccaggaccacggcaagcaagtggcggtggatgtggccaaggtgctgctggtggtgatgaagcgccaaggcggtcaggcccagttcagcccgatgaccgctgccgtagcgccccaggaaactgcgatcacccgcgtacagaaccacgttctggcgcatctggagcaagcttttaccatcgagtccatggccgaactggccggcatgagtgcacggcattttgcgcgactgttcgccaaggacgtgcagatgacgcccatggcgttcctgcagggcgcacgcatcgaccgggctcggcacttgttggaaaccaccgacctgccgctcaagaccgtggcgttccacgcaggcttcggcagcgtgcggcatatgcgctttctgttcagtgaaaagcttggcctgaaccctacccaataccgacaacagttcagttaacgacacaatgtccgtccagggcactcgattgtccgtatcgctccccgtgccagcattgccccgtcatcgccagctggcaagatagcgccgagcccatggaaaaggacgcgcaggcactcaagcacgggtgttccagcgcttttagcggacatgcacaactctgcggcgatcagcttcggcccttacacttttcatcggcaacagcgcctggtcagcaaggcgggcctgccggtggcgctgggcggacgcgccctggatattctcgcggtgctgctcgaggcgcctgggcaattcatcagcaaggcgaccttgatccagcgggtctggcccaacagcgtcgtcgaggacaataacctgcgcgtgcacattgccgcattgcgccgggcgctcgacgggccacgcctgatcctcaatcacccccagcgcggctactgtttcgtcgcccccgtgcaaggctcggcgccgacgttactgccacagcacaacctggctgcgcggctcagcccggtatgtggccgcgatgagcttgtgcgggtgctggcgcgacgcttgcccgggcagcggctgttgacgctcaccgggatggccggcattggcaaaagtacattggccctggccttggccgagcgggtattgccccgctaccgcgacggggtgtggtgggtcgacctgacccgcatgcatgccccccacgaactgctcggcagtctggtcacggtattgcaactgcaggattgcgagcgctttgatgagctgtgccgccaattggcctcgcgccagttgctgctggtactcgatggtgccgacctgttgctgggcgcgtgtcgcaagctggtgcgtgcattgcgcgaacaggcgcccggcgtcagcgtgctggtcagcagccgcgaagccttgctggcccccggcgagtgggtgctgcgcgtgcctcggctggccgtgccgtcgccctcggcattgagcagtgtcgagcaggccatggcttgtcccgcggtgcagctgtttatcgctcgggtgtgtgccagccagcaggggtttgtattacggcatcaggatctggcagcgctgcgcgatatttgccggcgcctggacggtatcccgttggccctcgaactggcggcggcccaagtcgacgcattgggcatcagcggtgtgcagagacaattgcgcacggggctgcagacgttgacccgcgggcgccgcacggcggtggaacaccatcgatcactgactgctgccctggactggagctacgaacgcctgagcctgccggagtgctggctgttcctgcagttggggttgttcaagatggcagtgaccttgcctgccttgagcgagctggtgagcgggaccgagcttgagcacgccgacctggcctatctgctggcgcgcctggtcaatgtctcgctgctgagcgtcgaacctgggctaggcccgcagcgccgctaccgcctgctcaactgtgtgcgcagctatgccctggcgcaactgcgtgacccgcgtcaggtcgagcgtttgcagcagggctacgagccatgtgtgggggctttttcaggccggccgtttgtcctgcaactcgtcgagcaggctgcttgcgcggactaagtcgcgagtggtgaagccttcggtaaatcgcccgtagactgaacccagcaggtcccgcgcggcctgcaaacgcccctgccgttgccacagttgtgccagggaagtcgcacagcgcagttcccaggccaaggcaccttgctggcgcgccaggcccagggtttcgagcaacagggcttcagcggcgcggctgtcgccccgttgcacccactgttgggcacagacccgcaggatttcaggcgcgcaccagcccgcagagcctgcgcgtgcgcgctcgaaggctgcttcattgacttcgtcggcgccgaatgtaatcagggtgtcctcgatcagtcccagtccctgcaaatcctggtcgaccagaataccggcgtaatgcccggcccaggtctggaacaactgcgccgaatgcttgtgcgcctgttccagcagtaacctttgcagggcttgcgcatcgtcttcggcgccgttgtagcgggcgattaccaccccggccagggccagggtgtagcagatcgaggtgccatgattgatctgcagggccagctccagcgcctggctggcgctacgccaggcactgtcgggaaaaccctgtaaccacaggatccgcgccagcagggtcaaggatgccacgctttgatcgtattgcacgccgacgccatgggcgaaccggtttacatggccgctgtggctcatgcgctgcagcacttgctcggcattgtgccgggcgagcgcctggtccccggtgtaatgctgggccagtgcgcgcaatcgttgggcgctcagctccagcaacggttcggtacgcgggtcgaggcgatcaaactgcaggctttgttgcagtgcttgggcatagcgcccggcacacaggtttacagccatttgcccggagaccgcacgcagttgccctgcaacgtcgcgacgtgccagggccaggcgttcggcactgacaaaggcggcaatggtgcggggcgcagcgcccatggcgtggtaggagaggctgcccagggccaattgcaattgaaggatcagttgcgtgcagggcgtatcgacctggcctatcagtgccagtgccttgtccacatagccgccgtgctcacgcagcaatgacaattcctgccacaggggcattgcgctgaccgtcaggcggatggccagcaagtgcccgacgtcctcggcaaagccccaatcgagtgcggcgcgcacgtcttcgcgcagcggcgcatagcggtcaagccagggctgcgtggccagcagttcccagtcggttcgggcctgttccatcagcgccaggcagcgtgccgcatggcgctctcgagtggctggcagttcgccggcgaggctgagcttttccagggcgtaggtgcgggtgatatccagcaggcgatacaccatctcgtcatcgccggcttccacattcaacaaagacttggccaccaattgcgtgatggaacccagcacttcggcgggggcgatcgtttccccggcgatcaccgctgcggcgctggccaggctgaagcctgcgcgaaaaaccgcgaggcgacgcaggcaggttttttcgcactcgccgagcaggtcaaagctccagtcgagggtggcccgcagggtttgctggcggggcagggcgctgcgccgcccgcgggtcagcaagcggaaattgtcttccatctgtatcagcagcccctgcaagccaaaacgctcgatttgcgcggccaccagttcaattgccaggggaatgccgtccaggcgctggcagatatcaatcgccaggggcaggtcagcttcgctgagggcaaagctgtcctgatgggacatggctcgttcgatcagcaattgcatggccgggtaacccagggcctgggcacggttgccggtggcgggtgggcaagccagcggctcgaggcgttgcacatactcaccgtcggcgcgcagggcttcgcggctggtggtgaggatgtgcaggtgcggcgcatggcgcaacagggtttcgctgatcagggcgatgtcgtcgagcaagtgttcgcagttgtcgatcaccagcagcatctggcgtgcctgcaggctacgggcgaagctgaccagcggtgcattcgcagcgggtgtcaggtcgaggagcgcggcgaggttgggcaggatcatcgaggctgcgctgagtggcgccaggtccagcagatgaatgccgtcacggtaatgcccgatcaacaactcggcgacgcgcagggccacggtggtcttgccgatgccaccggcgccggtcaaggtgatgaagcgctgctgcggcagttgctgcaccagggcgtcgatcagggcttggcggccgatcattcgcgtacgccgcaacggcaggttatggctcgggcgctggggcatgccgcctgtgggtagcgtcatcggttcaatgctcagtggcgcaacaaaactgtagccgcgctgagcgaccgtgacgatatagcgctgcccggcctggccatcgcccagcgccttgcgcaacgcggccatgtgtacccgcaggttgccgtcttccaccacggtcttgggccagacccgcgagatcagctcctgcttgctcaccacattgccggcctgctccagcaggaccagcagaatatccacggcccgccgccccaggcgcagcgggcggccggcttccagcactaggcgctggcgcgggtggacacggtaggggccgaagtgcacggcctggtcgctcaagtcagtcatggctgcccaggttccggagtcgaagatgggccagcatattccaggtgcgtgaagaccactaggcggcgatcaccgaaggcttgtggcgcgactggtggtttcgccaggtcatcgggttcacgccttcgctgcgcgtgaacatgtggcagaagtgcgcctggtcgcagaaaccacattccaggctgatttgcgtgaggctcaaggacgaaccggtgatcaactccttggcgcgctggatgcgttgctggcggatccattcctggggcgatagcccggtggtgcatttgaatgcgcgggaaaagtggctgcgcgacaaggcgcaggcctgggccaggtcggcgatagccaggctttcgccgaggttggcgaggatcagttgcttggcgattcgttcgcgccgggggcacaggccgccggtggcggacaaacgtggggcgtattgctcgagtcgggccatgacagatatccgtagtcgatgggagcgttcccggtggatggatgcagtgtagacgcctgcattcttggtgcaggagctccggcctgacgagttaatcgttgttaatttcgccagctgcaggcgtggaaaagacagcacaggcatgcaatcgcggggagtgcggatatgcttccctggccgtctggaaaacgtttggataccgccatgaaccgcaacgacctgcgccgcgtcgacatgaacctgctggtaattttcgaagccttgatgtttgaaaaaaacctgacccgggtcgccgaaaaactctttatgggccaaccggcggtgagcgccgcattgggccgtttgcgcgacttgttcgacgacccactgctgctgcgcaacggccgcggcatggagcccacgccccgtgcggtggcgatactcaaggagctgcaaccggccatggacatcatctcgggcgccgtcagccgcgccaaggacttcgacccttccagcagcagcgcggtgtttcgcatcggcctgtccgatgacgccgagttcgggctgtttccggcgttgctcagccaactgcgcgaagaggcaccgggtatcatcgtggtggtgcgccgggccaattacctgttgatgtcggcactgctggccagcggtgagatctcggtgggcgtcagctacaccaccgaactgccggccaatgccaagcgcaagaaactgcgggacatcccctgcaaggtactgcgcggcgatgacggcgtggcgcctctgaccctggatgactattgcgccaggccccatgcgatggtgtcgttttcaggggacttgagcggcaatatcgacctcgacctggcacgcatcggccgctcgcgccgtgtggtgctggctgtaccgcagttcagcgggttgcgtgcattgctggcgggcacgcagattatcgccaccgtgccggattatgcggcgtgcgcactgaccgagggcacccgcttgcgcgctgaagacccgccgtttgccattgacgcagcggagctgtcgatggtctggagtggggtgcatgacaatgacccggcggagcgctggttacgggggcggatcgcggagcatatggccgccaagtgactctgtcagtgaccccctgtaggagcgagcttgctcgcgaaaaacgtcaacgataacgcgtgtatcctgaataaacgcggcgcctaggggtttttcgcgagccagctcgctcctacaggcatagggcttgccccctccaacatcctcaggcgccaaacagcacatacatccaattcccaatatccacggcccggcaaactcctcccatcgctcaatactgcgggggagtcacccaaccatggacccaacacccaagaccagtcctgacgaagtcgtcacgctggtggtcaagcaccgggtcaagcccggacgcgaaaccgagtacgaagcctggctgcgccgtatcgtgcgtattgccggtgagcgccccggccatctgggcgtcgatgtggtacgcagccggcagaacggcatggcgctgttcacctgtgtgctgcgctatcgctccaccgatgccctggaactgtggctcgattccccccaacgacaggccctgatcgacgaagccgcgccgatgctggcggacggcgaccagactgaaatcggcgccgtcaatgagttctggttcgcgccccaggccgacggcgctgcccagccgccgcgctggaaacaggcagtggtcagcctgtgcgtgattttgccgcaaaccttgctcctgccgtttatctgggggccgatcctgcgcctgcacccgttgctgtccaactatgtggtctccaccttcctggtcaccctgaccattgtgctgttggtggtctacctgctgatgccagcggctacccacttgtttgccccctggcttcaaccttctgtaaaggaaaccctatgaacgccgatctgattctgttcaatggccagttccacaccgtggaccgggaaaacccacgtgccacagccgtcgccatccgcgacgggcgcttcgtcgcggtcggcactgacggcgaggccatggccctgcgcggcagcggcacccaggtcatcgacctcaagggccgcacggtaatcccagggctcaatgactcgcacctgcacctgatccgtggcgggctgaactacaacctcgagctgcgctgggaaggcgtgccgtccctggccgatgccttgcgcatgctcaaggaccaggccgaccgtacccctacgccgcaatgggtacgcgtggtcggcggctggaacgaattccagttcgccgaaaaacgcatgcccaccctcgaagaactcaaccaggctgcgccggacactccggtgtttgtgctgcacctgtacgaccgcgccttgctcaaccgtgcggcgttgcgggtggccggctacaccaaggacacgcccaacccgccaggcggcgagatcgtgcgcgacagccacggcaaccccaccggcatgctggtggcacgacctaacgcgatgatcctgtattcgaccttggccaagggtccgaaactgcccttggaataccaggtcaactccactcgccagttcatgcgcgaactcaatcgcctgggcctgaccagcgccatcgatgctggcggcggcttccagaactatcccgatgactatgcggtgatcgaacagttggccaaggaccaacagttgacggtgcgcatcgcctacaacctgttcactcagaagcccaaggaagaactcagcgacttcaagaactggaccggcagcgtcaccctgcatcagggcgatgattatctgcgtcataacggcgcgggcgaaatgctggtgttttcggcggcggatttcgaagacttcctcgaaccgcgcccggacctgccgctgaccatggaacaggagctggagccagtggtgcgccacctggtggaacagcgctggccgttccgcctgcacgccacctacgacgaatccatctcacgcatgctcgatgtgttcgagaaggttaaccgcgacattcccttcaatggcctgccgtggttcttcgaccacgccgaaaccattaccccgaaaaacatcgagcgcgtgcgcgccctcggtggcggcattgcgatccaggaccgcatggcgttccagggtgaatactttgtcgagcgctacggtgccaaggccgccgaagccacgccgccgatcaagcgcatgctcgccgaaggcgtgccggtaggggcgggcaccgatgccacgcgggtctccagttataacccgtggacctcgctgtactggatggtcagcggccgtaccgttggcggcctggagctgcacgccgaaggcctgccacgcctcaccgcgttggagttgtttacccacggcagcgcctggttctcgtccgagcagggcaagaaaggccagatcaaggtcggccagttggcggacgtggccgcgttgtcggcggacttcttcagtgtcgacgaggaagccatcaagtggatcgaatcggtgctgaccgtggtcggcggcaaggtggtgtacggcgcgggtgacttcgaagatttcgccccaccacgcgtgccggtgctgccggactggtcgccggtggtcaatgtaccagggcactggcgtccgacctcacccttgcaggcccaggtccaccagtgcagcggcccgtgcggcgtgcatgcccacagccatgaaaaagcccgtctttccagcgtgccagtcagcgacttccagggcttctggggtgcgtttggctgttcatgctttgccttttaatccagaaaccaaaggagttaccccatgacttataagcgcttgaacaaagatgacgcggttgtcctgctggtcgatcaccagactggcctgatctcgctggtgcaggatttctcccccaacgaattcaagaataacgtgctggccctggccgacgtggcgaagttcttcaacctgccgaccatcctgaccaccagttttgaaggcggtcctaacggcccactggtgccagagctcaaggcactgttcccggacgcgccatatatcgcccgcccaggccagatcaacgcctgggacaacgaagatttcgtcaaggccgtcaaggcgaccggtcgtaagcagatcatcattgccggcgtggtcacggatgtgtgcgtagccttcccgaccctgtgcgctctcgacgaaggcttcgaggttttcgtggtcaccgacgcctccggcaccttcaatgaaaccgtgcaacaggccgcctgggcacgcatgactgccgccggcgcacagttggtgaactggttctcggtggcctgcgagctgcaggttgactggcgcaacgacatggaaggcctggccaacctgttgtcgccgcgcatccccaactaccgcaacctgatgaacagctactcggcgttcaccgccaagtagccggttctcaaacctgtaggtaatcccatgtgggagggggcttgctcccgatggcggtgtgtcagtcacagcatttttgactgacacaccgccatcgggagcaagccccctcccacattttgattgtgttcccatattaggtttgtggtgtggccaccgacaggctataaatcagcccatcgtccaccgagaagcgacaatgaaccccttcgaagacatgcgcctgttctgccaggtcatggagtccggcagtttcaccgccgccgccgagcaactgggcctgtccaagcaattcgtcagccgccgcctgatccagctggaagagcgccttggtgtgcgcctgctcaatcgttctacgcggcgcctggatgtcacgccactgggccagagctactacgaatccgccctgcgcctgctcggtgaagtcgagcaagtggagcagggcatcgccggccagaacagcgagccgcgcggtaccatccgcctcagcgcgccgttgtcattcgccatggctcacctgggctgcctgctgccgttgttcctgcaacgtcatccgcaggtgtcggtggaagtcgacctgagcgaccgccctgtggacttgatcggcgagggctacgacctggtgctgcgcatcggcaccctggaagattccaccctgatcgcccgacggatcgccagcgtgcagcgggtgtactgcgccagccccgattacctggcgctgcgcgggacgccattgaaacccgaggacctgaccgcgcacgactgtctgccctacggccatggtcgccaggtgcaatggcgcttcaaaggcaagttgcaggggttgaatgtcagtgggcgtatgcgcgtgaataacggcgagttgttgcgtgataccgccattgccggtctgggggtgacctacctgccgacctttatcgtcgcggatgcgttgaaagacgggcgcctggtgacactgctggacgacttcgcccccgaagccctgaccctgtcggcggtgtatccccagcaccggcaaagctcacggccggtgcaggcgctggtggagtttttacgcgagcgcctggctagcggctgttgaacagctggcggatcaggttcggggtgctgccggtccagcgcttgaatgaacgccggaagttcgccgcatcgttgaagttcaggtacgccgccacctcatcattgctgtagcccttgagctgatacaggtgcaacgccacctgcttgcgtacccggtccacctgctgttgaaaaccggtgtcgtgcttgttcaacttgcgcttgagggtcgccgggctcatggcgaaggcctgggccgcctgttccaggctgggcggctggcgtacttgatcgcgcaggtagtcgtagagacagtcgagaaaactgccggcaaaacccagctgttcgatctgctcgcgggcctgcctacgcgcaacctgaccggccgtaaccgaggcgccaggccaggggcgggtgaggtattcacgcgggatactcatcatgtccagcgggcgttcgaagcgcgtgtcttcgcccaggtgcacccagtactgctcgatataacgcggctcggcatggctgaaactgcatgcccatggcaggcgctcgccgcttagccattggctcatggcgatcagcgaggtcatgcaggcttccagcaggaaacgccagtgctcgccggcgccgcaactgtccagccagtacaggtaggcgcgatgctcatccagctccaattgcagggtggccaacgggctgagcagcacctgttgctggaccaggatctccagggcctggtgcaggttctgcgcatggccaagggcgtggctggcggcgccgtaatagcccggcagcaaacgctggccaaacaggaagctgctgtcgtcggcgtccaataacttgcggctgttgccgatcaggccgaagaactgttgcgggctcaggtgcgcggtgccggccaggatgtcctcgtgaaacaggccggtgccgcgcagcaggcgatggctgtcgatgtcgcgggacaaggccaggtcgatcagcgcggcgggttggtaatgtcctgggatgaagcggctgtcgacttcataccagctggttttcacggccatctcaggcacttttcgcaagcggttgcttggccctggccaacgccaggttcaggcgcttgagcaagttctggggcggttcttcaagggccatgaccacggcggtagtcgcggccagttgcaggcgttcgccttggtgccgggtcttgtgggccaggccgagcactgcctgctgcaactccagcgccagctccctggcctggcgttcaccggtattgggcagcagcaccacaaagcggtcgccggccaggcggcacagcaggtcctggcggcgcaggttgagcagcagcaaatggctgagggcttgtagtaccgcgtcgccctcggcatgcccgtaggcctggttgatggcggcgaagttgtccaggtccagggccagcagcgacagcggctgttgctggtcgcggctgtcttgcaggctgtcagccaactggcgcttgaggtaatcggcgccggccagcggcgtgagtttgtcgaacagccgatgctcacggaacagccgctcgcgtttttccatctgcgcgctgatcgccagttgttcgcggtgccagtggtagatgccgatggtcagcaggaccatgcccaccggcatcggtccggactccagccaatggtcccaggtgatgctgtcgggcaggcggataaactcgtcgaggctgtcgatccaccaggagaaaaagatgcacgacaggcccagcgccaggtagttggtgacgcgccctgcggggcggcttttgagcaccagccccagccataccagggcgagcagggcggagccgccttcgccgacaatatccagccacacccactcactgacgcttttcaattcgccacaggccaggtgcaggatcagcccgagattggcggcgaccagcagcaatgagagtttccagcggtggggcttgagcacgccaggcatggctgcgattccttgggcgaatgagcgatgggcgccagcacagcagatggatgtgaccgttggatgacggtgggcgagggtcgaatcagctcatctcacaggcaacaaagattaaacatgtgggagggggcttgctcccgatgacggtgtatcagtcagcttatttgtagctgtcacaccgctatcgggggcaagcccccttccacatgagaactgctgaggtcatatcagctcattccaagccaaaaatccgtgcaaacctgcggtttacggacatggccactcaatgctgtcacagaaccgtcatcccccacccctagcgtgccctcccagttgccgggccctcttgcctggcgccaacggattcttggggaggattgcatgtacaagcgcaccgggctcgtcagcttcacgcttaccgccttggccctggcgatggccagcgagcggctcacggcggccgaggcggccaccaccgagcatgtcgaagtggtcggccaggccgctgccatggacagcgccctcaaggaacaacgttcttccgacagcatcaggagcgtggtacatgccgacggtgtagcccagttaccggatgaaaacgtcgccgaagcggtgcagcgcctaccgggcatcagcgtggagcgcgaccagggagaagggcgttttgtcagcgtgcgcggcctgggcccggacctcaacagcgtcaccatcaacggcaccctggtgcccgcgccagagagcgagcgccgcgccgtggccctcgatgtgctgccctcggagttggtgcagtcgctgtcggtgatcaagaccctgacaccggacatggacgccaactctctcggtggcaccgtggatgtgaagagcttgtcggcgttcgatcacaaggggctgttctataccggtagcaccgaagccagctacgacaagaacactcgccagaccagcccgaaattctccggtgccgccagtaatcgcttcagcctcggcgacggcatcgacaacttcggcgtggccgcagcgctgagctggcaaaagcgcgactttggctcagacaacgtcgaaaccggtggcgcctgggatttcaccgacggcgccaggctcaacgagttcgaacagcgcgactacgacatcagccgcgaacgcgcaggtggcggcctgaacttcgactacaagcccgacgacctgagcagctattacctgcgtaccctctacagccgctacaaggacaccgaaacccgcaacgccgccagccttgaatttgccgacccgcaagcgcctggcgagctgggcgatgccgagggcaagcgcaagctgaaaaaccgtgaggaaacccagcagatccagtcctacgtgttcggcggcgagcgcatgctgggcctgtggaccctcagcggccaggccggctacagccaatccagcgaagacagcccggcgcacattgcgggcgctaccttcgacggcggcgactttgccaacagcggtttctacgacaaggacaaaccccgtccgatcatcgccagcggcttctacgacgccagcaacttcagcctcgacaaggtcgactgggagaaacagtacacgaaggacaccgagaaaaacctgcgcctggacctggcccgtgactatgacctgagtggctatgcctcccagttcaagttcggtggcaaggtcagccgccgcaacaaggacaacgacttggaggcctgggtctacaaggacttggatcagcaaggcttgagcgatgaacagctcaacctcgcgcagttccagaagggcagcgttgactaccgtctcggccgatatggcccaggcatcagcgcgggtaatatccgccaactgattggtggcctcaatcgggatgatttctacgaccccaccgaatccagggtcaacgacttcaccatccgcgaagatatcaacgccggctacctgatgaacaccgtcgatatcgacgactggcggttcatcgccgggatgcgttacgagggcaccgagttcgaagccaagggcaccggcgccaccgacggccagttcagcgccacagagaccaagcggcgttatcaccattggttgccgggcctgcacgcacgctatcagatcgataagaacacccaggtgcgcgctgcctggaccaaatccgtggtgcgcccaacattcggccagctggcgccgggtttcgtgatcgatgatgacgaagccaccttcggtaacccggacctcaagcccctggaatcgagcaacctggacttgggcatcgaacacttcatgggccgcgccggcaccgtatcggcgttcgtgttctacaaggatatccagaacttcgtctacaacaccgacgtggccggcacgggtgcctgggccaacttctccgaggcccacacctacgccaatggcgacagcgccaaactctacggcctggagctggcctactcacagaagttcgactggctgcccgcgccgtggaacggcttgctggtcggtgccaacagcaccttcagccgctccagcgcggatatcgagggtttcgacagcgccagcgggcgcaaccgcaagcgcagcatcagcctgcccaatcagtcggacacggtcggcaacctgatgcttggctgggaagacgacaagctcagcctgcgcctgtcggccaactataaatcggcctacctgtatgaactggcctcgatcaacgacaaggcccatgacctgcacgtcgacgcgcagaccttcgtcgacttcagtgcgcgctactcggtgaccaagaacctgcaagtcagcttcgaggcccagaacctcactgatgaatcgtacttcgtctacaccggccaccgcagctacaacggccagtacgaagagtacggcccgacctacaaagtgggcctgaccttcacccatttctaaaccacacctggattccaatgtgggagggggcttgctcccgatagcggtgtgtcagcctccattgtattcactgaaccactgccatcgggagcaagccccctcccacattggatctttatcgtattcgaaggattttgcctgttcatgagaatttccaagctgtacctgttgatcgcgctggtcaccagcgccaatgcctttgccaccgacctggccctgtcgccttgggcgccgagcttgaatgccgaagccgtggccttcttgcccaacgccaccgagcgcctggccgccggtacccgcgacgggctacaactgctcgacagccagggcgtcgaactggcgcgcttcaaaggcaacttcaccagcctcgacacccggcctgccggtgcacaagtactggtcgccagcctcgacaatgaccgccaacaggcgttgctgatcagcctggataccgccagcaaaaactggggcaagcccctgtacctgccaacccgtgactactcggtgaatggcctgtgcctttatcgcgattcggcggccaacctgttcgtattcctggtaggtgaagagggcaagggcgagcaatggctggtaggcaacggctcgacgctgctcactgaaccccagcgggtacgcggtttgccgctgccgccgtcggcgcagttctgccaggtggacgacgccacccagcagttggttgtcaatgaagagaatgtcggctggtgggcctaccctgcgcatcccgaagctgatgtgaaacgcacgcctgtggcgctgttcgacaaccccaagcgcgaagccggggccatggcgctggtgccgggtggcatggttgcgctggacccgaagaccgcccagttgcacctgttccagcaagccggcgagcgctgggcggagcaatcgagcttgagcctggcgggtctgaaagagccacagcaattggcgatcaatggtcgccagttgttggtgcgcgatgacgacagcggcaagctttatcaggccaggctcgactggcaggccaagcccgttgtagtcgccccggtgttgccggaggtcgcggccttgcgccagagcgacccggtcggccgtcaaggcgatgcggcggatgacccggcgatttggattcaccctcagacaccggccagcagccgtgtgctcggcaccaacaaaaaacagggcctgctcgcctatgacctcgacggcaagctgttgcaggagctggcggtgggccgtctgaataacgtcgatgtacgttccaacttcaagctcggcgcacaaacggtcgacctggccgtggcgagcaaccgcgaccgcaacagcctgagcctgttcagcatcgaccgtcagagcggcgagctgcgtgaagccggggaagtgaccacgccgctcaaggacatctatggcatctgcctgttccagcctgccagcggcgagatctacgcgattgccaacggcaaggacggcaccttcctgcaataccgtctcagcgcgccggatgggcgtgtgcaaggcgagctggtgcgccagttcaaggtcgacagccaacccgaaggctgcgtggccgatgatcaacgccagcgcctgtttatcggtgaggaagacgtcggtgtatgggcagtggatgcacgcgccgatcagccggcaacgttgaccagcgtgatcaaggtcggcccgcagctgcatgcggatgtcgagggcctggcgctgtaccagagcgatcaacgtgactatctggtgatctccagccagggcaatgacagctacctggtggtggacgccgaaccgccgtttgccgtgcacggtgccctgcgcgttggcttgaatgccgccgccggtatcgatggtgcctccgaaaccgacggcctcgaggtcacggccgtcaacctcggcgggccatggagccagggcatgctggtggtgcaggacggacgcaagcgcatgcccgagcaaacccagaacttcaagttcgtgccctgggccgaggtggcccgcgccttgaagttgccttgagtctgtcatcaggcagtcattcattttcaatcgaataggagtttgaccatgcacgcgacgatggaacatatgacgatctgggggttgatcagcgacgccagcctgttggtcaaggcggtcatgctgaccttgctgttggcgtccttgctcagttggtacctgataatccagcgcggcagtgtgctgcgccgcctggaacggcagttgaacggtttcgtgcagcgttttcgtgccgcaccggatttgcaggcgctgtaccgcgacacgctgcaggcgggcgagggcggcatcgcgccgatctttatcgccggggtccaggaataccagcacctgcacaatcatgacccggctgtgctcgaaggcgtggagcgcgccttgcaggtagcgatcaccgagcaggaaatcgagctggaaaagggcctgcaatttctcgccactgtggggtcggtcagcccttacatcggcctgttcggcacggtgtggggcatcatgaattcctttatcggcctgtcccaggtgcaacaggccacgttgtccaccgtagcgccgggcatcgccgaagcgttgatcgccacggccatcggcctgtttgcggccatccccgcggtaatcgcctataaccgcttcgcggcccgcggccagacactgctcacccgctactacgcgtttggcaatgagctgcaagtgcgcctgcaccgctccctgagcggcacgtcgagcaacctggccgtggccgcctgaaaggagcaattcccatgttagtcaggccgcaacgcaagcacgggcccaaggccgaaatgaacgtggtgccgtatatcgacgtgatgttggtgctgctggtgatcttcatggtcaccgcgccgatgctgacccagggcgtgaagatcgaactgcccaaggtcgccgccgaggcgctggccaccgacacccgccagcagatcctcacgctgtcggtaaaggccgacggtggctactactggaacctcggcggcgaactcgatacccagcatcagaccgacagcgccgtaagcctcgacgaaatgggcgccaaggtcatgcaggtggtggcggcgcgcagtgacacccaggtgtatatccgcgctgacgacaacgccggttatggccgggtggtcgcggccatggcggtgttgcaaaagagcggtgtcagcaatctgggactggtaaccgaggccccgcaatgacggcgatgatcatgcatagtcccactccggcgatgacgcccagggatgcttcgggggtttggagaaacagcctcgctgccggcctggcggtggcgctgcatgtgggcgtgctggccgcgttgatgatgggctggtcgacgcaaaagccggtggtggatgcgcctcgggtgatgcacacgcagttggtcatgttgccagctgcgcccgcgcttgaaccgttggtggctacctccgcaccccctgagcctgagcctgtgccggtgccggcaaagcccagggtcgacccgcaggtgcaggtgcaaaaactcgagaaagccgccttggcgcgtaaacgtgtcgaggagaagaaagccgaacaacagcaggagcggctcgccaccgaacaacgcaaccgcgagctggaacaacaacgcctcgatcagcaacgcctggccgctgaaaaagcccgggctgccatacctgcgccagccttcgacagccgccaatatcaacccctgagcaaggcagcgccggactatcccgagcgcgccctggacaagaatattgaaggcgattgcaccttggagtacagcgtcaacattcagggtcgcgtggagaatcccaaggtactggacggctgccacccgctgtttatccggccatcattggcggcggcgaatacctttcgttaccagcccagagtcgtcgacggcaagcccgtggccgtgccggcagtgcgcaacaccttccactaccgcatcaaatgatctctcccagccaacacagaaataatgtgggagggggcttgctcccgatagcggtgggtcagtcatagatatagagactgacccaccgctatcgggagcaagccccctcccacattttgaactgcgtcaggcgttagctagattcgctagttcgatacctgaaatataccgctgcagattcgccaaaaacgcatcggcaatctcatgcttgctatgggtcgaaatcgccgacgtatgcggtgacaaccgcacccgtggatggctgtacaacgggtgcccatccggcaagggttccggctcggtcacgtcaagcgaggccaggccgacctggccgttatccagcgcctccagcaatgcctcctgatcgagcaaccctccacgcgcaatgttgatcaggtgcagcccaggcttggcgctggccagcacgtcacggttgatgatatggcgtgtggcttcggtcagcggtgccgccaccaccaggtggtcggcgcgggcgaacaggtcgtggatgtccgtggccgcttcaacaccggcactgaaggatgcctggctctgacgcagcgcgaccaccttgacgcccagggccagggccttttgcgccaggctttcaccaatcgcaccaaagccaagaatgcccagggtggtgcccttgagcgggcgcagagcagtgaaatgccactgcgcgtccttcacccagatatccggcaagtgcttggacgcggcaaagatcgcggctagggcgaactcggcgaggttgtcggcggcgctgccccgggacgtggtcacgggtgggccgttgaacagccactgtgggtaaaagtcgatacccgacgacaccaggtgcacccattgcgcgccatagggccagcccggcggcggtgtgtcgggcgcggtgtagccgcgtacgttgatcggacgcagcaacaggatattggcctggggcggcaggtcgctgggcacgccgaccggcaatccgaacacctgggcctcggggtgcagcggtgccaggcgctcacggatcacctggttgaagtcttcgtccaactgactggcaataatcacctggctcatgtgcgttccttctggcgttgggtgaacacggctttgccgacgccttgcaacaccgcgtcgttctgcggggtgtgtacgcggctgcacagcacgtcgcgataatgccgttgcagcgggctgtggcgtgacaggccggggttgccggaggcctcgatggccagttccacggcgcgaatggcgttatgggtgatcaggtacttcaactgtgcagcgttagcggccggggtatgcccctcggcggcggcgtcgagcaggctgcggttggcgaacagcagggtgtcgatatggccgacggtctcctggaaacgcggcaagctggacagcgccgcgccgaggttggatggcttgcgttcctccagccagttcaccagccagtcccgcgccgcctgggccacggcgtcgtaaaccgacgacagcagcaccgacatccacagcaagccgtcaccgtcgagctccgactgcggtgcgctccaggggctggtgctgacggcgtggtccagcggcaccagcacgttgtcgagtaccacctcatggctgcaggtggcgcgcatgcccaggtgatcccaggtgtcgatgatgctcacgccggggctgtccttgggcaccagccaggcgcctaccagcgggtcggcatcatcgctgcgcgcccacacgctgaaccagctcaagccatgactgccggtggagtagagcttgcgcccgctgatacgccagccgtcggcaccgcgcaccgcggtggtggccggtagaccaccacgggccggggtgcccaggtctggttcgacacgcagggcgttgatcagcgcgccgttgcgcactgcatcctcagcgactttgacgcgcaggtgtgcgggccaggcctggctgtcttgcaggcgactgtgttgcaggtactgcatcaccaggatcagcgccgtggacggttcgcccttggctatcgcgctgatggccttgcgcgcctgggccaggctggcaccgccgccgccgagagccttgggcacggtcagggcgagcaggccgtgctggtgcaagagcttgaagttggcgtgggggaaggcgccgctttcgtcatagacgtgggcggtgctggccagttcggcgctgaggcgttcgagcgtggtgtcgaaatcgacgacgtccacagcccgtagagacgagtgagtcatcagcaggtactcggtcaaagtgggaagggagagtgtccaggccagcgccttgagcggggctggcactacagctggggcccgcgcttggcgttgaagcttgggtcgaagccctgggagacgtcgatgtgcttgggtagcaggccttctttgacataggtgtcggcggtggcttgcaggccgcggaccacgctgtcgtcaattttgacgggtgacaggtgggtgtccttggccacttcgatgtgcacggccaatggcaagccagtgatcctggcctgggcggcggcatattcatcggggtgggtgttggcccaggcgtaggcgcggtcaacccgtgcgacaaagtcgtccagttgcacgcgtttgtcggcgatcgcctggccggtggcggcgaaatagaggtgattgctcaacaggttcttgccgctgaccagcacgcgggcgttgctctgtgaggtgaccacggtggtgtaggggtcccatgttgcccaggcatccgcagtgccgttgtccagcaccagccgtgactcggcgggcagcagaaaaatgaagtgcacatcctgggtgctcaggcctgcatcgttcagggctctgatggccaggtagtgcccgatggagccgcggccggtgacgattttcttacccttgagatccgccgcggtcttgatcggcgagtccttgggcaccagcagtgcagtggtgttacgcccttcggcatggatgatgctgatcactttgatcgatgcgcccgcgcccaaggcgaatacatagggagcatcgcccagggcgcctacatccacggcgccggcattcagcgcttcgcccaggggcgaggccgaggggaattccgaccacttgatttcatagggaacgttttggctttcgccagaagcgtccagcagtgccttgatcgtggacttctggttggctacgcgcagcggttgcaggtcggcggcctgggcggtggacaggccgagggccaatgcagcgcccagcagcaggcgtttgaatggggtggcgtacagcatggggcaaactccaggcgttggataaaaggagatacctccgcctggagaaggggtcggatgtccgtgggaacggtgcagcagtgactcagatcacatagaaaccatgggtgccgtcgcgggccagttgcgcgaccaggccgaactcccagtccaggtaagcctgcatggcttcccgagggttatcggtgccttcataggggcggcggtagcggtcgatacgcggcgaggccaggtgggtttcgccttcttccagaggcagttgcgcggcgatccagccggcggtgccgtcctgtagcaggaacacctgcttgccagtcagggcctcgacttcggccaccgccaggcgcgccaactggctgctgccgcaggtcaatacgtagcgttgcgcaggcggcacattggccagggcctggggcagttgcccgcgaaggatccaccaggccccgggaatatggcgtttgacatagttggcgctggcagtgaagtccagcaccagggtgtcgccatggcccagccagtcggcgagggtaggcgcgctgatcagttcggcctggggcggcgcagggaccggtgcgacccacgcgccacgttcgctgaaatgcgtcgcttgcaggtcatccagcacatgcacctgccagcccaactgggccagccaggaagcggacatattggcgcgcacgccgtcgtcgtccaccagcaccaggcgcgccccgcgtacgctggcaacgtgatcggtttcctgcaccaattggccgccgggcgtggagcgtgcgccgggcaaatggccgatttcgaattcttccggggtgcgcacatcgaacaggtaggtggtgcgcgtcgcatcctgctgccagcggtgaagatcgttaaggctggcgcgaccgacccgggccttgtcggcgacgcggcgcgcagcctcggcggcgcgctggcggtgttcctctggcgttggcgcgaagcggcgggcttggccgtgggccagtgtttgcccggccaatgtccagccgatcgtgccgttgcgcagggctgacacggggttgggaacgctggcattgatcagcgactgggtgccgataatgctgcgggtgcgcccggcgcagttgacgataatgcgcgtggccgggtcgggtgccagttcgcgggcgcgcagtaccagttcggcgcctggcacgctgatgccggtggggatgctcatggtctggtattcgtcgaaacgacgggcgtcgagcaccaccacatcggcctggctatcgagcagggcctggacgtcttcggcggccagggacggcgtatggcgctggctctcgaccagttcgccaaaggccttgctgggtacgttgacgtcgataaacagctcgccaccggcctggcgccaaccgtcgagcccgccttctagcaggctgacctgggtgtagcccagcgcaaccaggcgttcggcggcgcggctggccagcccttcaccgttgtcatacagggtgacctgggtgtcgcggcgtggaatgcgcgaatacacctccagttccagcttggacagcggaatattcgcggcgaacagcgggtgggcctcggcaaacggcgcttcctcgcgcacgtcgatcagcgcgacttcttcacggtccaacagggcctggcgaatctgcgcatagcggcgggtcgatacggtggtcatagggcagggctcttttctttggacaagtcccagatattcgggagataggcgttggaataaccagagataaacagtttttcgctaccgtcgggttgatacaccgcacggcgtaccgcaccgatattggcaccgtacacatggatgctgatggacacctggtcggcgtgggcattgctgacctgatgaatatcgccaatcctgggcgataccgcttcgacttgacccggcaatagctgggtcggtttgccttcagccatcaggctgccatcgggggcacgggcaaacccctgggaaaattccgagccgcgcaacatgccgatcagcccccatacccgatggtcatgaatcggtgtgcgttgccccggcccccacacgaagctgacaaggctgaaacgctggcgcgaatcggcatgcagcaaaaactgctggtagcgctcggggtcaggctgggcgaattcgtcagggagccagtcatcatggctgaccagttgcgccagcagcttgccgccacggtgcagcaggtcgccttcacgcgggttggcgtcgatcagttccgccagggcgcctatgaaggctctgagtctctcggggtgtcgggcctgggtcatgaccattccatcggctgggttgatggctttatataagcataatgtttatggttaatatgctattttttaatgattagcttatagccgaaggtaatttagatccggtttgaatagcgttagacgttatcgatcacagcgtggactatccagaccggttggcggcaactatgcttcacgcacatcttaatgactgatctctatgtgcggcccaaatgaaaattgacgatatcgatgcctttgtcgaagtgattcgttgccagtccatcagccatgccgccgagtcgttgcaactgacccagccggccattacccggcgtgtgcagaacttcgagcaggccctgggcgtggagctgttcgaccgcaacaccaagcccctcaagccgacgctgatcggcacgcgcgtctatgaacaatgccggctgatcctgcgcgagatggacgccctgcgcgaactggtagctaccgatgcgccgcccaccggcgtgttgcgcctgggtgtaccgcagaccatcggcgacgtggtgttgctggacgcgctcaagcacctgcgcactgaatacaccgacctgcgcgcccaggtcgccaccggctggggcagccaattggtcggcaagatcgaacgcggcgagctggatgcggcggtggcgttgttcccggcgggcaagatctttccggacaacatcgtcggtgagtccatcggcaagatggagctggtggtggtctgcgccaaggcgcagttgccgaaaaagccgtgcaagctggcggatgtgtaccagaacggctggatcctcaacccggacggctgcggcttccgagccggcttgcaacgcaccttgtctgaccagggcctggcgctgcgagtgaacctggaaaccttcggcaccgaactgcaattaggtttggtggccgacggcctcggccttggcctggtaccgcgcccgttattggagcgcagtgcccatcgcgagcagctggcagtgatgccgctcaaggacttcaagccggtgatggacctgtggctgatctacccgcacttccttggcaatctgcaggggccggtggatgcgtttggccagtgggtggcagactccctgcacaagatccgcaacgtcgcgtgatatgaaaaaaaataataattagcttagattaaaatgtgctttttattatttttttgcttcccctaggctggccttgagtccttaaggccatccaggaagttatgccatgagcagcgtcacctcgctttccagtgtttccaataccgtccgccagcgcgtcacgccagaggaatgggaggtgcgcgtcaaactggccgccgcctaccgcctggcggccttgtacaagtggactgaccatatctatacgcacttctcggcccgtgtaccggggcccgacgagcatttcctgatcaacgccttcgggttgttgttcgatgaaatcagcgcctccaacctggtcaaggtcgacctcgatggcaccatcgtcgacgaccccactggcctggggatcaactacgccggctacgtgatccacagcgccatccacggcgcgcgccatgacctgcaagcggtgctgcacacccatacccgcgatggtattgcggtgtcggcgcagaaggacggcttgctgccgatttcccagcactccattgcgttctccgggcgcgtggcctaccacggttatgagggtgtggccctggacctggatgagcgtgagcggctggtggcagacctgggcgacaagagcgtgatgattctgcgcaaccatggcttgttgacggcaggcgtcagcgtcgagcacgccttccagcaactgcaaagcctggagcgcgcctgcaacatacagatcgccgcgcaggcggcggggaatgccgagttgatcttcccgccggcagaggtggtggccaaggtcgaggagcaggccaaggtgttcagcaacgggcaagggcccggagtggcgcggcattggaatgcgctggtgcggcagttggagcggactgataccgactacaaaaactgatcctgagtgcgcagcaaatcaaatgtgggagggggcttgctccctcccacattgttcttaagccacttgctgggcctgctcccgctcggcaaccaactggcgggtgaggggaatcaacttcttgccatagtcaatcgcatcattgagcgggtcaaacccacgaatcaggaaggtggtaattcccaggtcgtagtaatccaacagcgcctctgcgacttgctcagcagtgcccaccaacgacgtggaattgccctgcgccccgagcaacccggcaatcccggtccacaaacgcttatccaaccgcgacccctgagccgccgccgccagcaaccgccgcgagccttcattcggcggctcgcggcgcacaaatccattcctctcggccagcgccgtggcctgctgcagaatctgctcggcacgttgccacgccagttcctcggtgtcggcgaggatcggccgcaacgacaggctgaagcgaatcgtacgcccatgcttggccgcttcggcgcgcacctgggtcaccacctcgcgtacctgctcataggtttcgccccacagcgcatacacatccgcatgcttgccggccacggcaatcgccgccgctgaagagccgccaaaatacagcgggatatgcggctgttgtggcgacttcaccgtggagtgcgcgccttgcacttggtagtaagtgccggtgaagtcgaagggctgctcgctggtccattcctggcgcaccacgctcaggtactcgtcggtgcgcgcatagcgttcatccttaccgatatggctgccatcggcacgcagttcgttgtcatcgccgccggtgatgatgtgcacggcggtacgcccaccgttgaacacatccagcgtggcgaactggcgtgcagccaatgtgggttgggcaaaacccgggcggtgggcgattaaaaactgcagcctggtggtgacgctggccgcatgggcggcgatcagcgtgctgtccgggctgttggagtggaaggctatcagggcgcggtcgaagcccgccgtttcatgggcgcgggcgacgctttcgacgtagtccggttgcagggtcgggccgctgcgcgggtggatttccgaggcgtggtggccgccgatatagccgatgaattcaatgctcatggtcaggtccttgtcgaggtcggtaaacaagcctccaccgggcagggggtcggtccgtagacgtgaaagtagggccagcggccgagcctgtaaaatgccgtttggttctaacctaattattaaaatataaaatgttgatatttattcaatatcagaaatttgcatttagtccgcgacctcgcgcatcgcgataccgggttgggcgtcctgactcgtcgcacccatgcggtccgccaggtagcgcgccggcggctggcccatcgccttgcgaaacatggtgataaaaccgctggcattttcgtaacccaggtccagggccacgctctgcacactttcgccgttggccaggcgttgcagcgagaggatcacgtgcagttggcggcgccagcggccgaaactcaaaccgatctgctccagcaacaggcgcgtcatgctgcgctcgctcatgcctatgcgcatggcccactcgcccaaggtggatttgtcgccggggttggccagtaagctattggccaatcgcatcaagcgtgggtcttggggcatcggcaaatgcaaggcctcgatgggggcctcggccagctcatccagcaaggtcgccaccagccggccctgggcaccgtcttcgtcgtagagcggggggaaactgaccgccttgccgatcaacgcgtgcagtaatggcgacaccgacagggtgcaacattggcggggcagggcgctggcagcgccgggatcgatcagcaggcaatacacatcggcttccccggccccccgcgccgcgtggatcacaccgccgggtatccacagtgcgcactgtggcggcacgatccagataccggcctcgatcacacaatgcaccacgccgcgcaaggtgtagatcagttgcccgtgctgatggtggtggggggtatgttcccagcgctcggaagtactggatgcgcccacggcaactatctggcgcgggatggcagcggcatcgcgtacccggctggggtcgtagtggtcgaggcggtgatgaaccatggtgctggctatcttggctggtttgcgaaacattctggctattatgtgcaatgccgtccagcaccttggcgcttatgatgagaaccaatctcatccaaggagctttgccatgcgactcgacagttcaacttttcctgtggtgaaaatcgttttcgacgcgccaaatcagggcggcccagaggatgcctttctgcttttcgaacgcctgctggcccgcaagcagcccttcgtgctactgcacgagaaagccgtggatgaaaacaatcacgcgcactcccatgaagaacgcaagcaggcctcgatctggatgaagacgcacaaggcggcgttacgcgcttacgtcagaggcatgatccaggtcgaacccagcgccgccaagcgcctggccctcaagccctttgccgtgacattcggcaaggcctggggctacccattgctggtggtggagtccaaggaccgcgcctgggcgctggcccgggatgtgctggatgagcaggtctcggatgtggcgcatttctaagcctggccaacgctcgacagcgcccacaattgaactaccttgattgacgagccttcccactcggtacttaagcatgcgcacgttatggacgcggtatctggcgttgctggacaacgacctgagcacacagatcttcgacaacgtaaagaatctgctggtgtgcgcgctgttgttcgcggcggggaccaatacgctggtggggcagcgtgagttgtttatcggggtgttcgcctccaacgtcgccggttggggactgattatcctgtcgacgctattgatgttgctgaacgtcagtgatggcattcgaaggctggccaagttgcgctatcacttggcgctgcaactgttgttgatcctgatgtacgtggtggttgccgagcgggtggtagagattgtgtggggcttccgcgcccattaacgtatcctgcgcgcctggctttttactgattcaaacaaagatgacaggacaagatatgcaggcgctgctcgagtcgatcctcgatgaagtgcgccccctgatcggcctcggcaaagtagccgactacattcccgcactggccgatgtgccggcccagcagctcggcatcgcggtatacggtaatgacggcgcagcttattgcgccggtgacgccgacaccctgttctcggtgcagagcatttccaaggtgttcagcctggtgcaggccatcgatcacggcggcgagagcatctgggagcgcctgggccacgaaccgtcgggccagccattcaactccatggtgcaactggagttcgaacgcggccgcccgcgcaacccgtttatcaatgccggcgccctggtgatctgcgacatcaaccaatcgcgctttgccgtgccgatcctgtcgatgcgtgactttgtgcggcgcctgtcgggcaacccgcagatcctggtcaacagcctggttgccgagtccgaagcccagcatggcgcacgtaatgcggccatggcctacctgatgaaatccttcggcaactttcacaacgatgtggacgcggtgctgcacagctacttcaactactgcgccttgcagatgagctgcctggacctggcccgggcgttcagtttcctggccaacgaaggcgtgagtgcccacagtggcgagcagattttgacagcgcgccagaccaagcaggtcaactcgatcatggccaccagcgggctgtatgacgaggctggcaattttgcctaccgcgtcgggctgccgggcaagagtggggtaggtggcgggatcgtcgcggtggtgccggggcagttcacggtgtgcgtgtggtcgccggagttgaacgcggcggggaactcgctggcggggatgaaggcgttggagttgttgagtgagcggattgggtggtcggtgttctgaacacatcaccaaagcaaaatgtgggagggggcttgctcccgatagcgtagtgtcagcaataaatgtagcgcctgacacactgcaatcgggggcaagccccctcccacatttggatctccaatggtttggaggtcttcatacggtcttgtctttacgcgacggggtgggtttcatccagcaccttgcctgccagtagctgcacgccttcgagcattcggcagatacccagcgctacattgcggttggcgccgtcgatttcgaaagcgaggtgggtggcgatgtcggtaatggatgccaggtcttgagaggcattgaccagcagggtttcagtgcccaggccatcgcgtacattgaaaagtcgattgtgggatagatcttcgttttcttcgggatggagctcagaattttgtcgagtagtgtcattgatcacgggcaaaccctctggttgaaaagcttccttgacagttcggacggtcaaacccggtcgctgaattggcagcgacggccagaggttagtcagcgaagttccgagcgacaacctgaaacagctgtgggaaacgtccgagccatacccccccgtaggagcgagcttgctcgcgaaaaacttactggccctacggtcatccaggttacccccgttatcgttgacgatcttcgcgagcaagctcgctcctacagtgggtaggcggcagtgggttagcgacggggcctgttgaggcgcggcacaaccatgcccacttcactctgatagcgccgataccgctcgccaaacagcatcaccaaatccctctcttcgaagcgggcgcctatgaacagataaaccgacatccccagcgcaaacaccagatgacccaccgtcatatgcggcgttgcccaaaacgcgatcaaaaaccccaggtacagcgggtgacgcacgattttgtagagcaacggggtcctgaatatcggtgcctgctgcggcgtgttgcgccaacgatcaatcgcctgcttcaacccgaacagttcgaagtggctgatcaagaaggttgccagcaagacgataccccagcccagccagaacaggccggtcaggagtgtcttggcccacacggcttcaacctcccagacgctgtcgggaatgggttgccacagccagaacatcaccccgagcaccaggctgctgagcagtacataggtggagcgttcagccggcgcgggaatgaatgtggccagccagcgcttgaaacctttgcggaccattaccgtgtgctgcacgccgaataaaatgatcagtgcgccgttgatcaagacggctgtgggccacgcaaccagtggcccatcgttgatgtttttaggcaccaccacactgccaacgaaaccgatcaaatataaacaggtaaacaaaaacgccaaataacagcaggtactgtacgccagcccgatgactcgggcggcgcgactgtctggattgttcataaacatgcccctttccatcggctcatcaccctgcaactcagccagctcatcctgaactccgatgcgtgagcctagcgggtattgctcgtgcggtaacctgtgaaaattgacagtgcttgaaatgtgatcaaccgatattgagccgatccaacaagctgtaccaagccaccccagcgccaatataaaaccgctgcaacccatgcaacggcaaccgctgcaacggcgtcaccgggtaggcaaactctgcatggctgtcgcacagccgcccggccagttgctggcccaggctggtacacagcgcgatcccacgcccattgcagcccagtgccaaggtcagccccggcgccggttcgtggacatggggcatgaagtcccgcgtgatcgcaatacgcccggcccagcggtagtcgaattccagcggtcccaattgcggaaacagcagcgccaatgagcgctccaagtgggcaaagtcggctggcccggtggggtcattgaacagcccgcggccacccatcagcagacgcccataggcgtctttacgaagatacagcagcaacctctgtgcggtagacacggtttcctggcccggcaagatgctctcggctgcgtgacctttcaatggcttggtggcgacgataaaactgttggccgccagcacactctgagccatgccgggccacaggttactgctgtagccattggtcgccagcaccacttgatcggccgtgacctgcgcgccacccgctgtttgcaactgccaagccgaaccctggtgctgcaaccctgtcaccgcgctgtggccatgcacccgcgcaccggccgccaatgctgctgcgaccaagccacgggcgtatgccaagggttggatcgcgccggcacgcccatccagccagccgccggcaaacgccgagctgcccatgcgcgccgccactgcacgggcatccagatgttgcaccggcacaccgcgccgagcccattggtccgcccgcgcatgcagcctggtcacgcctctttcgttgtaagacacctgcatccaacccttacgcaccggggcgcaatcgatgccatgtcgctcgatcagcttgaataccaggtctgccgagcccgacaccgtggagatcagcgtctcggcgcgctccggcccgtacatccttaccagttgctccgggtcatatttgagcgtggggttgacctgcccaccgttacgccccgatgcgccccagcctggctcatgggcttccagcacgcacacgtgcacgccacgctcggccaggtgcagcgctgtcgacaagccggtatagccagcgccgacaatcgccacatcgaccctcactgactcgttcaacgcgggcgtgggcactactgacggtgcagtcgccgaccacaacgacttcatgacaggctccgcgtgttgccggtggggtgcagcacgcgccgcaggaagtcctgggtgcgcgcatgctgtgggttgcccagcacctgctcggcggggccgctttcgacgatatagccgccatgcaggaagcacacacggtcggctacttcacgggcgaagcccatttcgtgggtgaccacgatcatggtcatgccttcatcggcgagcgtgcgcatcaccgccagcacatcgccgaccagctccgggtcgagggccgaggtgggttcgtcgaacaacatggcctcgggtttcatcgccagggcgcgggcgatggccacgcgttgctgttggccgccggagagttgttccgggtaggcgtcggccttggcgctcaggccgactttctccagcagcaccagggcttcctcgcgcacttgccgcggcggctcacctttgacgtacaccgggccttccatcacgttttccagcacggtgcggtgggggaacagattgaaacgctggaacaccatgcccatgcggctgcgcagggtgtgcacggtcttgctggcgcgctgcacagtttcaccgaacaccttgatatggccaccgtcgtaggcttccagtgcattgatgcagcgcagcagggtggatttgcccgagcccgaggggccgaccaggcacaccacttcgcccttggccacgtcgaggtcgacgccgtgcagcacgcggtggtcgccgtagtgtttttgcagctgacgaatctcgatcatgcttttttcctccggcccaggtactgctccatgcggcgcaggccatataccagcggcaagctcatcagcaggtagagcagggcgaccagggtgtagacggtcatgttctgaaaggtcgacgaggcgatcagctggccctggcgggtcatctccgccacggtgatggtggacaccagggacgagtccttgagcatcatcaccaaagtgttgccgtagggcggcagggcgatgcgaaatgcctggggcaggatcacccggcgcatcatcagcatcgggcgcatgcccagggcctcggcggcttcacgctggccctgttcgacggcaatgatgccggtgcggaagttctcggcctggtacgccgaataggcgatgcccatgccaattactccggcgtagaacgcggtgaggtggatgcccatgtccggcagcacgaagtagatgtagaacagctgcacgatgatcggcaggccacggatcacattgatgatggtactggccgtccacgacaacgcacggatcggcgacagcttgagcaacgccagcaccaggccgatggcgctgctgagcaggaacgacaacaccgtgatctggattgtcacccaggcgccttgcagcaggatcggcaggaagtcctgggcgttttgcaggaactcagccaggttcatgggcgcgcctgggtatccagcccccatttcttgagaatactgtccaggatgccatcggccttgatgctggcgatggctttgttcaggcgctccagggttgcgacatcgcccttgcgcaccaccagacaaacttcgccgacattggtgggctggtagtcagacgccagtttcacgcctttgaacagcttctggcggatctggtaagccaccaccggctggtcgccgacggcggccttgatgcggcccagggacaggtcgcggaccatctcgccgatggagtcgtaggtgcggacttccttgaaaatgcccagcttgttcaattggtcgtagaagatcgtcccggcttgcacgccgaccacctggtctttcagcggggtgaggtcgggatatgcgccattgtcgtcggcgctgacgatcaggccttcaccgtaggcatacaccggtgcgctgaagtcgaccaccttggtgcgttcttcggtcttgagcatgccggcggaaataaagtccagtttgccggaagtcagcgaagggatcagcgcggcaaagttggtctgctcgatctggctgctgaacccaccggccttgcccacggcttcggccacgtcgaccatcacaccctgaatgctattgctcttgatatcgaggaaggtaaacggcgaaccactggccgttgccccgactttgtacgaggacgcactctctgcgtgcgcaacgctgatacaaagcgcggcacacacaccgaaggcaaggcggcgaaacaagggcgaaagactgttcatcgggttgctccataagaaaaacagaagtcagttgcgcaagcgactgctgataaaaccgcaagctctatgccattttgaatcagaaaaatcgtaaatgacctaataaagtttgagaaatgaacttatcgtatcgatatgcgatattttgtggtcattttacagcttttaaggtagaaatatcgccacgcctgattgaccagcccgcgagttcgccatgcccgaagaccgcaacagtttgcacaaccaatccctggaaaaaggcctgtcggtgctcaaggcattcagcgcccagcgccgcagcatgagccttgcagaggtggccgaggcagctggcatgaccaaaagctcggcccagcgcatggtgtttaccctcgaaagcctgggttaccttcggaaacactcgcgcacacggcattaccaactcacacctcgagtgctggagctggggttcagttacctggatgcgcattcgctgattgaagtggccaacccgttcttgtccgagttgacgcggttgaccggtgagacgtcgtgcctgaccgagccggcgggccatgacatgacttatattgcgcggtttgtcagcgccgggtttgtgccggtgcacatgccgatcggctcgcgggtgccgatgtactgcaccgcgtcggggcgggcgtatttgagcgccttgccgcaggatgaagcgctggcacttatccagaacagtcagcgagtggcgcataccagccataccgtgacagacgtcgaccaaattctggagtcgttgcagcaagtacgtgagcaggggtatgcggtaaatggccaggaactgttcctgggcgacatgaccatcggcgcgcctgtgctgggcgccaacggtcgaccggtagcggcggtgcatgtggtggcgcccactagtcgctggagccaggcggcggctgaaaagcagcttgcaccggcgttgttgcaatgctcaagagcgctgagcaactcggcgcgtaacctggaataacaggcaaagcagatcaaaatgtgggagggggcttgctcccgatagcggtgagtcagtaaagaataggctggctgacacacagccatcgggggcgagccccctcccacatttggctctccagcgttctgggaatatctagaatacccaaacaaaaaatgcgcccggttgggcgcatttttttgtgtagtcagctatcgcctatcaggcaatcgcatcccaagcgcgatcaccgttctcgtccttgatccgggtcggcaggcccatcacatccagcgctttcaggaacggctcagccggcagttcctcaacgttggccatgtgcttcacatcccactcgccacgcgcaaccagcagcgcagcagcgaccggtggaacgcctgcggtgtaggagatgccctggctgtcggtctcggcatacgcctcttcgtgatcagccacgttgtagatgaaaatttcccgcgacaggccatccttggtgcctttgaccaggtcgccgatgcaggtcttgccggtgtagcccggggcaagcgaagacgggtcaggcagcacggccttgaccactttcaacggcaccacttccaggccttcggcggtcttgactggcttctcggagagcaggccgaggtttttcagtacggtgaacacgttgatgtagtgttcgccgaagctcatccagaaacgcacgttgggcacgtcgaggtttttcgacagcgagtgcacttcatcgtggccggtgaggtagaggttctgcgagccaactaccggcaggtcgtcggtgcgtttgacttcgaacatggtgttgctggtccactggctgttctgccagctccacacctgcccggtgaattcgcggaagttgatttccggatcgaaattggtggcgaagtatttgccatgggagccggcattgacgtcgagaatgtcgatcgaatcaatgcggtcgaaatgctgttgctgcgccagcgcggcgtacgcgttgacgacacctgggtcgaagcccacgccaaggatggcggtgatgttcttctgtttgcattcttccaggtgattccattcgtagttgccgtaccacggcggggtctcgcagaccttgcccggctcttcgtggatggcggtgtcgaggtaggccacgccggtatcgatgcaggcgcgcagtaccgacatgttaaggaacgcggaaccgacgttgataacgatctgtgactcagtttcgcggatcaaggctttggtcgcttccacgtccagggcgttcagcgcaaaggcttggatatcggcgggtaccttgaggctacccttggccttgacgctgtcgatgatggcctggcatttggagatgttgcgcgacgcgatagcaatacgaccgagttcgtcgttgtgctgcgcgcacttgtgggccaccaccttggcgacacctcctgcaccaatgataagaacgttctttttcaattgctttatttctcctatatccgccagcttaggaaaggctggacaggtagtcgtcgtaaccaaattcacgaaccacctcgactgtaccgtcgagttgtttcactacgatggacggcattttcaggccgttgaaccaatttttcttgaccatggtgtagcccgcggtgtcgatgaatgacagccgatcgccgatggccagcggacgatcgaattgatactcgccgaagatgtccccggccaggcaggatttgccgcacaccatgtaggtgtgttcaccctcgcttggcgccagcttggcattgaggcgatagatcagcagatccagcaggtgggcttcgatggagctgtcgaccacggcaaggtgcttgccgttgtagagagtgtcgagcacggtgacttccagggaggcgctgttggtgatcgcagcttcccccggttccaggtacacctgcacgccatacttctcggagaacgccttcaagcgcgcgcagaacgcgtccagcgcgtagccttcaccggtaaagtggatgccgccgccgaggctgacccacttgaccttgtgcagcagctcaccgaaacgttcctcgatggtgccaagcattttgtcgaacaggctgaagtcgccgttctcgcagttgttgtggaacatgaagccagagatctgctcgatcacgccgtcgatcttcaccgggtcccattcgcccaggcggctgaacgggcgcgccgggtcggccagcaggtagtcggagctgctcacctgcgggttcacgcgcaggcctcgggtcttgccctcggaacgctcggcaaaccgctgcagttggctgatggagttgaagatgatcttgtcgcagttctccagcatctcttcgatttcatcatcggcccaggccacactgtaggcgtgcgcttcaccttcgaacttctggcggccgagcttcaactcgtacagcgacgacgaggtggtgccgtccatgtattgctgcatcaggtcgaacaccgaccaggtggcaaagcacttgagtgccagcagagccttggcgccggactgctcgcgcacgtaggcaatcttctgcatgttgaccagaagcttctgtttatcgatgaggtaatacggcgttttgatcatttttgagagcctgcggcggtgcctgccaaaaaaggacacgcattgtgcccgcacttggaacagatcgaaaggttagcgggcggattttgcgcgccgtgttcaagcatagggcctgagtgtgaccgttcgttgggaggagggcggtactacccatcaagttaacgttcgcgtatcgaagcatgaacatgagcagatcttgtgatgatctatagaataatgagtttgtctcattatcaccctctgccgacaatggctgccatcaataacgacattggagctttaggtcatggcagtcgctcattccctcggatttccgcgcattggacgcgaccgtgaactgaaaaaagcgcaggaagcgttctggaaaggcgagctcgacgaggccggcctgcgtgccgtgggccgtgacttgcgcaagacccattgggagctgcaaaaacaggcaggcatcgaattgctgcccgccggtgatttcgcctggtacgaccaggtgctgacccactcgctgatgttcggcgtgatccccgagcgcttccgcccggccgatggccaggccaccttgcatacccttttcgccatggcccgtggggtcagtgacagctgctgcggcggtgcccacgcccaggagatgaccaagtggttcgacaccaactatcactacctggtgccagagttcagcgccgaccagcagttccacctgggttgggaccagttgttcgaagaggtcaagcaagcccgtgacctcggccacaccgtcaagccagtcgtactcggcccgctgacctacctgtggctgggcaaagccaagggtggcgatttcgacaagcttgacctgctcgagcgcctgctgccgctgtacggccagatcttccagcgcctggcggacctgggcgtggagtgggtgcagatcgacgagccgatcctggtgctcgatttaccccaggaatggaagaacgcgtttgagcgtgcctacaacctgatccagcgtgacccgctgaaaaaactggtggcgacctacttcggtggcctggaagagaacctcggtttggccgccaacctgccagtggacggcctgcacatcgacctggtgcgagcgccggaccagtacccgactatcctcgaccgcctgccggcttataaagtgttgtccctgggcgtagtcaatggccgcaacgtttggcgctgcgacctggaaaaagccttggccaccttgcagcatgcccacgagaaattgggtgatcgcctgtgggttgcgccgtcctgttcgctgctgcacagccctgtagaccttggccgtgaggaccagctggatgccgagctgaaaagctggctggcctttgctgttcagaagtgcgaagaggtggcggtgctggcccaggctgttgaccagcccgaagcccccaacgtacttgtcgccctggccgaaagccgagccgtacaggttgcccgcgctgcttcgccacggatccataagcctgccgttcaagcccgtgtcgccgccatcaccgcccaagacagcaagcgtcagtcgccgtttgcccaacgcattgcgaaacagcgggccggcctggacctgccgctgttcccaaccaccaccatcggttcattcccgcaaactgcgtcgatccgcctggcacgccagtcttacaaggccggcaagttgagcgaagccgaatacatcgaggccatgcacagtgagatcaagcacgccgtcgaggttcaggaaaacctcgggctggacgtgctggtgcacggtgaagccgagcgtaacgacatggtcgagtacttcgccgaacaactggatggctacgcgttcacccgtttcggctgggtgcagagctatggttcgcgctgtgtgaaaccggcggtaattgtgggtgatctgagccgcccgaaggccatgacggtggagtggatccgctacgcccagggcctgaccggcaaagtgatgaagggcatgctgactggcccggtgacgatgctgatgtggtcgttcccaagggaagacgtgagccgcgaagtgcaggcccggcaactggccctggcgattcgtgacgaagtgctggacttggaagcggccgggatcaagctcgtgcagatcgatgaggccgcgttccgtgaaggcttgccgttgcgccaggcgcagtggcagcactaccttgactgggccaccgaggtgttccgcctgtgcgcctgtggtgtgcgagacgaaacccaaatccacacccacatgtgctacagcgagttcaatgatgtaatcgagtccatcgcggcaatggacgccgacgtgattaccatcgaaacctcgcgttcggacatggagctgcttgacgcattcgaagccttcgcttacccgaatgaaatcgggccgggggtgtatgacattcactcgccacgggtgccggatgcgtcggagatggccaacttattgcgcaaggccgccaagcggattccggcagagcgcttgtgggttaaccccgattgcgggttgaagacgcggggttggccggagacggaggcggcgctcattcacatggtcaccgccgcccgccaactgcgcgccgaattggcctgacacagtctaaaaaatgtgggagtccccaccacattttcgatgtgacgctgtcgcgcagcaaactgtttggtaagaggggttgcttgccatagcggtgggaggggggctaacagccgaccaggatgttggggttttgaccgagtacatatccgttgctgcggtaacggccacttagggttccgctcttacagcgggtcacttttggaaggacccaaaagtaaccaaaaggtcctcgccccaccactcggtgcctcgcctaggctcggcatgcccgaacgcaggcttgaatccgtgggccgccgcaatgggccatccatggcccagtgcggctaacccggcgtcctgccgggttacccacggattcaagcctgcgttcggccagcgtggtttaacggggcgcctgagatcaaaagcaagatcaagagccactcgcttcgcatcgtagatacgctggcggcgcttctgcttttctgtaggagcgagcttgctcgcgaaaaacctgagtgcgccgcgctcatcctgagttcccgcgtcatcgttaacgaccttcgcgggcaagctcccacaggggtacgcgcaagcttcaacgatcaggtcggctataaggccgcctcgctgtgtttttgatcttaggcgccccgttaaaccacgctggccggaattcgacagggatttggggggtaaaccggcagggatgccggtttagcggccccgcgccatggatggcgcgtggcggcggccccccaaatccatgtcggattacgggcacaccgagcctaggcgaggtgccgagtggtggggcaagagccttttggttacttttgggctctttcaaaagtgacccgctgtaagagcggaaccaatagccgccgttacctaaataacggatatgtacccggtccaacaaccaaccactcgttcacatcgccgacgtgacgctgtcgcgcagcaaactgggccgcctccaaaatatctggtttagagactaaattttaactctgtaaaatcagtagcttatttgatgtttgataagagggggcttgcccccgatggcggagtttcagtaccaaatccattggctgaaccaccgctatcgggggcaagccccctcccacatttggagtagcgatagtcagagatatttgagccaggcgatgtcgcgccgacgcgctttgagcccggcaaaccagcgcacgggcgggtacaacgccagcggcagcaacagcgcggccagccacaccgtgccgatgctgtcgaagccgaaataattgccgtggttgagcccaagcaacgcggcacaggccacatacagtattttcagcacatacaggtgcaacaggtagaagaacatcggcgcggcgccaaacacggccagtacaccgatccagcgtttatgtccggcacgttcgaacgccagcaacaccaacaaaccgatgcccagcgtcagtgccaggaacaacagcgaaggcgggtacttggtgatgttgaagaaactcatcagtgtctgcacgccgctgtcatacgcctgccaaggcttgtcgccgtacccgttgagcattcgcaacagcacaaaccccaccagcgcgccgattcccgccgtcagcaaataacgctggcgcctggccggcggtgtgacattggcaaaccaggggccgacgccgtagcccagggcaatcacgccgatccacggcaacactgggtaggtcacgcgcagccgcaggttttcagacacctggatccaactgcgttcatgcaggatcgaccacagcgcctgcgacgtcgatcccggggccaagtgcactgcatcgagcaagttatgcccggcaatgatcaccagggccaagctgatcagcaacgcacgcggcaaccacaccagggcggcgagtgcgatcatgctcacgccgattgcccagatcacctgcatatagatcaccgtgggcggcaactggaaggtccaggcgaagttgaccagggtgaactccagcaccaccaaaaacagcccgcgcttgaacagaaacgccgacacgtcgcgccggccctggtatttctggccatacatccaagccgacaagccggtgagcagcacaaacaccggcgcgcatagatgggccagggtgcggctgacaaacagcgcaggctcggtgctgtcgatgctcatcgggtcgctgacctggcgatgcaacaggaaggtttcgcgcacatggtccagtagcatgaacaggatcaccaggccgcgcagggcgtcgatggactgcaggcgttggcgtaaggtagtagcgtcagtcataagtgggaatcacaagcgggcaaataatttacgttatcctataacatttgaggcgcatgatgatcagcataaagacgcaatcagccgaggccgtgatcgaattctggaaacaggcggggcccaagcgttggttcgccaaggacgatggcttcgacacaacctttcgcgacaccttctataccacccatatgcaggccgcacggcgcgaactggaagattggctgacctgcgccgacggtgcgctcgcgttattgatcctgctggaccagtacccgcgtaacgcctttcgcggcaccgcgcatatgttcgccaccgacccgctggcacgcctgtatgcacatcagatggtggacgccgggctggatcaacagatcgaaccccagttgcgtgcgttctgttatttgccgtttgaacactcggaagatccgcaggaccagcaacgctcgctgacgctcaaccagcagttggatgccaatacctaccactgggccaaggaacacgccgttatcattgagcggttcgggcgctttcctcatcgtaatgcgatgttgggcagggctacgacaccagcggaacaggtttttttgggtgagggtgggtttgcggggtaaggcgtaggagggggcgtgctgagcgccttcagctgatccaacagtgcggtgcgtcggttagcttggaggagaccttaatcacttgaagaattcgcctacaaagttttaggttaaatcccatacttcgcgtgcttgtaaaggtttcttgcgtgctcaaacatcattatcaggacaactgacctgggacgcatgacttgcagccaaatgtgcggatactgattttagcttgcagtaccaccgtaatggcccagctaggcgtgacactttatctgcctgccacgccttacatcgttaatgcgctcggtatgagtgcggctgaaggctacaacgctttgctgatgtatttaagcggtgccgcagtcccattgactttcaccgcttaccttattcggttatttggtcgttcggcagttctgtgggtgttctgctgcatgttcttttgtggaagttttttatccgtgtgggcttatgacgataaaagcttttatttttccaggctgctgcaaggcttgggcggcggcggggcggcgttgctgggacgcgcgttgttatcgcaggttttctcgggagctcacttggcgaggaatttatcccttttatcctattcatttgtttttgcgttggtggcgggacaagtcgcaagcggttttttagtttctttttatcgctgggaagtggtggcagtggtcatggcttgcggctcaatcatctccgctatcctggtactgcctgtaagagagattctgtctgctctggatatcgatagtcagcagcgagtcagacgtccaagatatgcagctatggtcagtcatcccagcttttatttgccggtcatactaggcgggtgtggttatggggtgtttgttgtgtaccaaggtgtaggtgtctacgtctttgacgcgctattggagtgggatagcgcgcaatacgggatgtttggggtatggctggggcttgcctatttcgccggggcgctgtctgtaaggtatgcattgaggtcggttagcatatctgcactttcaattatggccggcggtgtgctgctttttgcggtgtggatatttttgttaacaaccttaaagcacttggatcgcaactttgtgttcttggcatatctagcagtctggtatgcccaggcaatgatctacccctgtgtcgcgtccatggcggtaaaaaaatacccaggtattgaggcaatgatgctgtttagtttcttgcaacagctagttgctctgttattcggagcattagcctcactgctcatcgccgttggaatgcatggcgtggcattactaacccttggtttaggcgccttgggagcgctggtgacagttttactgtcaaataacagtagcagctaggcatcggggcggcttttgtattcccaccaggaatgcccccataaaaacccggcattgtccttatcgacccgaatctcgtagcttagaggctcatccaccggagatagcccatgagccaactgcgcctctacgttgattcgctgttcaccagcccctacgccatgtcggtgttcgtcgcgctgcgggaaaaaggtttggcgttcgagacggttcctctggatctggatgctggacaaaaccagtcggcagattacgcccaacgctccctgacccaacgggtacccactctggaacacggtaatttcacgctgtcggaatcttcggcaatcactgagtacctggaccaggcgtaccctcagatctgcgtttacccaactgatctgcagcagcgagcgagggcgcggcaggttcaggcgtggctgcgcagcgatttgctgccgattcgccaggaacgttcgacgctggtggtgttctacgggcagaagatgccgcctttatcgccggtggctcaggccgctgcgggcaagctgatcactgctgctcaggcacttctggcaggcaaccctaagtatttgtttggcgaatggtcgattgccgatgtggacctggcggtgatgcttaatcgcctggtcctcaacggcgacgctgtaccgaccgagctggtggtgtacgcgcagcgccagtggcaacggccgtcagtgcaggagtgggtcaacctgcaacggccggtgctctagctgccactcttcctcgacacgtcggtcgagctcctcccagtgggccatgcccagcacccgtgtggtgttcaagccccgcaggtagccgcgtagttgttgggcgctagccgagcgttgttcagcatcggcgcttgggtccagcagcacgttttcataatcgaccaggtaatcggcgacccgctcgcgaaactccggcagtacggcttcgcggatgcggtcgaaggttttctggtagggcttcatggcggggtccttatagattttatcggctgcctgacactatcggttcaaatgatagtcaccatcaaggatcacaagttctgttttttcgccaatcgcgcagaatctgcacatcgaaacgcggctcaaggaaatgcgcgatgaggacaattatccagtttgcactaatggccctgatgctgggcacggcggccatgaccaccccggcgattgccgatgaactgcgtacaggccatttgctgccacttgccgctggcgtagactccctgcagcgcgcccagtcggtgggagtgttgttcagcgaaaacactcgcgagaacctcaattaccttgagcgctaccacgccatggcgctgaacggcgccaaggacgcgttggatgggcggattcgcgaggcgttcgtcaacagctccgatccggaactggccatcgactggttgatgaattcgctacagggcacttttgtctcggtgacggtctacagcagcctggatgccctggtgcgggcacatccggacgtggtggtggtgctcgatgcccataaccaattgctgacccagcgtaacgaccgggtcgaggcgcgctttgccgcacgcttctatgacgcgaacctgcagtacatcgccaaggctgagggctcggtgggcaagcaagtaccgtcggtgtgggtgcacgacaaggcggcgcctgagatcgccgcgctgatcgagcaacaacgcgatgtccagcaagacgccctgaagcagttcgatgtgtcgctcaaggccctggttcgcgcaggttgacccgcgaatggatgtaaaccctattggttattttcaggaatctgtatgcgctctttttttgccccggccctggccttcgctgctttgtcgctgaccggatgtatcactgccccgaatgctccctcactgaccctgcaaaccgccaagacccctgaaggctatgtgcagtgcgtattgcccaagctggaaaaacacggcattacctcgaccgtgacgcagaactcccgccacgccaaggtgttattgaccagcaagattgctgccgatgatgtgctggaggcctacaagtcccaggacggcaccaaggtgttcctgtatgagcgcaaaccgctggcctcggcgatcaagccgtcgcggcttgagcaggcggcccaggactgcaagtaagcccccacattggaccagcattcggctcagggtttggcttcgttactgaaactatcgaccgttctgatcaacccctgcgccgccaacgctaccagctcgccgcctttctccaccgttgccagcgccgggtccgagcccatgcgcccatcggggaagcgtgcgcggaagtccagggcttcgcggatcgggccggtgttggcaatttgcggcgagtactcggccgacttgatcgactgcgggtacgcccactgtgtcaccgcaatctccgacggcgtggcgtggctgccgtggccgaccgggaattggcggtgggccaggtccgttacgccttccaggtcccaccaattgaccagcttcagtgcgaacccagccgggcggcgggcgaagctggcttcggcgtacagctcggaaaacgctgcttcgattgtggcgatattgccgccgtggccgttcaaaaacaggatcttctcgaaaccatgcccggccagcgagcgcacccagtcgccaatcgcggcgataaaggtggaagggcgcagggagatggtgccggggaagcccaggtgatgttgggccatgccgatattgaaggtcgggccgatgaggatgtcggcatttttttgcgcctcgtgggcgatgatctccgggcacatccagtcagtgcccagcaggccggtggggccgtgttgttcgttggagccgatgggaatcaccaccgtgcgactgcgttccagaaactgcccgatttcgatccaggtggaggtgtgtagaagcatgcgacgctctcttttatctgtggggacaggctatccgccacggattgtacgactactcgccacctgttggggtttgcaattgaggtaggtcgaggacttcaaccagcgctggtccgggtaccaggagaacatgaactgcccacccttgagcttgtccactacctggcgcgccacctgtgggcgcaccgccgggcaaccctggctgcggccgatgcggccctcgcgcttgctccacaaggggctgacgtagtcggcggcatggatcacgatggcacggtcgcgcgccaggtcattgaagccgggttccaggccatccatgcgcagcgagtagccgtgggtgccgaggtagctttcctgggtgcggaacaagccgaggctggactggtggctgccctcgaggttggagaactgggtggcgaagttttccccggacttggctccatgggccaccaggtcacgcagcaccagggtctgtttgcgcaaatcgaagatccaaagccgacgagcggtcgagggctgggagtagtcaataaccgctaggcgatcggaacgttcctcgccgttattgaccgcgcactgcaccgcgctcaaggcgcttttcagcacggcgggattgagttctggagccgagcgcgccaggctgctatacaaggaaggaggggggccattggcggcgagcgcaacattgctcagtaaagccaggctcccggtcatcaagcccacggtggttattccgaggcggcgcataaaagtcagcatctacagtcgatccccaggctgtggagtggagctcagtcaattgttcaaaaaacacgcatgttacttgagcatttgcctgctcgttgcaccattggtcgccatggccgatgcaccgccgctggagccgttgccggtgaccacgccggcgccggtcgacctggcgcccgtgcaacaggctttggcgcaattgcccagcgtctgcccccagttagccccgcggatcgacgccaccgcgttggtgcgcctgcaagccttttaccaacagcagggcaatgcgtcgctgtggtcggccgacgagccccgcaaagccttgcaaacccagctgctgatgctcgctgacgacggcctggatcccacccactatagcttgcccacggtggatgccacggctaacgtgctgtgcagcgatatcgcgactagccagcagtacctgcaggccctgcacgatttgcattacgggcgcctgctgcaatcgcgctatgaaccgctgtggcattctcaaccgcccacaacagacccgaacactccagtattggcatttgccgctaccggcttgcaggacatggtcaaggcgttcgaccaggcgcgccccagtgcggatttgtatcgcagcctgcgcaacgcctattccaacgtgcgccaacagcctttaccgcactgggacgcggtgggcagtggcccgttattacgccccggcatggaagatccgcgcgtgccggaactggcgcggcgcctgcacagtggcggttacctggccaagttgcccggcggcaatggcaagcaataccagggcgaattggtcaaggcggtgaaggcgttccagctcagccactccttgcaagccgacggagtgatcggtgcgggcaccgtggccgagctcaatatcagcccggccatgcgccgcgagcaactgcgcatcaacctggagcgtttccgctggctggcccaggacctggaacccgaaggcgtcgtggtcaatgtggcggccgcgcaactgagcgtataccagagcggcatcccggtgtggcaaacccgcctgcaggtcgggcgcgccgaacgccagacgccgttgctcaagtcgcgcatcacacggttgaccctcaaccccacctggaccatcccgccgaccatcatgcgcgaggacaagctcccggccatccgtctcaaccctgaatacctgcgccagcaaaacctgcaggtgctcgacgccgaaggccacccgctggcgcccgagcaggttgactgggcgcgcccaggcaacatcttgctgcgccagcaggccggcccgcgtaacccgttgggcaagatcgtgatgcgtttccccaacccgtattctgtgtacctgcacgacacccccagccagccgctgtttaccaaggggccgcgggcgttcagttccggctgtgtgcgggtcgagcagccgctgctgttgcgcgacctgctggtgaccccggcagaacgcacccgcactgatgaattgctggccactggcgtcacccatgaattcaggctggcaacgccagtgccggtgttgttggggtattggaccgtggaggtggatcgccaggggagcctggtctacgcgccggatatctatgcatttgatccggtgttgatcaaggccatggggagtctgctgtagcgctcaatgcctcggtccccctcccacatttggttctctgtgccccgacgatctagtcaggtatcaactgctggcgacactccagcaccagccgggcgccgcccagttcgctggtgccgacgtcgagcttgaagccgtgcaagttgatgatcgccgccacaatcgacaaccccaagccaaaaccgccgtgctgatcgctttcatccacccgataaaagcgctggaataccgaagcgcgctcggccgccggaatccccggccctgagtcaagcacttcgatacgggtgctgcccatatcattgaccgcccgcaggatcaccttgccattgggcggggtgaacttgatcgagttgctcaacaggttggccaaggcttcaaacaacagcgcgcggtcgcctgtcacccatggcagtgattcgggtgcctgtaataccaactccatttcaccctcttcggccaggggcagatagaagtcgtgcaattcgcgcagcagcggcagtgggtccagcactaggaagccagaccgacgctgatggtcttccagttcggaaatacgtagcagcccgcgaaagcgcgccatcagcgtgtcggtttctgcaatggcgtcatcgagtttcactgcgtgggcggagtcttcctcggcttgctgcttgatgcggtaaagctgtgcgcgcaggcgtgtgagtggggtacgcaggtcgtgggcgatggcgtcgcacacacccttgacctcgttcatcagtttctcgatgcggtcgagcatggcgttgacgatggcggcgagcatgtccaactcgtcacggcggttggacagcggcaagcggtgcgtcaggtcaccggcgacgatggcttcggcgctggcctggatcccgcgaatccgccgcagcgggcgacggcgcagcaggtgccagccggcagcgccagggatgatggtcaacgatagggcccacagcaaggcgtgccagatgatccgggtcacgccgaacagcgaaccgttggcgcgcaccagcaccagccagcgcccgtcgccggtgcgggtagccacggcgtcgcagctgtccttgggcagtttcgggtcgtcggattcgacgcaattggccagcgcgtggatcttgccatccaaaggcaggtcggccggcaccgtacggatcggcccgctcagggggcgaaattgctcatcgaacagaccataggcgtccacgcccttcatgtcgaaggtcatgctggtggtcaaggcctccaccagttcttcgccgtcgaagcgctggaacaaatgctggcgctgcagcagggagtggcgcgacaaatcgcccaggtaacctgatacctcgtagtacagcacccccatgaggatgcagctccaggccacgaacaacgaactgtacagcgccaacaagcggctgctggaagaacgccagcctttagaggggttcagcaatgacataaccggaacctcgtaccgtgcggatcaacggcgtaaggcccggtgggtcgatctttttgcgcaggcgaccgatgtgcacatcgatcaggttggtgccggggtcgaagtgataaccccagacttcttcgaagatcatcatccgcgagagaatctgcccggtgttgcgcatcaggaattccagcagtttgtattcggtaggcaacagggtcagcggttgctcggcacggctggcttcgcggctgatcaggttcagttccaggtcggccacgcgcagggcggtctcgaactccttgaccgtgcttttgcgccgcagcagcacttcgacgcgggcggccatttcgtcggaggcgaacggcttggtcaggtagtcatcgcccccggcacgcaggccgcgtacgcgctcgtcgacatcagagagcgcgctgatcatcaagatcggcgtcgacaccccgatggtgcgcaaggtggtgacgatggccaggccatccagttcgggcaacatgcggtcgagggtgatcaggtcgtaatcaccactgacggcacggaccaggccttcgcggccgttgtccacccaatctacttccagtccatggctactcagctcggcgacgatctcgcgggccgttacggcgtcatcctcgatggtcaaaatgcgggtcataggattacctggtgagcgttcacactagaagtgcgggtattttgccaagaagttgctgaatgtttcctaaataaaacttcatctaggcagagccgtcacctgttcgtgactggcacggatccaatgtgggagggggcttgctcccgatagcggtctgtcaggacaagttttatagcctggtacaccgctatcgggagcaaaccccctcccacagggaatgcataacgcccgcctacagcagacagttcttgcaacttgcatggtttggataagttcaatcttcctaagcttttgaaatttaaagaatttaattttatacgcgactggcatggtgcctgcactgtcccttttgagacttgtaacactatttttcatgcctggagcaaaacaacaatgatcacatcctcatccacgctgcaagagtcaagcacgctctccggggtttcctggggggcgatcttcgccggggccgctgcggcggctgccttgtcattaattctggtgctgctgggcttcggcctcggcttttcggcggtctcgccgtgggccgacagtggcatcagtgccaagggcctgggcatttccacgattgtctggctggcctttacccagattgttgcgtcgggcctgggcggctacatcgccggtcggttgcgggtaaagtgggccaatatgcatggcgatgaggtgtactttcgcgacaccgcccatggcttcctggcctgggcagtggcgacactgatcaccgcgatgttggtggtcggttccgtcagcagcgtcgtcagcggcggcgtgcaagccggtgccagtgtcgcgtctggcgccgccagtggcatgacccaagcggccggcaacgcagcacagggtgccgatagtggtgacttcggctactacgtcgacagcctgttccgcgatgaccgcccagccgcagtcagcgatgacgccgcacacgccgtggtcggtcgcattttcgcccgcaccctgagcaatgacggccaacttgctgctgaagaccgtgcctacctggcccaactgatcagccagcgcaccaacctcagccaggccgatgctgaagcgcgtatcgacaaagtctacggcgatgcccgcaaagccatcgaagatgccaaggtaaaagccaagcaagccgccgacaccgccgcgaaagttgccgcctatacctcgctgtggaccttcgtggcgctgttgatcggtgcattcttcgccagtttcgccgctacctttggcggtcgccgccgggatgccgtggtgtatgtcgaaaccgaaaactacgttcgttaattcaaggcccgttcacttaaggagaatatgatgcgctcattactgctgtggttcctcggcgtgccgattccgctgatcatcctgatcgcgatcttcatgcactaaatccgagcctggctcggtgaagagtgggagggaccttgttccctcccactttgcgttttgcgcagggtcagccagcttgtgaccagcaatgcgctggcaagcgaggtcatgatcaccaacggctgcgaagtaccgtccgacagcagcccggtggcccaactgctcagtgccgtgacaaacatctggataaaaaagaacagccccgacgccgtgccggcaatcgccccatacggctgcaacacagacagctggcaggcaggcatcgtcaggcccaccgacaccatgatcaccaccatcggtaccacaatggccagccacgtctgtggcagcagtgccgtggctagcgcgagcatgacgctgcccagcacattcaagccgatggcgacgctgatcaagcggtcggccccgaaccgctgcaccagacgccggaacaggttggcgccgagcatatagccactgattgtcgcggcaaacaccagcgcgtaggcggtcggcgtcaaatcaaagccccgttgcagcaatgccgaagactcgctgataaacggaaaatacgtgctgtacgcgcagccgatcgccaaggcataacgcaggaagtagcggtcgcgcagcagttggctgtaggtgcgcagcaagtgactgggcggtgcagcggccacttgctgcgggcgggtttcaggcaggcggcgttggacgattacgcaaagcacgcaaccgatcacccccagcaatacaaacaagccacgccaacccaagagcggcaacaacaggctaccgagcactggcgcggccatgggcgatacggccatcgccatggagatcaaccccaacagacgcgcctgctcatcgcggtcaaaataatcgcgcacgatcactcggccaatcaccgtggtgcagcacccgccgagcgcctggaacagccgcgcaatgaccagcacgccgaggctatcggccagggcgcaggtcacggtcgccagcacatacagcgtcaatccggccaacagcaccgggcgtcggccgaagcggtcggtgagcgggccgctgaccagcagggaaatcgccgagccgagggtgtacagggtcaggaccagttgcaactggctgtcctgggtgtggaagtagtcggccatggcgggcagggcgggcaaatgcaaatccagggtgaggcgcggcaggcccaccaggaccgtcagcaaagtcagccagaaccacggagcgagaaggcgttgagtcatgggcgggtttcttcgcaatgagtagagcccggactctagcgactttgtggtttaatcctcaggaccacttatgccatggatgactggaccactatgagccgcggaaaagctgcctccaaccttgacctgccgcgccccgatacgctggatgcaggcaagcagcagggcgcctacgaggcgttgcgcgaggcaatcctggctcgacagttgccggcaggcagtcgtttgccgtcgacccgcagcctggccgagcgctggcaggtctcacgtggcaccctcgaggccgcttttgaccgtttgcacagcgaaggctatgtgcagcgtgtggccggctccggcacgcgggtgtgtgcggtgattccggagcagttcatcgcagccccggtggccaagcaaaacctgcgccgaccggttgagcccgactttcctcacgccggcgtgcagagccacgtgccctttgtcgcacgacgcccggatgccagcctgttcgacctgaaaacctgggcgcgctgcctctcccgcgggttgctggcggcaggtcccggcgtgctggaggctgcgcaccccggcgggttgccggccttgcgcgaactgatcgcggattacctgcgccgctatcgcggcatgcagtgcgaggctgatgaagtgatcgtcaccacgggcattcgccatggccttgacctgattgcgcgcacgctgctccagccaggtgacaccgcctgcgtcgaagaccccggctacacaccggcgcggcgtttgttcggcctcgccggggcgcgggtccaggcgatcgccgtcacggccgaagggctcgataccgaccagctccccgagcacgcacggctggcctatgtcagcccagcgcaccaggcgccgctgggcgtgaccctatcggtgtcacgccgcctggcactgctggactgggcgaaccgggcggatgcctgggtggtggaggatgactacgacagcgagtacaactacaacagcgcacccctggcggcgctcaagtccctggattcgaacgaccgcgtgctctattgcggaagcttcaacaaaaacctgtttcccggcttgcgggtcggcttcatggtggtgcccaagatcctgcgcccggcactgctgcgcaccttgcaactgaccgggcattcagtgggtgcaaccgaccagttgggcttggtggaattttttggcagtggtgccttcgtgcggcacctgcgggcttctcgccaggcgtatcaggcgcggcgggatgcgttgcttgcctgtctgccggagggcgtcacggtcagtggccagcaggccgggctgcattttgtgttgtggttgccgcccggggtgcaagaggcggacttctgcgcccgcgccgccaacgccgggttgagcttgcaaccgttgggcaagttttgtgtcgatgtgacgttgccgcccgccgtgattatcggctataccgcgttgaccctcgcgcagatccgcttccacggccgggccctggcgcaattactgtaggagcgagcttgctcgcgaagatcgttaacgataacgcgggcatcctggatggccgcgatgcctatgggttttcgcgagcaagctcgctcctacaggtggagcgcgtcagtcgtcgaacccgacctgctcatgaatctcatccaccttcaattccaaccgatacgccaccgcaataaacagcgcctggcacaggcacaaggtggcgctcagcgagcgaaaggcaaacgacgaaccttcattcaccagcaataccgcattcgcgcgcttggccagcggtgacaggttgctgtcagtgatgatcagggtcttggcctggtgatgctgggcaatgcgcagacagtgctgggtctccttgccgtagggcgtgaagctgatcgcgatcaccaggtcattggcgcgcacactgcgcatctgctcgcgataactgccgcccaggccagagatcaggtggatgcgcttgttggtgtgctgcaggttgtagaccaggtagtcggccaccgcgaaggagcgacgcacgccaaccacgtagatgttgtcggcattgaccaccaggtccacggctttttcgaaggcggtatcgtccagctccaggcccaggcgctcgatgccggagagggtcgcgttgacgcattcgcgcgccaggtcgccgccgctggccttctgcgatttattggcgatcatgctgcggatgcgctgctggtagttctgcaccggcgtggtcttgtgggtatacgcctcgcgaaacagcgcctgcatctcgctgaacccgctgaagccgaaacgctgggagaaccgcacgatggccgaggggtgcacttcgcattcgcgggcaatgtcgctgatgcggtcgaccatgatccggtcgctctgctgactcatgtagctggcgatgcgcttgagctggcgcggcaggctctcgtattcgtcggtgatcagctgcaacaggcgttcggcattgatcggagggctggcgacagtttcttccagggtggtctcgggatcggtgcgggacatgggcaatccttctggcgtgttcgtctgatgcgctgatgggtggcgcaagtctacagggtaggcgcaaaaaaatacctcggcatcacggcccgtgtggcctgctgaaacgatgcacgggcgctggcgtgccgctatgctgacgtattggaaaaaatattccactaaaaataattatggaataaatattgattgccaccgctggacgttctagtctgctcccaccaagagcgtttgccgtcgccacggcggcacaacgcaggctgataaaaataacaggagccagcatgggccagactcgttttgccagtgggcgtcaattggatctgatttgcctcgggcgcctgggcgtcgacctctatgcgcagcaagtcggtgcgcggcttgaggacgtgaccagcttcgccaagtacctcggcggttcttccgccaacatcgccttcggcaccgccaggctgggtctcaagtcagcgatgctgagccgcgtgggcgacgaccatatgggccgttttctggtggaatccctggcccgtgaaggctgcgatgtcagcggtatcaaggtcgacccggagcgcctcaccgccctggtgctgctgggcctcaaggatcgtgaaaccttcccgttggtgttctaccgcgaaaactgcgccgacatggccctgcgcgccgaagacatcagcgaagcctttattgcctccagcaaagcgctgttgatcaccggtacgcacttctccaccgacggcgtgtacaaggccagcatccaggccctggattacgccgccaagcacaacgtcaagcgcgtgctggatatcgactaccgcccggtgctgtggggcctggcgggcaaggccgatggcgaaacccgtttcgtcgccgaccaaaatgtcagccagcatgtgcagaagatcctgccgcgtttcgacctgatcgtcggcactgaagaagaattccttatcgccggtggcagtgaagacctgctcaacgcgttgcgcaccgtacgcgaactgacgcctgcgaccctggtagtcaagctgggtccccagggttgtacggtcatccacggcgcgattcctgcgcggctggaggacggggcgatctaccccggtgtgcgcgtggaagtgctcaatgtgctgggggccggcgatgccttcatgtcaggcttcctcagcggttggatcaatgacgccagcgatgaacgttgcagtcagttggccaatgcctgcggtggcctggtggtttcgcgccatgcctgtgcgccggccatgcctactcccgctgagctcgattacctgttcagcagcccggtgcccattacccgcccggaccaggacgtgaccctgcaacgcctgcaccgcgtaacggtgccgcgcaaggcctggaagcaattgttcgtgtttgccttcgaccaccgctggcaactggtggacctggcgcaaaagggcggccaggaccctgcgcgcatcagcgcgatcaagcagttgtttatccaggccatcgaacgcgtggagcgcaagctcggcgagcagggcgtcgaggccgacgtgggcctgctcgccgaccaacgtttcggccaggatgccctcaacgccgccagcggtcgcggctggtggatcgcacgcccggtggaagtgcagaactcacggcccctggcgttcgaacacggccgctcggtgggcagcaacctgattgcctggccccaggaacagatcatcaagtgcctggtgcaattccaccccgatgacgaaccgatgctgcgcctggagcaggaagcgcaactcaaggcggtgtacgaggcctccatcgtgagcgggcatgagctgctgctggaagtcatcccgcccaaggatcatccatcgacttaccccgacgtgctctaccgcagcctcaagcgcctgtacaacctgggcatctacccggcctggtggaagatcgaggcgcagtcggccgaggattggaagaagctcgacgaactgatccaggagcgcgacccgtactgccggggcgtggtgctgctgggcctgaacgcgtccgccgaatgcctcgccgatggtttccagcaagcacgcctgagcaccacctgccgtgggtttgccgtaggccgcacgatcttccaggagccgagccgggcgtggatggcgggggagatcgatgatgagaccttgatccagcaggtacaggctaccttcgaacaactcatcaatgcctggcgcagtgctcgaacctgatacatgaccgatacctgtaggagcgagcttgctcgcgaaaaacgcatggacaccgcgtttcgtcagaatgccggtgtaatcgttagcgatcttcgcgagcaagctcgctcctacagttgagaagcgacttgaataataaaggtgcagccatgcccgcaatccgaattggcatcaacccgatctcctggagcaacgacgacctgccggccctcggcggtgaaaccccgctgagcacggccctgagcgaaggcaaggacatcggctacgaaggttttgaactcaacggcaaattccccaaggatgccaagggtgtcggcgacgtgttgcgcccctatgacctggccctcgtctccggctggtactccagccgcctggcccgtcgctccgtggccgaggaaatcgaggcgattgccggtcatgtcgaactgctcaggcacaacggcgcctcggtgctggtgtatggcgaagtggctgattcgatccagggctcgcgcattcgtttgatcgaacgcccgcgtttccatagcgagcaggcttggcaggactatgccgacaaactcaccgaactggcgcgcttcaccctgtcccagggggtacgcctggcgtaccaccaccatatgggcgcctatgtcgagtcccccgaagacatcgaccagctgatgcagcgcacggggcctgaagtcggcctgctgttcgattcgggccactgctacatgggcggcggcgaacccatcgaggtgttgcgcaagcatatcgaccgtgtctgccacgtgcatttcaaggacgtgcgcaaacccgtggtgcaactggcgcgcaaccagatgtggagctttcccgattgcatcgtcaacggcactttcactgtgcccggcgatggcgacatcgattttgcaccgttgctggacgtactgctggcggcgaactacgagggctggctggtggtggaagccgagcaggacccggccgtggcgcccagctatatctacgcaaaaaagggttatgacaccttgcgtgcgcttctcaaccagaggacttgagtgatgagcttgttggtcaaaagcagcaaacgcgggcaaaccatggtcgccctggaagccgggcgcctggactacgtaggctttgccgcctaccgcctgagcctgggcgaaagcctgccgatcagcgcgggcgatcaagagttgtgcctggtgttgctcagcggtcgggtaaacatcgaaggcgcgggtttcagttggcagaacctcggtgatcgccagtcggtgttcgaagacaaatcaccgttcgccgcctacctgccgcccggcaccgatgctcaggtcagcgccttgagcgatgtacagatcgccgtctgcgccgctccgggtgcccagggttttgccccgcgcctgatccgccccgagcagtgcaagcgcagtgtgcgtggcaaaggcgccaacacccgctatgtgtgcgacatcctgcccgatagcgagccggcccattcgctgctggtggtggaagtgcgcacaccgtcggggcattcctcaagctacccgccgcacaagcacgacaccgacgacctgccgcaccagagcttcctggaagagacctattaccaccagatcaacccgccccagggctttgtcttccagcgcgtgtacaccgatgaccgcagcatcgaccaggccatggccgtggaaaacagcgacctggtggtggtgcccaagggttaccacccggtcagcgtgccatacggctacgagtcgtattacctcaacgtgatggccggccccaagcgcgcctggcatttccataacgacccgcagcacagctggctgctggacctttaaacggtttggacggagaacaacaacaatgaagtcgccgctacgttttgcccttaaccgcatggtcgcgcctgacctggccctggcggatttcatccagatggccaaggccctcaagtgcgatgctatcgagatccgcaacgacctcaagaaccgcgaaatcgaatacggcatgcccgccactcgcgtgcgtgagttgtgcgcggcgcagggtattacggtgctgtcgatcaacgcgttgtacccctttgacgtgtggaacgacgagcgccgtgcccaagcgttggagcttgccacctacgcgcgtgaatgcggtgcccagggtctggtgatgtgcccgttcaatgagcccggcgacacgcgcaccgacgcgcagcgcgccgccgctttgcgcaccgcgttgagcgaactggcgcccatcctgcgcgagtacgggattctcggtttcgtcgaacccctgggctttgaagtatccgccctgcgtcgcaagcgcgtggcggtggaggcgatcaagtccatcggtggcctggatgtgttccgagtggtgcatgacaccttccaccatcacctggccggcgagcatgagttctttcccgaactgaccggcctggtgcatatctccggggtggaagatcacgacgcgccgctcaacgcgatcggcgacggccaccgcgtactggtgggcgagggcgatatcctcggcaatgcggtgcagatcgacaccttgctgagtactggctacagcggctatctgtcgttcgaaccctttgccgaaagcgtgcatgggttagcggatatccagcaggccttgggggcaagcatcgcccacctgcaaaaaccataaggggcgcgtcatgaccaccacacgattgaccatggcccaggccctggtgaagttcctggataaccaatacatcgaagtcgacggcgtacagagcaagtttgttgccggcgtatttaccattttcggccatggcaatgtgttgggcctcggccaggccctggagcaggacagcggcgacttggtggtgcatcagggccgcaacgagcagggcatggcccatgccgccatcggttttgccaagcagcacctgcggcgcaagatctatgcatgcaccgcctcggtcgggcctggcgctgcgaatatgctcaccgctgcggccaccgccacggccaaccgcatcccgttgctgctgttgcccggcgatgtctacgccagccgccagccggatccggtgctgcagcagatcgagcagttccacgacctgagcatcagcaccaacgacgcgtttcgctccgtgagcaaatactgggaccgcatcaaccgccctgagcaattgatgacggcggcgatccaggccatgcgcgtgctcacagatcctgcggaaaccggcgcggtgaccctggccttgccccaggacgtacaggccgaagcctgggactatcccgactacttcctgcaaaaacgcgtgcaccgcatcgaccggcgcccggccactgcggcgatgatcggtgatgcgcttgccgcgtttcatggcaagcgcaagccgctgatcatctgcggtggcggggtgaagtactccggcgccagtgccgcgctgcaagccttcgccgagcgctttgcgattcccttcgcggaaacccaggcgggcaagagcgcagtggtttccagccatccgctgaatgtcggcggcatcggcgaaaccggctgcctggcggccaacctgctggcgcccgaagccgacctgatcatcggtatcggcacccgttataccgacttcactacctcgtccaaatcgctgttcaagcacgccgaggtgaagtttctcaacctcaatatcagcccgtgcgacgccttgaaactcgacggcgtgcaagtgctggcggatgccaaggttgcccttcaagcgctggctgacgccctgggcgattaccgctccggctggggtgagcaaatcgctgacgccaaggcgcaactcgatgccgaagtggatcgtgtgcatcaggtggaataccagggcgatgggttcgtccccgaagtcgacgaccacctggaccgtggagtactgcgtgaatttatcgagctgaccggctcatgcctgacccaaagccgggtgcttggcgtgctcaaccagagcctggccgacgacgcgatcatcgtcgccgccgccggcagcctgcctggcgatttgcaacgggcctggcgcagcaagggcgtcaacacctaccacgtcgaatacggctattcgtgcatgggctacgagatcaacgcggcccttggcgtgaagctggccgagccgaccaaggaggtctatgcgctggtcggtgatggctcctacatgatgctgcactcggaactggccacctcgatccaggagcggcgcaagatcaacgtggtgctgctcgacaacatggctttcggctgtatcaacaacctgcagatcggcaatggcatggacagcttcggcaccgagttccgctaccgcaaccccgagagcggcaagctcgacggtggcctggtgccggtggacttcgccatgagtgcggcggcctatggctgcaagacttacaaggtcagcacggtggaacagctcgaagcggccctggcggatgcgcgcgcgcaaagcgtctcgacgctgatcgatatcaaggtgctgcccaagaccatgattcacggctacctgtcgtggtggcgagtgggcgtggcgcaggtgtccaccagcgaacgcaccaatgccgctgcgaaaaaactcaatgaacacctggcgaaagcccggcagtactaataacaagaggagtgtttgcatgtctttgctttctaattcactgcggataggtgtaatcggcacaggcgccatcggccgtgaccatatccgtcgttgcagccagaccctgctcaacagccaggtggtggcggtcaccgatatcaaccttgagcaggccgccaaggtggtcgcggacttgaagctggacgcagaggtgtatccggacggccatgcactgatcagctcgccgcaggtcgaagcggtgctggtgacttcatggggtccaagccacgaagcgttcgtactggccgccatcgccgccggcaaaccggtgttctgtgaaaagcctctggcggtcaccgccgaaggttgtcgcaagatcgtcgaagccgaagtcgcccatggcaagcgcctggtgcaagtgggtttcatgcgtccgtatgacgaaggctatcgtgccttgaaagccgtaatcgatagcggccagatcggtgagccgttgatgctgcactgcgcgcaccgtaaccccacggtgggcgagaactacaagaccgacatggcgatcaccgacaccctgatccacgagttggatgtgttgcgctggctgctcgacgacgactacgtttccgtgcaggtggtgttcccgcgcaagaccagcaaggccctggcccacctgcgcgacccgcagatcgtgctgctggaaaccgccaagggcacgcgtatcgacgtggaggtatttgtgaactgccaatacggctacgacatccagtgcgaagtggtgggggagaccggcatcgccaagttgccggagccgtcccaggtgcaactgcgcagtgacgcgaagctgtccaacgcgatcctgatggactggaaggaccgctttatcggcgcctatgacgtggagttgcaggccttcattgacagcgtgcgcgctggacaggtgggtgggccgtcggcctgggatgggtatgcggcggcggtggcggcagatgcctgcattgaagcccagggcagcgggcagattgtgaaagtcagcttgccggatcgcccacacttctacagctgatcccaatctcacaggtggaacctggtcaatgtgggagggggcttgctcccgatatcggtgggtcagtcacccagtatgtatctgatctaccgctatcgggagcaagccccctcccacatttggattggttttcacttcaagtcaggagtgtatgcatgcgaattggactagtcggctacggccacggagggcgcttctttcatgcgccgctgattgcaacgttgcaaggcgcgacgtttgtaggcgtcgtcacacgctcagccgaacgccgccagcaattaagtaccgaccttccaggcgtgaaggcttttgactccatcggccagatcgtcgaagccggcgtcgacgccctggtcatctccaccaccctcaaaggccgccctgcattagtactggaagccattgaacacggcgtaaccgtggtcagcgataaaccctttgccgccaacgccgaacaggcccaagccttgatcaccgccgccgagcgccagggttccctgctcagcgtctaccagaaccggcgctgggactcggattacctgaccctgcgcaaactcatcgacgccggtgccctcggcagcatcacccggtttgaatcccgcgtggagcgctacagcccagaggctgtgggcaatgccagtggcggcggatggctgcgcgacctgggcagccatctggtggaccaggcgctgcaactgttcggcccggtggatcgagtgttcgcccaactgcactacaccgcgcaataccccagcgtggatcacggcttctttgtttccttgacccacgccaatggcgtgatttcacacctgtggggcaacgccttgcagaacagccaggcaccacgctttcgggtcagtggcagcttgggttgctacaccgtcgaaggcttggacggccaggaagacgcgttgatggccggtaaatcgccgaagaccgaaggcgagcattggggggccgaggaacatcgacgctggggctggttcgagcaggggccggaacgtgagcgggtgccatcggagaagggctgctggacccagttctatcgccagctgcaagcggcggtgcacggccaggggccgctgccggtaagcgcctatgacgcgctggaaaccacccgtatattggatgccgcgcgcctgagtgccgagcgccagcaggtggtttcgacaaaaatagaataaaattctaaaacaggttgatatggaaattattttctaatagagtcttttccaggttgcataaagtccgtcccgcacacgtttggggcgactcaacaaaaacaagatcaaaaacaaccaggtaccgtcagatgaaaatcttcaacgctgtactgcgagttttacgcccagctcaaacgcctcgccgcctgccccgcgcccgaccgttctacttctccttccttaatgtgctgtgcgtcgaaaaccagggcgcgctgctctgctgcattccaggcgcgccggtggtgcgagtgccggccgaggcctgatcaacgcaacgtccaaaaaaaccaacaagaaagtggagacagaccgttcatgaagaccccgatccgttttaccgcgctggccctgtccatcctgctggccagtggtgttgccggcgccgccgatctcaaggtgggcgtcacgatgtccgcgttcgatgacaccttccttacctacctgcgcgaagacatggacaagcaagccaagtcctaccccaagggcgatggcgtgcaactgcagtttgaagatgcccgtgccgatgtggtcaagcaactgagccaggtggagaacttcatcagtcagaaagtcgacgccattatcgtcaacccggtcgataccgcctcgaccaagaacatcatcaatgccgcgaccaaggcgggcattccgctggtgttcgtcaaccgccggcccgaccagaaagacctgcccaaggacgtggtggcggtgacctcagatgatgtcgaggccggacgcctgcaaatgcagtacatcgctgagaaactcggtggcaagggcaagatcgtgatcctgctgggcgacctggcgaacaattccaccaccaaccgcaccaagggcgtgaaggaagtactcgccaagtacccggacatcaagatcgaacaggaacagaccggcatctggctgcgggacaagggcatgaccctggtcaacgactggctgacccagggccgcgagttcaatgcagtgctggccaacaacgatgaaatggcgattggtgcgtccatggcgctgaaatcggccggcaaggaaaagggcagcgtgctgatcgcgggtgtcgacggtacgccggacggcttgaatgcaatcaccaagggtgacatggccgcctccgcgttccaggacgccaagggtcaggccgtgggttcggtggaggcggcgcgcaagatggccaggaacgagccggtcgagcagaacgtgatcattccgttccagctgattactccggacaacgtcgcccagttcaagtagccctgacatcacaacaatgaaccggcagggcggtcgtgcccgccctgctgatggagtaccgtcttatgctcgctcatgccgctgtctcgcagcctcccggtatccagccgttgccgctggacgaaccctacctgttggaaatcgtcaacatcagcaaaggctttcccggcgtcgtggccctggccgacgtacaactgcgtgtgcgtcccggcacggtgctggcgctgatgggcgagaatggcgcaggcaagtcgaccttgatgaaaatcatcgccggtatctatcagcccgacgctggggaaatccgcctgcgcggcaagcccatcgtgtttgacacaccgctggcggcacagaaagccgggatcgcgatgatccaccaggaactcaacctgatgccgcacatgagcatcgccgagaacatctggatcggccgcgagcagctcaacagcctgcacatggtcaaccaccgcgaaatgcatcgttgcaccgccgagttgctggcgcgcctgcgcatcaacctcgaccccgaagaacaggtcggcaacctgagcatcgccgagcggcagatggtcgagattgccaaggcggtgtcctatgactccgacatcctgatcatggatgagcccacctcggcgatcaccgacaaggaggtggcccacctgttttcgatcattgccgacctcaagtcccagggcaaaggcatcgtctacatcacgcacaaaatgaacgaagtgttcgccatcgccgatgaagtggcggtgttccgcgacggccagtacatcggcctgcaacgtgccgacagcatggacagcgacagcctgatctcgatgatggtggggcgtgagctgagccagctgttcccggtgcgcgagacgcccattggtgacctgctgctgtcggtacgcgacctgagcctggacggtgtgttcaaggacgtatccttcgacctgcacgccggggaaatcctcggcatcgccgggctgatgggctccgggcgcaccaatgtggcagaaacgatttttggcatcaccccgagcaccagtgggcaaatcaccctggacggccaggcggtgcgcatcaccgacccgcatatggccatcgagaagggctttgcgctgttgaccgaggaccgcaagctcagcggcctgttcccgtgcctgtcggtactggaaaacatggagatggcagtgttgccgcactattcgggcaacggcttcatccagcagaaagccctgcgtgtgttgtgtgaagacatgtgcaagaagctgcgggtgaaaaccccatccctggagcaatgcatcgacacgctgtccggcggcaaccagcaaaaggccttgctggcgcgctggctgatgaccaacccacgcctgctgatcctcgacgagccgacccgcggcatcgacgtaggcgccaaggccgagatctatcgcttgatcgccttccttgccagcgaaggcatggcggtgatcatgatttcctccgaactgcccgaagtgctcggcatgagcgaccgggtgatggtcatgcacgaaggcgaactgatgggcaccctggatcgcgctgaggccacccaggaaaaagtcatgcagctggcttccggcatgaccgcggtccactgatctacagaataagaaggtgatgggttatgaacgcaataacagacaacaaaccggcgacggcaccggtcaagaaccgtcgacgcatgcctaccgagctgagcatcttcctggtgctgatcggcatcggcctggtgtttgaactgttcggctggatcgtgcgcgaccagagcttcttgatgaactcccagcgcctggtgctgatgatcctgcaagtgtcgatcatcggcctgctggccatcggtgtgacccaggtgatcatcaccacggggatcgacctgtcttccggctcggtactggccttgtcagcaatgatcgccgcgagcctggcgcagacctccgatttttcccgggcggtgtttccgtccctgaccgacctgccggtatggatcccggtggcaatgggcttgggtgtagggctgctggccggggcaatcaacggcagcattattgcggtgaccggcatcccgccgtttatcgcgaccctgggcatgatggtctcggcccgtggcctggcgcgttattacaccgaaggccagccggtgagcatgctctcggattcctatacggctatcggccatggcgcaatgccggtgattatcttcctggtggtagcggtgatcttccatatcgccctgcgctacaccaagtacggcaaatacacctacgccatcggcggcaacatgcaggcggcacgcacctcggggatcaacgtcaagcgccacttgatcatcgtctacagcatcgccggcctgctggcgggcttggccggcgtggtggcttcggcacgtgcggctaccggccaggcgggcatgggcatgtcctatgagctggatgcaatcgccgcagcggtgatcggcggcaccagcctggcgggcggggtagggcgcatcaccggcaccgtgatcggcgcgctgatcctcggcgtgatggccagcgggtttaccttcgtcggcgttgacgcgtatatccaggacatcatcaagggcctgatcatcgtggtggcggtggtgatcgaccaataccgtaataagcgcaagctcaagcgctgagtgaatccaagggccaaatcagatcaaatgtgggagggggcttgctcccgatagcggtcagccagaaacagatgtgcaagctgacacaccgctatcgggagcaagccccctcccacatttagtccgggatcagccactttcaaccgtttgtcttctatatagctccacaaacttgaatttcttgctataaacgcactccgatgaccgttcgccaagcccgtcctggtgcctttgggggttaattgggaaaaaatgcctgtcttttcagttgctgcgccctcaagtcggccttagactgccgcccctcgtaaattgagtgccgggtggcgcttgaaatggacggcgcccttccgagacctgcagaggcctgccggaacgctcccttattcgccttaatgcacgtattttttatagagaaatcaatgacaaaggaaaagttgctggccatgccggcggatgactacatgaatgccgaacagcacgcttttttcgagaagttgctgcaagacatgaaagtggaacaccacgagcgcattgaacagaaccgcatcgccattgaaagcctggacaccccggccgacccggctgacgccgcttctgtggaagaagagcgcacctggctggtaaatgccattgatcgcgaccagcgcatgctgccgcagcttgagcgggccttggagcgtatcaaggaagattcctttggctggtgcgatgacagcggcgagcctatcggcctcaagcgcctgctgatcagtcctaccaccaagtactgcatcgaagcgcaagagcgccacgagcagatcgacaagcaccagcgtcaagcctgacgcgggtgaggggggcgcctgccagtgagccggccgccccgcctgcaacagcattacgcgagcatccggccgcgtccagcgcgtagattgttgctatttatgcaatgaagctattccgaagatagctttttccaactggaataaaaccgtagcatggccaacattgttagcaagctaactaatgctgcggagaaactccatgcaaaacaaagtcgatgtggccgtaatgatcggcagtggcgtacctcagaccttgcgtgccctgggccagaaagcttgctgggtggtattgctcaatggtgagcagcgcggtaccgccttcgccagccgcgatgaggccgaggagtgcaggactgcctggcaagcgctgttgcgcatggaacagtcagacagcctgcattgaattattccttgggcgattcgtgcaacagtgcgttgaggtcatccaccgcaggcgcccattcggcatctacatgcaattgttccttgaggaaactcgcctgttgttcgctccagaacggtgcgtcgatgagtttgacatcatccggcaggcgatgctcggcggtaaagcgctcgatggcttcctggctcgagtccaggcccagttgatcgaacaaggtttcgagcgtgggggtggtggtgtccatgtcgtactccatgcggttcaggtgtgtatgcatgggaggcttggggcgcggcagagttctatcagattgtcaggaggtgagcgcccctgaatccacggctgccttgagcgccttggcagcgtccttcgcggcgctggcggcggcgtccacggttttgaaccagcggtccttctctacctgatgcgtagtgacggtggtcaagggtggtttggcacgcattacgataactgcttgaaactctccgtctacttccctggcatcgccgtggataaaaaattcgccaatatcaaattccgtcacgtatagccttcccttcaaggtaactgcactgatgaaacctgacccgcagggggcaaacttcaatggacgggccagtatggcagttgttgaagcacgacggcgcggtaaagtcatccaggtgacgaaacgagtgagtcacacagggcttgcaacttggcttccagggtcttggccagttcgcaggccttgttatgatcgctgcgaaaccccttgatccggccactgggtacttcaaggatgtggaaaaagttcttcccagccggtacaacttgataaatgactgagttcgagtacccatcagcgttatgcaggcagtaatattggcgttcttctgaccatgatgaacgcttgtggaaagacgcagcatcgtgttgacgtcgttgcatgctcagctcctgtcgatcttgttggcctgtcagtggcgtttcgggtggtttaacctgggttgctgttttagtattgtcgtcggcagttcgcgactggttccatgcgcggttatttttttgctttggacgtcggaaaactgcattttcgattgggttattctctgaagttgctcgacttgtattctcgggtcgctaaacctgtgatttgctgtgctaccggatgaccttgattgaggtccaccgcggctgtatgtaccagccttgtaggttatcttcagtttttaacgaatgggtgatcgtgccgtaacggccgttttttgtgttgcccgcttcagcggccagcgcttttttgatgtggggacgtttccttggcagtcagtaatctggatatgcacgcgttattcgtgctgggtgatttgcgcgcaaagttggtcaagcagtttcaatcgcggtttgtctacgtcaccgaacaaaccccagaaggtatctatatcgccgagatcgataccgaaacggcgctggtcgtggatgacaagccacgcctggaactcaaggtgggcgaccatttccgtgcggcggtgttacccagccgcgaaggtggcaagttcgaactcaagtttcgcgatatcaagttgaccgtgtatgggttgggcgattacgcctttgtttcgtcggccgagggccagggcattgtgttcaaggaaggccacagcgtgatgctggtatttgccgcccatgaacaattgcaggaaggcctgaccaagaccctgaaagccgtgaccggcaaggccgccaaatggcgcaagggcgagctggttaccttcaaggccagcgaataaccgataaacacttcgtgtaccgatctgttccggaacctctactacagttgcgttgacttaactattcagaggcttcgcgcattggcggcaaagccgttcgccatgactgtgaagacgcgaggtgcaacgcatgaagggattgaaatcactgttggcagcgtccttgacgaccttgagcctggcattgccggtctcggctgcccaggcaccggtgcattttgccgacctgaactgggaaagcggcagcctgatcactgaagtactgcgctttatcgtcgagaagggttatgacctgcccaccgacaccttgcccggtaccaccatcaccctggaaactgccctggccaagaacgatatccaggtgattggggaagaatgggctggtcgcagtccggtgtgggtcaaggccgaagccgaaggcaaagtggtaggccttggagataccgtcaaaggcgccaccgaaggctggtgggtgccggagtacgtggtcaagggtgacccgtcgaaaaacctcaagccgctggctccggacctgaaaagcgtcaaggacctggcgcgctacaaggatgtgttcaaggaccccgaatcaccaggcaaaggtcgctttcttaacagccccatcggctggacctccgaagtggtcaacaagcagaagctcaaggcctatggcctcgacgatagctacgtgaacttccgcagcggttcgggcgcggcgttggatgcggaaattgcgtcttcgatccgccggggcaagccagtgctgttctactactggtcgccgaccccgttgatggggcgctataaattgatccagttggaagagccaccgtttgatgccgatgcgtggaagaccctgaccgatgcgaacaaccctgaccccaagcccacgcgctcgttggcatccaaattgagcattggcgtatcgacgccgttccagcaggaacatccgcagattgcccagttcttcgagaaggtcgagtttcccattgagccgcttaacaaagcgctggcgaagatgagcgaaaaccacacggcaccacgggaagtggcccagatgttcctcaaggagcatcctgaggtgtggaaggcgtggttgaccgatgatgttgcgcaaaaagttgagtcggccctcaagtaatagacagcgtctctacttgatggagatcaaaatgtgggaggggcttgccccctcccacatttttttgcattccagatttagaatcgggtttgtattgcgacttcaaacgttctcggcgaacccaggtaatacgccggcgacacatgggcaaactcggcatacacctcattggtcaagttgcgcacgcgtccggtcaccgaggtgtgggcgtccagcctgtagcgcaggaaggtgccaaacagcgtgtaggccggcaccgtctgagtattggcattatctgcatacacctgggcgacataccgcgcatccacacccccttgccaatcctcggaaaaatcataggtcaaccacagattgcccacgcgcttgggcacgttggttggcgtattgcctttacgcgacaccaccgcgccactggccattttctcattgaactcatcgtactcggcgtctacccaggcgaagttgccttcagccagcaaccttggcgtgatacgcagtgagctggccaattcgatgcccttggacgactgcgcgcctaccgggatgctattggtcggatccagcggatcagtgacggcaaagtccttgcgttcgatcttgtaggcagcgaccgttgccgaaccgcgaccgtccaggtaatcaaacttgctaccgatctcccattgcttgccggtggacacatcgaacacctgggtggtggtattgggctgttccacggcggtgctgtattgcacgtagacattggccgacgggatgaattgataagtcaggcccacacgccccgtcagcggttcccagctgcgcttgaagtgccgtgggttggtggcggtgaccgtgcgatggttggtcacgtccatgtcgatggcgtcatatcgcaggccggtcagcagcgagagcttatccgtcagccccaggcggttttccacgaacagtgccttggtggtcacctggttggtcttgtccttgacgaagccagggcgggtgccggggatgtcatagaagtgtcccgggtcatagttgttcggctccacggtacttttgccaggcacgttcaaggggctgttggtagtgctgttgaccttgtactcaaaaccgccggaccaggtggtggagaggccgaaaatcctgttgtcatggcgcagttcgaactggttgccgttttgttggccctgatgccttacctgataggcggtcgagcggttcaccgcgctgttatcggcgttgtactggtaggtctccaggttgcggtagtcgcgctggctgtcgaggtgatagagggtgtttttcagtgtggtgctgtcgtttatccggtagtcgatgatcgaccgcgcccagatcgtgcgctgttcgtaacgaccgtcggcgacgttgtaattgttgaagcgattgtgcttgtcgatcttaagttcgccagccttggggttgagcaccggcgtgccccaataggggctgtcttcatgctcgtcctgatattccagggccagggtgtgggacaggtcgggggtcaagtcgctgagcagcgaaaacgccaagctccaggcatctcgttgatcgcggtcgatatagctgtggttggtgttgcggctcacgtccaggcgtgcgtagtgctgcacctcggcaccaggctcggtcagcgcatggttgaggccgaacgccatgcccgcggtgtcgtagctgccataggtcaactggccttcgacagcctgctcctcacggctcgccagcttggtcacgtagttcagcgagccgcccacggagcctgcgccgttgatcaaggaggaagggccgcccaccagctcgacgcggtcatagacccacgcatccactggccgcgccaggcccgtggcaacattgatgccgttgaacatttgggtaatctggctgctggtaaaccctcggtacgatacaaacccaccaaacccgggcggcgcgctggcattgacgccgggcagggtgttggccgcatcgcggaaggtcttggcgccatggcgctcgatatcgttgcggttggcgatggccaccgaggccggggtttcccgcacgctcagtcccagccgcgaggccataccgctgggttggtccagggccagcccgggctcaacgctttgctcgccttcaatggtggtcggtgccagctcaagggctggggcgcagacaggcaggcagccgaacaggcctgccagcaggggtagatgtttcatggttgaatcctgaaaacttggcttgaaaacaaacgcacggccgcctttcttcctcacggaaacggtcggcaatgcagattagaaagcgcaggtatcaggcgagggcaggtggcgcgcgcgggttagccgtgggccaggtgaagcgggcaggaatgtcagcagcgagcacgatcgccgcaggcggcgcgtggggttgtggaaaaaccgccacgttcaggtggctgttgagcgcggggcccatgccgccggtcgaacacaaggggcaaccgaacgctttcgacagcgttggcaggttctcatccgtagagttgttttgcaggggcgcctgggtacgcggatctacggtgcagaactggccgctgatgccgttgagctgcatgcccaccatttgcccgtggccaatgctgcaggcgaacacattgaacaggacgcagcagtaaagcatccaggcaatgagcgagcggtcggcacgggcgagtttcatggggcggcactttaccatcagccgccgacgaaatgcctgcaaaaaatctcagggcgactatcctgattcccacatttttcgggagcgtccgccatgagttttgtcattgcgcgatggattgtcggggtttttacctttatcagcatgctgcatctttactgggccgctggcggcaaattcggcagcctggcggcgattccgcaactgcccggcgaatttgccagcgggccgcgaccggcgttcaagccctcggcgctgggcacctttctggtcgctatggggttggtggcaattgccttgctcgtttgcctgcgcgccgggttgtatttcacgccggtgtcccatggggcgttgcagtggggcatcagtgcgattgcggtgctgatgtttgccagggcgattggcgattcggagttggtgggctttttcaaaaaggtcggcggctcccggtttgcgcgcctggatacctatgtctactcgccgttgtgcctggtgttaggtgccgggcttttggtggtggcctggacctgatcgtctcagctccaatgtgggtggtgcgacgattcgacttgcccccgatggcggcctcaaagccgaccaggatgttcggttggatcgagtacatatccattgtttaggtgacggccgctattggttccgcccttacggcgggtcactttgaaaagcgcaaagtaaccaaacgctcttgccccaccactcggcacctcgcccaggctcggtgtgcccgtaatccgccatggatttggggggccgccgccacgcgccatccatggcgcggggcggctaaaccggcatccctgccggtttaccccccaaatccctgtcgaattccggccagcgtggtttgacggggcgcctgagatcaaaagcagagcaagatcaagagcggctcgcttcgcatcgtggttactgacggtcgcacgtcagagttgtgtagatacccatgctcatcgagggcaagtcgaatcgtcgcaccgcccccttccacaacaaagcgcctaaaggccgagatctcccaaactgcacacccagcccacgctccaaacaccctccagacaaaaacacacctcccggttttatagcgcttgaccttcccaacgtggcaagcccgataaaaacctccagtgtcgatttgtcttgaaaattccaaggagggtgaacgatgtacgccaaaccaattagcctgatcaccggggcaatggccgtggtgttgacgctgggcggatgcacagacaacgcgccgccggcggcggccgccaagccgcccggtgtgccggtggccgaggtggtagcgcgggcggtgacaccctttgtcgagtacaccggttcgttgaccgccatcgatcaggtggaactgcgcccgcgtgtcagcggctatctgcaaagtgtcagcgtgcccgagggccagttcgtggccaagggcagcccgttgtttgtgattgacccgcgggtgttccaggcggcgctgaatgcggccaaggcacgtttgcgcgaggccgaggccaatgcggtgctggcccaggccgagcatgggcgagccgagcaactgttcgccaagaaggtggtggcgcgtgatcgtcttgataccgccattgcttcgttgaatgcgggcagggcccaggtcgaggcggcgagggctgcgctggatacggcacagctggacctgagttacacccgcgtcaccgcgcccatcagtggccgcatcgatcgtgccctcgtcaccgaaggcaactatgtcacccgaggggagacgccgttgacgacgatcgtttcggtcgacccgttgcatgtgtatttcgatgtcgacgagcgcacctacctgcactcgcttgccgccacacgtcaacacgccgggtccaagggcgacaaagccgccaaggtcatggtggccatgctcaacgatacgacctatgcacgggccgggcgggtggacttcctggccaatacggccgaccgcaagaccggcaccgtgcgcgtgcgtgcggtggtcgacaacccggatgggcgcctgaccccagggctgttcgccaaggtcaagctggacaccggcgtggcgcagcctcgcgtgttgatcgccgaccaatccatcggcaccgaccagggccgccgctatgtgctggtggtcggtgagggcgacaagaccgaataccgcccggtcgaactgggcccgatggccgacggcctgcgcgttatcgagcaaggcctgcagccgggcgagcgcatcgtcgtcaaagggttggtgcgccccggtatgcaggtgacacccttggccgccagtatcgagggcaagccgcttgaggcgccgctgactgtgggaggtgtgcaatgagcttcccacgctttttcattgatcggccgatcttcgccattgtcttgtcggtgttgatgatgatcggcggtatcgtggctttctttcatctgccgctgagtgaataccccgcggtcacgccgcccacggtgcaggtcaccgcgtcctatcccggggccaacccgcaggtgatcgccgagacggtggcggcgccattggaacaggtgatcaccggggtcgagggcatgttgtacatgacctcgcagtcggccaccgacggccgcatgatcctgaccgcgaccttcgcccagggcaccaacgccgacatggcgcagatccaggtgcagaaccgtgtgtcgcgggccttgccgcgcttgcccgaggaggtgcagcgcctcggcgtggtcacgcaaaagacctcgccggacatcctcatggtggtccacctgctatcccccgataaacgttatgacccgctgtacatctccaactatgcctacctccaggtgcgtgacgagctgtcgcgcctgccggggatcaacgacgtgctggtatggggcgcgggcgaatacagcatgcgcttgtggctcgacccggacctgatcgccgcccgtggcttgaccgccggcgatgtgattgccgcggtgcgcgagcagaacgtgcaagtggcggccggctccgtcggccaggcaccggattccagcgcggccttccaagtcacggtcaatactctcgggcggctgacggacgaagagcaatttggcgacatcatcatccgcaccggcgataacggccaggtcacgcgtctgcgtgatgtggcccgtatcgagatgggcgccgatgcctacgcgctgcgcagcctgttggacggcgagccggcggtggccttgcagatcatccagagcccgggcgccaacgccctcgatgtggcgcaggcagtgcgcgataccatgcagcgcctgcagaccaacttccctgaagggctggtgtcgcggattgcctatgacccgacggtgtttgtgcgggcttcgctggagtcagtcgcgatcaccctgatggaagcgatcctgctggtggtcatcgtggtggtggtgttcctgcgtaactggcgcgcgtcgctgatcccgttgatggccgtgccggtgtcgatcatcggcaccttcgcggtcatgcacctgatgggtttttccctgaataccttgtcgttgttcggcctggtgctgtcgatcggcattgtggtcgacgatgccatcgtggtggtcgagaacgtcgagcggcatatcgagaacggcgaggagcccacgcaagctgcgcggcgtgcgatgggcgaggtcaccggccccatcattgcgattacctcggtgctggctgcggtgttcatccccacggcgttcctcagtggattgcaaggtgagttctaccggcagtttgcgctgaccatcgcgatttcgacgatcctctcggcggtcaactcgttgaccctcagcccggcgttggccggcctgttgctgcgcccacgaggtgccgccgtggtacatgacccgcgcagcctgcgcggtcgcgccgtgcgcctgctggaggtgctgggccggccgttccagcgtgcgccgcaggcgtatggcagcacggtgcgcaaggtggtcggccgtcgcggcgtggcggtggtggcctattgcggattactcgcgctgacctggttcggcttcaacgctgtgccggcgggttttgtgccgatgcaagacaaatactacctggtcggcattgcccaattgcccaactcggcgtcgctggatcgtaccgacgcggtggtgcggcaaatgtcgaaaatcgccctggacgaaccgggagtggaaagcgtggtggcgttcccgggtctgtcggtcaacggcttcgtcaacgtaccgaatgcggcggtgatgttcgtgatgctcgatccgttcaaggagcgaacctcgccggacatggccgcagtcgccatcgccgggcgcctgcaagccaagttcgcgagcattcccgacggtttcctcggcgtgttcccgccgccgccggtgcctggccttggcgtcaccggtggtttcaagctgcaggtcgaggaccgtggcggtgtagggcttgaggcgttggtgcagcagacccaggtgctgatgaccaaagccaccgagtcggggcaggtcgccggcttgatgaccagcctggacgtcaacgcgccgcagctgaatgtcgatatcgaccgcacccaggtcaagagccagggggtgcgcctggcggatgtattcgagtcactgcaggtctatctcggctcgctgtatgtcaacgacttcaatcgtttcggccgcacctacaaggtcaccgcccaggccgatgcggaccatcgcatgcaggccgaggcgattggccgcctgcaagtgcgcaatgcggccggggacatgctgccgttgtcggcgtttgtcaccgtcaccccgggttccggccctgaccgtgtgattcactacaacggctacccctcggcagatatctccggcggggcgatgccgggcgtcagctcaggccaggccgtggcgctgatggagcgcctggcccaggaggtgctgcccgaaggtgtgacctatgagtggacggacttgacctaccagcaaaagctcgccgggtcgtcggcgctgtttattttcccgctgtgtgtgttgctcgcttatttgatcctcgcggcgcagtacaacagctggctgctgccgctggcggtcttgctgatcgtgcccatgtgcctgctcagcgcgatcatcggcgtgtggctggtggagggtgacaacaacgtgttcgtgcagatcgggctggtggtgctggtcgggctggcggcgaagaacgccatcctgattgtcgagtttgcccgcagtctcgaagccgaaggcgccagcccgttggaggcggttatccacgcctgccaactgcgcttgcggccgatcctgatgacctcactggcgtttatcgccggcgtggtgccgctggtattcgccagcggtgccggggccgagatgcgccatgccatgggcgtcgcggtgtttgccggcatgctcggggtaacgctgttcggcctgttcctcaccccggtgttctacgtggtgatgcgcagcctggcgctgcgcgtggagcgtcaggggtcgagtccgaagttgcagttggaggagcgtgcatcatgagactgtcttatccagtgttgctgttgccgttgctgctgatggccggctgcgcctcggtaggccctgattattccacccctgtgttgcctgccgcgcagcgcccggcgagcttcggtgcgcccgtcgccggtctcggtaccggcgcggtcgaggcgcagtggtggcaggtgttcgacgagcccgctctcagccaattgatccagcaggcgctggcagccaaccatgacatcggcatcgccgccgcacgcctggacgaagccaaggcgatgctgcgcgaaagccgccaagggttcttgcccagcggcggcgccgccctcggttatgagcaccgacggcgcagtgaggtcgagacgccatatggcgagcagcgctccattgaatccacccgtgcggccctggatgcggcctgggaaatcgacctgtttggccgcgtgcgacgctcggttgaagtggcgcaggcccaggcggggtcacgccaggcgctgctgcgcagtgtgcaggcgagcgtcgcggccaccgttgccgccacctggttcgaactgcaagggatcgaagccgaacaagccgtggtcgctgacatcagccagagccagcgcgacagcctgggcctggtggagcatctggtcagtgtcggcgctgccaccgagttcgaccggctgcgtgccgaggctttgctgcgcaatgtcgaggcggtagcgcccgaccttgagcggcgacgcgcaacctccaacaacgcgttggcggtgctgctggggcaggcaccgcaagggttcaagccaccgctggccaggcccggtcgtgagactttgagcctgcgcaccctgcaagtgggtgatccggccggcttgttggcccggcgcgccgatattgccgcggccgaacgcaccctggcggctgagactgcgcaaataggcgtggaaaccgccggcctgtatccggatatccaggtgcagggctccatcggactactggccggaagcctcggctccctgggtgatgcaggcatgcagtcgaactttatcgccccggtgattcgctggtcgctgctggacaccgggcgtgtacgcgcacggatcgccgccagcgaggcgcgtacccaagcggccttgatcgcctatgaccagaccgtattgcgtgccctgcaggaaaccgacgatgcgttccaggccaacagtgccgcgggcagcaccttgggcctgcggctgctggaggcggcggccaatcgcgaggcggccaagtttgcgcgcacgcgatttgccgaaggcgagggcatgtatctggatgtgcttgaggccgaacgtgccgacttcaccagccgccgtgcgttaacggcagcgcgcacccagcagcgcttggcggtggtggggatctacaaggcgctgggcggtggctggcagatttgtgaacaggcggggcagatctgcagtggggctgcggcgctgcgttagccacagccgagcaaaaacacagcacggcagtgcaaatgtgggagggggcatgctcccgatggcggcgggtcagtcagtacatctggcactgacccactgccatcgggagcaagccccctcccacattttgctctccatacgccaggtaaatgtccattgggaaaagaaatttcctacaggtattgaccttgccactagaggaacctttagccttttcttcgagtacgccaaatcacaaaaacaagaatcgaggggttatcaatggatactgctgccctgttacaacgctcggattccgacctgttcaccacggcctcgacactgatggccagtgccctggaacccggcgcccactacgcccaggtcacccgcgcgctggaagcactgctcgcgctgacccggcaaggcttgtcgggggatgccgatgcctacgcccactaccaggcagccctgctgcaactgcacattccgggcgatccacgcactgagccgacccgccgttggatggccagtgaggtctaccgcgccgaagatgagttcgccgttgacctgccgggcttcaccgcgttgccggtggatgagttccgacagctggtcgacgctgaaatcgccgctcgcagccgggtcaaccaccccatgtcggtgcacctgttccaaggtacgccgcctgtgcaagacgtgcgtttcttcctggaacaccactggacccgctcctacaacttctacagcctgctggcagagctggcctttcgcttcgaggccatcgaggatgcctcggtgttctaccgcaacctttacggtgaagcgggggccgagactccggagcgttcgcacccggcgattctggcccatctgatggagtatttcgatattccgctggccatcgactttcctgcgttgcatcccctggaaaaagcctacctgaataatcgcattcgctgcgtgcgccacaccgatgtcgcctggggccttgcgctgctctatgcggtggagtctgtcagttgcgtcaaccatcggcgcatctacgagctgttgcagcgcctcgacgttccagagcagccgagcgaattccaccgcctgcacggcacccaggatgagatcgacaccgaggaaatgtgggcgctgattgccaagttcgcaggcgatgacggctttcagcgcacgttcatgcgcgcgctcaagcgtcacttcgaaatcaacaaggcctatttcgacagcttgtggcagcagatgcaggcgcagcgcctgcctgcctgaaccacccagcgatcctaaaacaacaataatggagcacatgatgagcccacgtaatttctcgcagccgcaattgcagaatatccacaccgccgaagcccgcctgttggccgaagcgctgaagccggatgcgacgttcaatcgcatcgaaattgccgccaatatgctgcgtgccctgtgtgagtcgggccagcgcggcgatgccgcgaacgcggcgcagtgccagcaattgctgtacatcctgtcgctgagcgatgacgtcgccaccgcctcgacccgacgctggctggccaatgccatctatagcgtgcaagagcgtttcatgccgtctgcggacttggcctcgccgttgtccgaggccgcgttccagcaacgcctggaagagcagattgccgcgcagtcacgggaaaaccacccgatgtcgcagtatgtgttcgagggcaaggcgtcccgcgagcaattgcaggtgttcctgcgccaccagtggttccgcacctaccgcctgtaccgggatgccgccgacctgttggtcaacctgaccgatgttgacgaggcggccgcccttggccgttatctctacggtgagctgggcgaagaggacgaacagcgctcccatccgcgactgttggccaagcttctcgctgccataggcctgaccgcggatttcgaggccatctcgacgatgcccgaggaaatcgcctacctgaacaaccgtgcccgctgtttccgcaaccccgatgtcggctggggcctggcggtgttctacatcaccgagctggtggtgcccggcaaccatggcaagttgtacaacgccttgcgcaatgcgggcttgagccaggacgacgcggagtactacgaagtgcatatcagcctggtgccaccccgggccaagcgtgaatgggcactgattgcacggcgtatcccggacctgggtttccagaatgcctttctcacgtccctggccgagcacttccggctggagcgggcctattacgacgcggtctgggaagcaatgcagcgcgtgaagtagccctccttaggacaacgcgagtaacccgacatgccgagtcatatcactgaatcccgtatccacgggggcgcttactcgtccccggaatttgccgcgatcttctctgatgccagtcaggtgcagaagtggctcgatgtagaaacagcgctggcggcgacgcaggcgcagatgggcatcatcccccacgaagctgcacgggaaatcgcccgggtggctagtgtggaactgctggacctcgacgccctggggcgccagagcatggagaccgggcatatcctggtgccgacccttcgcgccctcgaggccttgtgcgccgatggctggggtgagtacgtgcattacggtgtgaccacccaggacattctcgataccgggctgatcctgcaggtccgcgaggcctggggcctggtgttgcagcgcttgcgcgccatccgtgggcatttgctcacgctcgccctgcggcataagcacacgccgatggtcgcccgcacccatgggcaacaagcattgcccaccacgtttggctacaaggtggcggtgtgggtcgatgagatcgatcgccacctcgaacgcttcgacgaggcgtatgcccgggtaatggtgggcaacctgaccggcgccgtgggcaccctggcggcgcttggcccgcagggtttggaggtgcagcgccgcaccctggaacgtctcggcctgggggcaccgttgagcagttggcacagcgcccgcgaccgcatcctggaggcggcgtggctgctggtccaggcgtcggcgaccctgggccgcgtagccaatgagatctaccacctgcaacgcaccgagatcgatgaagtgcgtgaaggccgccgggcagggcaggtggggagcagcaccatgccccacaagcagaacccgtcgacggtggacctgatcagtgcgctgtcgcggctggtgcgcgcgcagatgcttgcactgactgatgcggcgttccagttgcatgagcgcgacggcaccacgtggcgtatcgaatgggcggccttgccggagctgtttgtctacgccggcgccttgctcggccgtatggagggtgtgctgctggccgggctggatgtgcgcgaaacgcgcatgcgcagcaacctcgacatgctcggcgggctgatcctgtcggagcgcatcatgctcgcgctggcgccacggttcggcaagcagacggctcatcagctggtccacgaaatagcccagcaggcccaggtcgagggtcgtccttttcgcgaagccctgctcagcgactcgcgcctgcacggctgtttcagtcgccaagtgctggacgacctgcttgacccggcggcctacaccgggctggcggcagacatggtcgacctggtggcgaataaagcgataccccgtcttgaagggttagtagaaacccaaggcaataccggtcagtccctgtacgcaatggagggtatgtgatggatgcgcaaacgttggaaatggcagcccgtgcgtcttgcaccgcacgttcggaacacccgggcctgggtcatgacggcgaacaatgccggcatgaacacagccacatcctcgactcgaaaacccacggctcaggctatgccggcccgcagagccgcaagatcttctgcagccattgccgcctgcaacgctggctggatgtggaagccgcactggccatggcccaggccgatgtcaatatcatcccgcgtgaggcggccctggacatcgaaaaagccgcgttgctgtcgggcatcaatgtgcgccagttggccgatggcgtggcggctaccggtcattcgctgatgccattgctcagcgccctgcaaaagaactgcagcccgagtgcccgcgaatacgtgcactacggcgccaccacccaggacatccaggacactgcccagtccctggaaatgcgcgacgtcctcgacgccatggaccaggccctggaaaccttgctgggcaaattgtcgacgctggccgatgcgcaccgtgattcgctgatggtcgccaggacccactcgatcccggcgttgccgaccactttcgggctgaaggtcgccggctggatcgatgagctgctgcgccatcgccagcgcctggccgaggcacgccagcgcgtgctggtggtgcagctgttcggcggggtcggcaccatggccgcgttcggtccggaggcgataccgatgctggagcgttttgccgagcgcttgtcattgcaggtgcccttgaccggctggcacgtgtcccgtgaccgggttgcggagttcgtcagcgccctggccatggtcacggcctcgttggcccgggtggccgatgaaatccgtacgctcaatcgctgggaaatcgctgaggtggaagtgggctggagcgaccagcagatcggcagcagcaccatgccgcacaaacgcaacccggaaggctgcgagcaggtggtggtgctggcgcggctggccaaggcccaagtcatgctcgcactggatgcgatgatccttgaacacgaacgcgattaccgcggcacgcgcctggagtggtgtgcggtcgcggacgtttcccactatgcgctgatggcgctgtcgatcctcaccgacaccatcgacgggctcactgtgaacgtgcagaagatggagtgcaccgcccacgcctacggcgatgccatctgcaccgaagccgtggtgttcgaaatggcgcgcaagctgggcaagagcagcgcctacgaaatcatcttcgaagtgtcccaagcgagccagcgcaatcacgtgtcgatccgcaccgcgatcgaggctgatgcgcgggtggttgccgccatggacaccggcgcactggctcggctgttcgagcccaggacccacctggggatgtccgaccgtatcgtcgacaacgtgctgtccaaactggcggcccgctaagcagtgatcacccaacagacttatcaaggagcgacacatgtcaaacattacggcagttgataaagccaaggttcaacagttttcggcgcgcatcatggaggactacggcaacaccctgcgtggcgccatgctctatattggcgaccagctcggcttgttcaaggccctggccgacggcgaggcggtgaccctggaggagctggcgcagaagaccggctataacgcccgctacctgcgtgaatggctgggcagcatggtcaccggcagctatgtgacctacgacgcgcccacgcgccgttaccagatgcctgcggagttcgtgccggtgctcgccgatgaagactcgccgtatttcgccggcggcatcatccagttgagcgtgccgttcgtgagcatggcacccaaggtcatcgaagcattccgtaatggcggcggctgcgccgaggaggcgttcccgctggagacttggaaaggcatggagcgcatgaccatgccctggtacaagcactacctggtgcagcactggatcccttccctggacggcgtcgaagagaaactcaagaccggcggcagtgtgctcgacttcggctgcggcgccggcctggcggcgatcaccatggccaaggcctatcccgaggcgcggattgtaggctgcgacttccacttgccctccatcgagttggcgcgggccaacgccgaggcggccggcgtgggcgaccgggtgcagttcgaggtgaacgattccgatgcgctgcgcggccagcaattcgacttcgtgaccaccttcgtggtgatccacgacgccaccgacccccagcaaatgctcaaggacctgcgcgcagccacggccgcagacggcacctacctgatggtcgaactcaacttgtccgaggagctgcacgagaacatgaacctgttcggccgggtgatgtacccgcagagcaccctctattgcatgacctgctcgctgtcccatggcggggcagggctgggagcgttcatgggcgagaagcgcgcccgccagatggcgcaagccgccgggttcagccacttccgcaaagtcccttcggagtggccgccgatgccggcgttgttcgaactcaagccctgacgtgggccatgcctgcgacggctgcctgaagttcgcagagtaaggcaatttagtggcccctttgtaactaaatcctcgccaaaattgcttttattttcaggtggttagccgaggatgcaaatgcgcactgtgggaatgatgctgattgcctgctccctggccggcggcgcggcggccgtgcaggccagggaattgcgcgagggcgacaagtacatgtgcagctggggcgcgggcactgctgccagggctcaggaactcaagttgtcaggggtatcgctgtacgccgctcggcagaagatccagagcatcaagttcagtaaatcgtggatgcacatgatggccatgggtattactgagcagacttatgacagtcgttcacggcttaagccggaggcgattcgcaagagcttttatcaggattgcctgcggtacaaggtggcgcgtaaataaccgagtgccacgcactggcgcttacaaatccacgacaaactcaatgtaggtatttgcatacaatcacccacttcttcatggaggcctgtatgcaagtgcttattcgagcggcaacagccgatgacgttgacacgctgtgtgctatccgcacctcggtggtgcaaaaccatttgagtcttgaacagatggccgacctgggcattaccccacaggcactggtcgataccctgagtgcggcgccctgcgcctggatcgcggaagtggatggccaggcggccgggttttccatggttgacctggccgaaggcgaagtgttcgcgatgttcgtgttgcccacctatgaaaaccttgggctggggcgccagctgatggcgttggccgaggcggcattgtttgaacaccacgacaagctgtatctggtcaccgacgggcgcgatgacattcgcgccaatggcttctaccagcgcctgggctggtccgtcgtgggccgtgtcgagggcgacgacgttcgttatgaaaagggcagggcgccgtaggccatggatgcgccgccgccagcgtccaacagcttgcgttatcttgcggttggcgtgctgtgcgtcgcggtgctattggggttctatttcgttcagatcaacgccaaggcagaccgccagcgtgaagacgccgccgaacgcctcgcgctgtgccgtcacctggaatgggtcgcgggtgcgaccgcttctcgtaacgacgagcttcgccaaacgtgcacgcaactgagcgatcagttattcaagcgggcgacgtcacattgattaataaccctattttataaacggaattgcttgaggaatatctgcgctacttgcaccaaaaagtggcaatcctattatccgttaccataaaaaacatgtggttattgaatgacttacgcaatatgtaatccgacgaaaggattaaaatattgttgttacaggtttttacagtcgctactatacccgggcgttcacctcccacggtttatgcatttttaaatcccaagtttccatcagctacttgggattttttttgcctgcgatttgacctggggattgaatttcagaacatttcatctggcgtcagagacgacgcaggaaggatttgacgatgtggcgggtggcatcggtggtgtccagttcatccagggcaccgtaggcataccactggcagtccacgatctcattgcatggccgtgcctggtcgatattcaccaccgaggcttcgaacacatggtgcagggtgtcgcgggtcttgagttcctgtaaatacagcaagccgtccacatttaatccggtttcttcttccaactcgcgttccgccgcgccgaccgggcgctcgtcgggctcgaccttgccgcctggcaacgcccatttggaccgggctttgcgcacgaagagaatatgctcctcatgtgcgcaaatgaccgttgcacgtattttcaatgcctgtacctcccgcagcgcgatcaatgtcataaaagtgtaatgcaattgtcatgctaagtggttatggcgtgccggggccggtatgtggatactgccggtttgacgaatacgagcgaggacattcaatgaagaccatacgctggggcatgatcggctgtggcaatgtcactgaattgaagagtggaccggctttctataaagcgccaggttcggcactggtggccgtaatgggcaggcgtatcgaagcggtgcgcgattatgcggcgcggcacggtatagcgcgtttctataccgacgcccaggcactgatcaacgaccctgaggtggacgccgtctacatcgccacgccgcctgacagccaccttgaatacgcgctgatggtggcggcggcgggtaagcattgttgcgtcgaaaagcccatgtcgctgaacgctgaacagagtgcgttgatgcagcgcaccttcgaacgcgccgggctgcatctgtttgtttcctattatcggcgctcgttgccccgcttccagcaagtgcgtacctggttgcaggaaggtcgtatcggtgcattgcgccacctgacctggaccctgtgcaagccggctgctgcagctgatagcagcgccgccaattggcgcaccgacccggcgattgccggtggcggatatttcgccgacctggccagccatggcttcgatcttttccagtacctggctggcgatatcgtcgaggtctcgggctataccgcgcgacaggccggacgctatgcagcagaagatgcggtaaccgcctgctggacctttgccagcggtgcgttgggcatgggctgctggaacttcgtggcggaccgtcgtgaggatcgtgtcgagttgatcggtagcctggggcgcatccagttctcggtgttcgaggaccagccactgcgccttgaaggcgagaccaccgaagtactggaagtgccatgccatgcccatatccagtggcaccacgtactgaacatgaacgcccatattcgcggggaggccgagcatccgtcgctggcgatcgaggcgttgaagaccgatatcatcctggacaaggtgttacaacgttactcccagcatccctagccgttgcaatagcgtgaggcttcattttttcaaaggaataccgggatgaaatactggatggtgttgtggctgctgatcgctacaggtgcaacggcggcgtcgcgcaaccaagggtcggcaggagagtttgatttttatgtgctgtcactgtcgtggtcaccgacgttctgcctgacgcacccaggcaatgagcagtgctcgggcaagggctatgggtttgtgctgcacggcttgtggccgcaatacgcacggggcggttggccggcctcgtgtgcgccccagtcgcgcttgagcgatgaagaaatggaaaagggcgcggcgctgtttccaacccgtgcgttgctcaagcatgagtgggccaagcatggtacctgcagcgggctcgagccgctggagtatctggaaaggaccgacacggcgcttggcgtggtggttatcccgcaacagctgcagccgttcaatacaccgccgtcgatgcaggcacaggaaatcgaggcgctgtttcgcgagagcaacccacgcatgggcaatcacgggctggcggtgatctgcaagggcaaggtgctctcggaggtgcgcgtgtgcctgaccaaggacctggcgtttgccggctgcccgcgcagtgtgaaaagccagtgccgagacggtgatatccgtattcctacccaacgctgaatgccaattccagcagtgggtatggagcagggcagaggggcattttgttcaataccttgatcgttgcgcgcgttaccgtgatctcaacctcgtttggcatcacaagaaggaactgcaatgagcttgatcatttccatggccgctttcgccctcgccacctccatcacccctgggccggtcaatgtcgtcgccctgagcagcggcgcgcgcttcggttttgccgccagccagaagcatgtgttcggtgccgccgtcggcttcaccttgttgctggtgctgatcggcctgggcctgcatgaagtgctggtgcgctggccgatcctgacccaactgatccagtggggcggggtcgccttcctgctgtacatggcctggaagctggcagtggacgatggtcgcctggacgccgacggtacggcaaccgcgccgtcgatgttgtacggcgcgatcatgcagtggctcaacccgaaagcctggctggcatgcgtggcgggcatgggcttgtttgcggccgatggcgacgctgggcaggtgtggttgtttgcggcgctgtacctggtgatctgctacctgtcggtggcgtgctgggcgtatgccgggacatttttgcgccgctacttgagcaacccccggggcgtgcgcctgttcaaccgctcaatggccgcgttgctggtggccagtgtgggttatttgctgatggcttgaggttttcgcggtactgccccggcgtagcggcgaagtgctgtttgaaggtgcgctggaaatgcgcctggtcggcaaagcctgcggccagggcgacgtcggcaatcagtgcaccgttgcgcagttggctgcgggcgaactggatgcgtcggttgaccatgaacgcgtggggcgtcaacccgtaatactgcttgaatgcgcgtatcagataggacggcgacagctcggccgcctggcaaatgtcttcgagtttcaatgcctcgatgcagtgggtgcggatgtactcggcggcgcgttccagcttgtggttgacctcacgcaccggtgccagcgaaggattgaggcgctgttgcacctcggtgaaatagctcaccagcgcgctttgtttctgcagcaggtcggcgtgctcgtccagcagtatgcggtacagttcaagcaagccgtggtacagccgcgtgtcgcgggtgtgaggcgtgtcgaatggccgataaccctgctcggtgctgaaacccagttggtattgcaggtcggtcagccacggcgtgtcgaggtacagcatgtgataggaccaaggctggtcatggatagggttgcacgcatgcacgtcgcccgggttcatcagcaccaccgtgccggcgccgatctcgaaggtctgggcaccgtagtgataataactgcgcccggtggtgatcgcgccgatggagaagtgctcgtgggcatgccgggtgtaagtgaccttgcgcccgtcggcgatggtccgcgcctcgatgaacggcaagcgttcgtcgcgccagaaaagcggtgctgtagcggcggtcatgggcaggcgctcccgggcgttgatcaagtgagcaagcagccttatacaaaacccgggattgttcaagcctcagtgatctacgagcgccaggccacgcaggtaatcggcccaggggtcgctgccgctcgcggcggcctgcaggctgatcggcaacctggcttgttgacgcaaggcctggctgtcgtgcagcaggtgctgttcgacaatgaaccgcgtgagtgcataactgcgcggtgagtcgagggtagagggcacccgccgacccaggctgtcgggtgcgggaacgtcgtccacactgggcagttcatgctcaagtttgtcgagccgcaggtcggtatcgaccggcgtcaaggcaacctcgacaggtgcggctccgcgtgcatacgccggccagtcgaagcgcatcaaggcagggtcgctggcggtgtcgaccgcttgcatgacctgggcgtaatccaagtcacgtcgtggacgaatcaataactgcttggggaaaaactcgtagaaatccaggttggtgaagtaggtgacatacaccaacacgcccagccgacccacttcgctggaggcacttggtcgccgtcggttcacgctgaaaaactgtacgcggccatattccagggcttcacgtcgcggcaaggtcaggtgcgacagccaataacgaatggactctccatatgcggccttcaactgttggagcttgaggtcaaaggcgacggcaaatactgtattgatccgccccagcagatgaaagcgcttggccatttcccgatatttgatcgccgggttcgaggaatgccagcgggttgaggtggtgtccaggctgccggccatgtgcaggtcgacgaaggaatacttagggcctgtatgcacatcctcaaagcgcccctcttcggagaacggcgagttttccggcagccacatcaacacgcgctcttcgagcaggggagtgtcggggtagaccttgcgcagatcctccagggcggtctggcgcaaagtgacaatgggctgggcaaacgcccgcagcgttgaggccaggcgtgcgcgttggaagttgagcgcctggcttgcgctgttcaacgcttgtgtaccgctgcgagactggacaggcaatacgccgttggcctcggcccagtccaggatcgggccggacgcttcgttgctggccaggaagcgcttccagccgccttccgggttcaggtaggcgagggtcatgatctgcgggtagctcaactgacgggacgaccctgtgacgaccttttccatataactgacgtactgacggaacagcacccaggcctgggagctcaggcaaggagtcgactcggggatgtcgcgcaccagcaagtgcgggctttttgcgcagagcagcagatgggcggcgagcgccgcgactggagcgctgagcccagacaggctgacttcgatctgatggcgggcgaaggacgccgattcgccccagaagtaggtgtcgtgccagtcgatgtagccgatacgagtgggatgcacatgcggctcgggatccaggctcaagatcaacgccgccaggatcagcgcgttgcgactgccgctctcggtgcgctcactcgcatggccgccatgccagtgcagcgtgttcgagaggttttcgcccagttgctgggcctggggggaggccagcaggcgcaggagcagaaagtccgcctctgcgcgcacatcagccactgacttgcctgccaggccagccccgccaagcgtttcaaacagcgggccgtccttgcccgccatgaatgcttcgctgatgatcaagacctgctggcgctccagcgttgacaactgccacgccgtcggctgccagccggtcgagggtttcagggcccgccaccaggcgcgatcactgaccgacagcggttggctgactgccaggcgctgcaaggtgacgcgggcctcttccagtgtgcggggcaaactgaattggtagagcttcagcgcctgggcgagggtgacggtggtgtaggggcgcaaatagccaccggtcttggcggccacatcttgaagttggcgtaccaacgccgccagcctggggtgctccagggccgggtcggtcagcgatttccacgtgccttccacgtcgtaggcgccgaggctgccggagtcgctcagtactacggggctggaggggtcaatgcgttcgcgaagacgcagggccaggaagtcggggtcatcggtcagcacgcgcaattgcccataggccttttctaccgtggcctgaagcgtatccggatcgccgctgaccggcatttcaaggccgtcggagccttgcaatgtacccgcgtcgatggccttggccagcgcagtgcgcaacatatacaggtcgttcaacaggccgacatagtgttggtaacggtacagctcagcgaaggagcgcctggcattgagcaccaccggcacgatcggcgtgggcacctggcgcaggcgtccgaccagggctttgatcgccgacacgctccaggggcgctcgatggcgtaggcctgcaaggccgcggctacgctgaggctgtggtccgggtaaagatcggtgcccagctggttgccgaaggacgccagcttgtcccagcgtgcgtcaagattggccgggacaaggaagctcaacgcttgctcatcgccaggagtgggtacccccagctgttggcgttggcagtcgaagtacactgaggccgatgtggccgtggtcgccctcagatcgttttcatccatgatcgcctgcagcaggcccgctgcatccttcaaggttctggccagccgtgaatcggacaccagttgcaggcgggtacgataaatatccagggccgaaaaagcatcactgtcttgagcaagccgctccagcgcatcggtcagctgttggcggtcccgcgcctgctcggtcaattcggcgtagatcatcgacttgctgcgtccgttgtcgtcaaaccccgggaaactgcccaaggtcgctagttcttcgacaatcgtccgagcctgtaagtgattggccggcatcggcaagccatagaaggccagtgtcaggttcagcgccagggtcggggccatcgcctgccgttgcggttcgagagccggcatgcccagctccatcggatcgaccagttggctgatagaaataatcgggttggcgtgggcccaccagcccgacgcgtcggccagcttgaagactctgggctggccgcctacggtggcactcaggctgctgctgtggacccgcaggctctcgggctcgatgccttgggcgttgacccaggccctgaaggccttgccgttgatggctttgtcgaaggctgcgcgccattggccgagcaatgagcccgcggcaattggtacggggtacgtgggaggcgcaagggcctggttcgcggggatggacagcagggcggtcaattgttcgatcaggttgcgctcaccttcggtgagcaaggcctggcgttcgctcacaaagctggtcgtcggtttgagcgtgaccggcaaagcggtatcgctgggcaaggcgtcccaggtgagggccagggtgcgaaagtcttccatgaatgcggttccggatttgaggacaaacccggatgttcacatgggcgattggcgcctcaatagcggggggttcctgtaacggcgtggcttgtatcagccagggccgcgaggaactgcacaagtgcgccactggctgtatcgactgtcaggccaccaccgggggcaagccgctcacatgcaagcaagcccctgccatatttcgccctgcgttccgtcaggcaggttccaggaaggctgccttgagcaactgccgggtatacgcgtgctgcgggtcagcaaaaatatctcgcgcatcaccttgctccaccacctggccttgcttgaccaccatcaactggtgactcagcgccttcaccaccgccagatcatggctgataaacaggtaggtcaggttgtacttggcctgcaggccgcgcagtaactccaccacctggcgttgtaccgtgcggtccagggccgaggtgggttcgtccagcaaaatcaggcgcggcttgagcaccagggcgcgggcgatggcgatgcgttggcgttggccgccggagaactcatgggggtaacgatggcgggattcggggtccagccccacctctttgagcgctgcgatgatcgcggcttcctgctcggcaggcgtgcccatcttgtggatgcgcaggccctcgccgacgatctcgctgacgcacatgcgagggctcaggctgccgaacggatcctggaacaccacctgcatttcccgccgcaacgggcgcacctgctgctgggtgagcttgtccagttgctggccttcgaagcgaatcccgccttggctgccgatcaagcgcaggatcgccagccccagggtggacttgcccgagccgctttcacccacaatacccagggtctggccctggggcaggctgaagttgataccgtccacggccttgacgtagtcgacggtgttgcgcaaaaagcctttcttgatcggaaaccagactttcaggtcgtcgacttccagcaacggtgggcccaccgcgttgttggccggcccaccgctgggctccgccgccagcaactcctgggtgtaggggtgctggggtgactggaacagcgtctcgcaatcggcctgctcgacgatgcagccctgttgcatcacacacacgcggtgggcgatgcgtcgcaccaggttgaggtcgtggctgatcaacaacagcgccatgcccaagcgtgcctgcaactccttgagcagttcgaggatcttcaactgcacagtgacgtcgagggccgtggtcggctcatcggcaatcagcagttccggctcgttggccagggccatggcgatcatcactcgctggcgctggccgccggacagttcgtggggcagggccttgaggcgcttgtgcggctcggggatgcccaccagttccagcaactccagggtgcgctgggtggcgaccttaccggtgaggcccttgtgcaggccgagtacttcgttgatctgcttctcgatgcaatgcagcgggttcaacgaggtcatcggctcctggaagatcattgcgatgcggttaccgcgaatatgccgcagggtcttttccttgagggtcagcaggtcttgcccggcatattcgatggtcccggacgggtgccttgccaacgggtagggcagcaggcgcaggatcgaatgggccgtcaccgatttgccggaaccgctttcaccgaccaacgccagggtttcgccacgcttgatgtcgaagctgacgtgattgaccacgcgatggagatgctcgcccgtgacgaactcgacactcaggtcgcggatttcgatcagattgtcctgagtcatctcatttcctcgggtcgaacgcatcgcgagcggcctcgccgataaacaccagcaaactcaacatgatcgccagcaccgcgaaggcactcatgcccagccacggcgcctgcaggttggatttgccctgggctaccagttcacccaacgacggcgaacccgccggcagcccgaagccgaggaaatccagggcggtcagggtgccaatggcgccggtgaggatgaagggcaggaaggtcatggtcgagaccatcgcattgggcaggatatggcggaacatgatcgcgccgttctgcatgcccaacgcccgtgccgcacgcacgtattcaaggttgcgcccacgcaggaactcggcacgcaccacgtctaccaggctcatccacgaaaacagcagcatgatccccagcagccaccagaagttgggctgcacgaagctggcgaggatgatcagcaggtagagcaccggcagcccggaccagatctccagaaagcgctggccggccaggtcgacccagccgccgtagaagccctgcaaggcaccggcaatcacgccgatgatcgaactgagcacggtcagggtcagggcaaacagcaccgatacgcgaaaaccatagatcactcgcgccagcacatcacggccctgatcatcggtgcccagcaggttggtgctcgaggggggcgcgggggcggggaccttcaggtcgtagttgatgctttggtagctgaacgggattggcgcccagagcgtccaggcgtccttggccttgagcaactcctggatgtacgggctcttgtagttggcttccagggggaactcgccgccgaaggtggtctccgggtagcgcttgagtgccgggaagtaccagccgccgtcgaagtgcacggccaggggcttatcgttggcgatcaactcggcgcccaggctcagcacgaacaggatcaggaacagccacagcgaccaccagccacgcttgttggccttgaaccgctcgaaccggcggcgattgaggggggacaggttcatctcaatgctcccggctggcgaagtcgatacgcggatcgaccagggtgtaggtgaggtcaccgatcagtttcacgaccagccccagcagggtgaagataaacagcgtgccgaacactaccgggtaatcgcggttgatcgccgcttcaaagctcatcaggcccaggccgtcgagtgagaagatcacttccaccagcaacgagccggtaaagaagatgccgatgaaggccgaagggaagccggcaattaccagcagcatcgcgttgcggaacacgtgaccatagagcacgcggtggttggtcaggcccttggccttggcagtgaccacgtactgtttgttgatctcgtcgaggaagctgttcttggtcagcagggtcatggttgcgaagttgccgatcaccagtgcggtgacgggcagggccaggtgccagaagtaatcgaggatcttgccgctccagctcaactcgtcgaagttgttggaggtcagcccgcgcaatgggaaccagtccaggtagctgcctccggcaaacaccacgatcagcaggatcgcaaacaggaacgccgggatcgcataaccgacgatgatcgccgagctggtccatacgtcgaagtgactgccgtgacgcgtggccttggcgatccccagggggatcgataccaggtacatgatcagggtgctccatagcccgagggagatggacactggcatcttttccttgatcaggtcgatgaccttggcgtcacgaaagaagctgtcgccgaaatccagctgggcgtagttcttgaccatgatccacaaacgttccggcgccgacttgtcgaagccgtacatcttttcgatttcctggatcagcgccgggtccaggccctgggcaccacggtagctggaaccggccaccgccacttcggcaccgccgccggcgatgcggctggtggcgccgtcaaaaccttcgagcttggcgatcatctgctccaccgggcccccgggggcggcctggatgatgacgaagttgatcagcaggatcccgaacagtgtggggatgatcagcaacaggcggcgaacaatataggctagcattcaatcgcctccgctcgccctatcggcgttttgcgtggggtccagggagaccgcaggcttgacgtcgggtttggcccaccaggtggccgtgcccacgtcatagcgtggtgagaccttcggatggcccaaatggtcccagtacgccacgcggaaggtcttgatgtgccagttgggaattacgtagtaaccaaactggagtacgcgatccaacgccctggcgtgggctatcaggctttggcgcgagccggcatcgatcaactcttccaccagttggtcgacagcggggtccttgaggcccatatagttgcggctgccgggcttgtcggcgctggaggacttccagaattcgcgttgctcgttacccggcgaagtggattgcggaaagctgcccaccagcatgtcgaagtcccgcgagcgcaggcggttgacgaattgggagacatccacccgacgaatcaccaggtcgatgcccaggtccgccaggttgcgcttgaatggcagcaggatgcgttcgaactcggtctgggccagcaggaactcgatggtcaccggcttgccgctggtgtcgaccatcttgtcgtcgacgatcttccaaccggcctcttgcagcagttggtaagcctcgcgctgctgggtgcggatcatgccgctgccatcggttctggacggctcgaaagcctgggtgaagacttcggcagggatcttgtcgcgcaacggttcaaggatcgccaactcatccgggccgggtaaaccggtggcggccatttccgagttttcgaagtaactgcgggtacgggtgtaggcgccattgaacagctgcttgttgctccattcgaaatccagcaacaggctgatggccttgcgcacgcgcacgtcctggaacatcggcttgcgcgtattgaacacgaagccctgcatgccggtggggttgccgttgggaatttcttccttgatcaagcggccctgggtcactgccggaatgttataggcattggcccagttcttcgcgctgaactccagccagtagtcgaactgcccggccttcaaggcttccagggacacggtgctgtcgcggtagtaatcggtgatgcgggtatcgaaattgtagaagcccttggtcaccggcaggtccttggcccagtagtccttgacccgctcgtagcgaatcatgcgtcctggcttgacctccgccaccttgtacgggccactgcccaggggaatttccaggttgcccttggagaaatcgcgagtcgcccaccagtgcttgggcagtaccggcaactgcccgaggatcagcggcaattcacggttgttggtgcgcttgaacttgaacagcacccgtagcgggtcttcggccaccacttcatcgacgtcggcgtagtagttgcggtacagcgggttaccgtccttgatcagggtctggaaggtgaacaccacgtcttcggcgcggatcgggtggccatcgtggaagcgtgcttcggggcgcaggtagaaacgcacccagctgttgtccggggccttttcgatcttgccggccaccaggccgtattcggtaatgggctcgtccaggctttgcacggccagagtgtcgtagatcaactgcaggttatccgccggcacgcccttgctgatgtagaggttgaggctgtcgaaaccgcccatggccgattcacggaaggtgccgcccttgggggcgtcggggttcacgtagtcaaaatgcttgaagtcggcggggtatttggggggctcgttgtagagggtcagcgcatgttgcggggcggcttgcgctgcggtgcacagcaacaggctggcgagcagggtagtacgcaaagacatcattgggctttctccgaagctttcagccaccacgcgctcaggcccaggctatagggcggcgtggtgacgaaggcgaaccggttgcggtacgccaggcgatgatagttgaggtaccagttgggaatgctgtagtgctgccacagcagcacacggtccagggcacggccggcggccagttgttcttcgcgggtctgcgccgccagcagttggtccagcaggtgatcgaccaccgggttggcgatacccgcgtaatttttgctgcccttgatcgcggcctggctggagtggaagtactgccactgctcaagaccggggcttaaggtctggttgagggtcatcagaatcatgtcgaaatcgaattgatcgaggcgctgtttgtactgtgcacggtcgaccgtgcgcaagcgggcgtcgatgccgatgcgggtcagattttcgacataaggttgcaggatgcgctcaaggttagggttgaccagcaggatctccaggcgcagcggttgcccgtccttgttgagcaggcgctgcccttgtcccgatagcttccagccggcgtcgccgagcaaggccagggcgcggcgcagggtgtcgcgggggatgccgcgaccgtcggtttgtggcaggttgaagggtcgggtgaagagggcggctggcaattggtcgcgataaggggaaagcatcaaccactcatgcccggtcggcaggccgctggccgagaattcgctgttggggtaatagctcaccgaacgtttataggcgttgctgaacagggtgcggttggtccattcgaaatcgaacatcaaccccagggcttcgcgcaccttggcctggctgaacgcgggtcgccggctgttcatgaacaggccctggctctgggtggggatctggtgggcaatctgcgccttgatcacgtcaccgcgattgaccgccgggaagttgtagcccgtggcccagtttttggcctggtgttcgatatagatgtcgaattcgccggccttgaaggcttcaaaggccacatcgctgtcgcgatagaactccacgtcgactttatcgtagttatagaagccgcggttgaccggcaggtccttgccccagtaatccttgacccgctcgaacactagttgccggccaggggcgaccttggtgatgcgataaggcccgctgcccagcggcggctcgaaggtggtggccttgaaatcgcggttcttccagtagtgcatgggcagcaccggcagctcgcccaggcgcaggatcagcaatgggttgccggcacgcttgaatacaaagcggatgcggtgacggttgaggatatccacccgcgccacttcctgcaggttggtgcggtattgcgggtggccttcggtcagcagggtacgataggaaaatgccacgtcatcggcagtgatcggcttgccatcgtgaaagcgcgcctcggggcgcaagttgaagaccacccagctgcggtcttcgctgtattccactgactgcgcaatcaggccgtagctggaggtgggctcgtcgccggatggcgcgtattggccggtgccgaccatcaagggttcgttcagctcattgacgccgtattgcaggaaattgccggtggccaccgggctggtacccttgaaagtataagggttgagggtgtcgaaggtgccaaaccccatgatccgcagtgttccgcctttgggcgctgcagggtttacccaatcgtaatgggtgaatttggccgggtacttgagtgagccgaactgcgcgtaaccgtggctctcggtaatcgtcgcgttcgcagcaaagctcaaggccagacttattagtagaaggagaggacgcttcaagtcagagatccgatccaggcggcttgggctttatgatcggtacagtaacagcttgttccggttggaaaaagactgctgagagcacccagagcctaatgtgggagggggcttgctccctcccacattagcctaccggtgttcttgagggctttatcttggcccggacaccaccagcatctgcccgggcttcaacgcctggccggtgcgcgggttccaacgcttgagatgttgcatctcgacgttgaagcgcttggcgaccatgtacagcgagtcgcctttcttgaccttgtactgcaccggtttcttcgccgcggctttacgagtgtcctgcatcaccagggtctggccgaccttgagggcctggccgttgagcttgttccagcgttgcaggtcatgcacgtcgaccttgttggccttggcgatcaaggtgaggttgtcgccactgcgcaccttgtagttgcgggtgcgcccggccaccgacttggtctcgacttcgtcgaacaccggctttttcgggcgcatgctcagcaattcttcgggcttcatcgtcgaaagggtgctggtcagcaactgggccttggaagtgggcaccagcaaatgctgggggccgtccagggtagtgcgctgcttcaaggccgggttgagttggaacagttcgtcttcgtcgatctcggccagcgccgcaacccttgacaggtccatgctctgcttgacttcgactacttcgaagtatggcgtattggcaatcgggttcaggttgacaccgtaggcctcgggcgccagtaccacttgggacagggccaggaacttgggcacgtagtccttggtttcctggggcaggggcaggttccagtagtcggtgggcaggccgagcttttcgttgcgctcgatggcccggctgaccgtgccctcaccggcgttataggccgccagggccagcagccagtcgccgttgaacatgtcatgcagacgcgtcaggtagtccagggcggcggtggtggaggcggtaatgtcgcgacggccgtcgtaggcacgggtctggcgcaggttgaagtagcgcccggtggagggaatgaactgccacaagccgactgcatcgctgcgcgaataggccattgggttgtaggcactttcaatcactggcagcagcgccagctccaagggcatgttgcgttcttcaaggcgttcgacgatgtaatgaatgtagaggctgccgcgttcgccggcgttctcgaggaaggacgggttgctggcgaaccacaggcgctgttgctcgatgcgcgggttgacgccgacgccgtcctgcaattgaaagccccgacgcatgcgttcccagacatcctggggcacttcggggctaggcttctctgatagccaaataggtttttgcttgatcttggcagcaagattgggtttgggttgcacggtggattgtgcagcgtaatgggtcgattggcagcccgccagagttgcggagacagccaccgccacggcttgagccaggcgggtcaatgcgtctgaagaaatggatttacgaatagatgacgacattggctggaagtaagttccgggcaaaaatgtcgggcgattctagaaagcgcttcggttccggtcaaccattcagaaattacgtatcagaatacgtcctcttagaacttatctttccaagccctcaagctagcaaacacctcggccccagagcggttgtcgcggccattccgttcgtccgctttttgtttaacggatgtttcagcggtacgcaggaacgggttggtacgtttttccagggccaaattggaaggcagcgtcatctcgccgcgagcccgtagttgggcaacgttttccagccgttcggcgatgtcggcgttgtgcggttccacggcctgggcaaacttgagattactttgtgtgtattcatgggtgcagtacaccagcgtatcggcgggcagggcggccaggcgttccagggaggcatgcatctgctccggcgtgccctcgaacagtcgcccgcaaccggcggcgaacaaggtatcgccacacaacagcaccccttcgtgataaaaggcgatatggcccagggtatgccctggcacggcgtagacgtcgaagtcccagcccagcacgttgatacggtcattgtcctgcagcgccacgtcccgcgccgggatcttttcgttggccgggccttggaccttggcgccggtcacctgtttcagttgctcgacaccgcccacgtgatcatggtgatggtgggtgaccaggatgtcgctgagggtccactcggcgttctgctggagccaggccagcactggcgcggcatcgccggggtcgaccacgacgcagcgccgggtggcggggtcttgcaacaaccagatgtagttgtcggtgaaggcgggtagggcactgatctgtatcattcttcgattcgccaagctgaacacattggtgcatcttagaacgtctaggcgagttggagaatgcaatgaccgataaagcgttcgcccaggccgatcctgagtggctggccctgatcagtgcggcccgtgaatggttgtccgggccgattgggcaatttctgctggatgaagaacgacgcatgctcgatgacgagctgggccggttcttcggtggctacctggtgcattacggaccgtcggccgaaaccccgccgtcggcaccccaggtgcaacgcaatgtgcgcttgggcgcgccgctgccgggggtggaaatcgtctgtgaggaacaggcctggcccttgagcgaacacgccgccgacgtggtggtgttgcagcatgggctggatttctgcctgtcgccccatggcctgctgcgcgaagccgcgagcagcgtgcgccctggtggccacttgctgattgtcggtatcaacccctggagcagttggggtttgcgccgtgtattcgcccatgacggcctgcgccaggcgcgctgcatctcgccgtcgcgggtgggcgactggctgaatctgctgggcttcgcgctggagaaacgtcgcttcgggtgctatcgtccgccgctggcgacggccaagtggcagggtcgcctggccggttgggagcgccgggcgggggcctggcaactctcgggtggcggcttctatttattggtggcgcgcaagatcgtggtagggctgcggccggtgcgccaggtgctgcgccaacccatgggcaagctggtgccgatgccgatggccaaggtcaaccgcgagcgaagcgaaccctaacctctttattgatttcaggccgggctgcccggcctcgggatactgtcggtcaatgaccgccagcccgtcttgatggatgcaaccgatgaccgatagcgtagaactcttcaccgacggcgcctgcaagggcaaccccggcccgggcggctggggtgccctgctggtgtgcaagggcgtggagaaggaactgtggggcggcgaagccaacaccaccaataaccgcatggaactgatgggcgccattcgcggcctggaagagctcaagcgtcgctgcaacgttctgctggtgaccgactcgcaatatgtgatgaagggcatcaatgagtggatggtcaactggaaaaaacgcggttggaagaccgcggccaaggagccggtcaagaacgccgacctgtggcaattgctcgacgagcaatgcaaccgtcacgacatcacctggaaatgggtgcgtgggcacatcggccaccctggcaacgagcgcgccgaccagttggccaaccgtggggtggacgaagtacgcggctacaagcagagctgaagccggcccacgtgttaacatcgcgccctttgattcacaccacaccgttgagagctgaaccctgatggccatccgatctgttgtactcgataccgaaaccaccggcatgccggtgaccgatggtcaccggatcatcgaaatcggctgtgtcgaactgatgggccgccgcctgaccggccgccacttccacgtctacctgcaaccggaccgcgacagtgacgaaggcgcgattggcgtccacggcatcaccgacgaattcctcaagggcaagccgcgttttgccgaagtggccgatgagttcttcgagtttatcaacggcgcccagctgatcatccataacgcggcgttcgacatcggctttatcaacaacgaatttgccctgatggggcagatggaccgtgcggacatctcccagcactgcacgatcctcgataccctgatgatggcccgcgagcgtcaccctggccaacgcaacagcctcgatgccctgtgcaagcgttatggcgtcgataactctggccgtgaactgcacggcgccttgctcgactccgagatcctggccgatgtctacctgaccatgaccggcgggcagaccagcctgtccctggccggtaatgcctcagacggcgccggatcggcggaaggctccggcaaccgcccttcggaaatccgccgtctgccggctgatcgcaggcctacgccggttatccgggccagcgagcaggatttggccgagcatgcggcgcggttggaagcgattgccaagtcggcgggtgcgccggcgttatggacccagttgacccaacaataacccggactcaatgcagtaaaaatgtggagggcaagccccctcccacagttgacccccatcgtctttgaaatcttcattcgccacattcgctcccagcttctacccttgagtgcaaagcctccggagtaagagcgctcatgtacaaagacctgaagttccccgttctgatcgtgcaccgtgacatcaaggccgacaccgtcgccggcgaccgggttcgaggcattgccagggagttggaacaagagggcttcagtatcttttctgccgtggactacgccgaaggtcggctggtggcctctactcatcacggtttggcgtgcatgctgatcgcagcggaaggcgccggagaaaatacccatctgctgcaaaacatggtcgagctgatccgcctggcgcgggtgagggcgcccaacctgccgatctttgccttgggcgaacaggtcaccctggaaaacgcccccgccgatgccatgagtgaactcaaccaactgcgcgggattctctatctgttcgaagacaccgtgccgtttctcgcacgccaggtcgcccgcgctgcgcgttcctacctcgatggcctgctgccgccattcttcaaggccctggtgcaacacaccgccgactccaattactcttggcacacccccggccatggcggtggcgtggcctatcgcaaaagcccggtggggcaggcgtttcatcagttcttcggggaaaataccctgcgttcggacttgtctgtttcagttcccgagctgggctcgctgcttgatcacaccgggcccttggccgaagccgaagcccgcgccgctcgcaactttggcgctgaccatacgttctttgtgatcaacggcacgtccactgccaacaagatcgtctggcattccatggtcggccgcgacgacctggtgctggtggatcgcaattgccacaaatcggtgttgcactcgatcatcatgaccggcgcgatcccactgtacctgtgccctgagcgcaacgaactgggaatcatcggcccgattcccctgagcgaattcagccctgagtcgattcgcgccaagatcgacgccagccccctgacccgtggccggcctgcgaaagtgaagctggcggtggtgaccaactccacctacgacggcctgtgctacaacgccgaattgatcaagcagcaactgggcaacagtgtcgaggtgctgcactttgacgaagcctggtacgcctacgccgcgttccacgagttcttcgccgggcgctatggcatgggcacctcgcgcaccccggatagccccttggtcttcaccacccacagcacgcacaagttgctggcggcgttcagccaggcatcgatgatccatgtgcaggacggcggcgcacggcaactggaccgtgatcggttcaacgaagctttcatgatgcatatctcgacctcgccccaatacagcatcatcgcctcgctggacgtggcctctgcaatgatggaaggcccggccgggcgctcgctgctacaggaaatgtttgacgaggccctgagttttcggcgtgcgctggccaacctgcgcctgcatatcgctgccgaagactggtggttttccatctggcagccaacctcggtcgccggtatcgaccgggtcgtcaccgcggattggttgttgcaccctcaggatgagtggcatggttttggcgacgttgccgaagactacgtattactcgacccaatcaaagtgacgctggtgatgcccggcctcaacgccggtggcgccctgagcgactgcggaattcccgccgcggtggtcagcaagttcctctgggagcgtggcctggtggtggaaaaaaccgggttgtattcgttcctggtgttgttttcaatgggcatcaccaaaggcaaatggagtaccttgctcaccgagttgctggagttcaagcgcagctatgacgccaatgccagcttggtcagttgtctgccgtcggtgtatgcccaaggccccgcgcgttatcaggggatggggatgcgcgacctttgcgaccagttgcacagctgttaccgtagcaacgctaccgccaagcatctcaaacgcatgtatacggtgttgccggaaatcgcgatgaagcccgccgatgcctacgaccagttggtgaggggcgaggtggaggccgtccctatcgatgccttgcctgggcgtgtcgcggccgtgatgctggtgccttacccgcccggtattccgttgatcatgcccggtgaacgctttaccgagtcaacccgttcaatcatcgactacctggcgtttgcccgtacgttcgatagcagcttccctggttttgtcgcggatgttcatgggctgcaacatgaagatgacggcagtggccgttgttacaccgtcgattgcatcaagggctaaggatgtttatgcaagcagtaatgaacccgaagtatccagggctcagtgtgcgggtcgccgatgaagggttcgacccctatgtatggggcaatgacttcagcttcgaggtcagcgcctatgctgtgccgcagatgggcctgcgtgtcgatcagtggcctgtggagcgcgttctgccgtaccgcaagtgctacggcattgacccggaagagttcgccagctttcgcgacgccaccgacagcgcgatcttcatggcctacctggatgaccgtgcggtggggcatgtagtggtcagcaccaactggaacggttttgcccacgtcgatgagttggccgtggtgttgcctgcgcgacgccatggtgtggccaaggcgttgctggatgtggcgcagttctgggctcgcaaaaaaaacctgccgggcatgatgctggaaacccagaacaataatcttggggcctgccgcctgtatgagcgctgtgggtacgtgatgggcgggattgatcaattgcgttatcgcgggattgatccgcaaacccgtgaagtggcgatcttctggtatcggttgttcaagacggaagtggaatcgatctgacgcttaggctgtggattttgtgtcgccgcccaggagactttcggccttctgggtgacaatctccagcaaggcattcaacgccggtaaagtcgcatggtctttcagcgtcaatgcatacaggctgaccatgatcggcggcgacaccgggcacgcatccagcccgacctctcgcgcgccgaaggcggtgaaggggtcgacaattgccaagccttccccggcttccaccatgctgcgcatcatctggtaggtctgcacccgcgtctgcaccaccggcagtgggcgcagggcttgcagcttggcgtccagcaggcgactgagggggtcatgcccctcaagcccgatcagcgactgcccggccaggtcctgcaatgcaatgtacttttgctttggtttgagccacccatggggcgcgagtagttgcaatttgccctgggccagtacggtgctttggatttgtgcatgttccggatcatgcaggctcaggcccacatcggcttcgtgcagcagcaggctcctgacgatctcccgggtcggctggctcgacagattgcacggggtgtcctggaagcgtcggcgcagcatggcaatgctttgcggcaacagttggttggccaggggcggggtgcacagggcgcgcagtgtcggggcgtgatggtgtttcaaacggctggccaggcgttgtagcggttcgagcgcttcgtacagcgggccaatatgcgcctgcaactccagggtctcgcgcgtcgcttgcaggcggccgcgtacactggcgaacaacatgaaccccaattgcaactcggcatccttgagagtggcgtctacctcgcccacggggagttgcaaccattcggcggccgtgccgaggtgcccggtctgcaagatggcctgaatcacttcgatatgacgtaaacgcatggccggagtctatgtgcagcgcgatggggattcaatggtgcaaggctttgtgcgcaaaaaagactgcacgggtcgccctggcctatggcattcggtcacgacctcactagaatggcgcatctgatcagtaacgaccaatgccggcgttccggtacttaaaacaaaaacaggtctggtctcaaaatgcctctaccctcgacattcttcggggtgacggccaagcaactcctggtcctggtgaccctgggatgcgtggcggcttacctcttcaatgatcacgctgaacccacgccggaaaacctcgcactggaaacctttatccgttcacaggaacaggtgggtgaacaggtgggcgcggtgctgggcattaccttgattcggcaggtggaggcatatcccgcctataacgtgtcgggctacaagcgctccatgtacgccgtcgagggggagcgagggcgactcgtggtgacgctcaagcaaggcgagcagggaattgaagtgacagatatccgcaaaccctgatcctccggcccagttgccgccagcacgcgctgggactgggcgggtggataaggcgggatcttatgaggcgagggtggtttgcgattcgcggacgataatggtccccgactggatcaacttgaattcatcgccttccagtttttctacacggtcgccaatggccagcttgtaggtagtggagggcgtcgagccagccaggtcgccttgcgccgggttggattcctggaactcatgcaccgaatacacgcgaccttccgcgtctctggcatggaactgtccgactagtactgctgccatctgtttagaacctctggagataaacactcgatttgcggttctgtagaccgtcagggagcggggtagtttacctataagaaaaaaatactattcgctgatgttttcagacgcttcctacgcaattgattgcaaagaaagcgccgggaaaatcaccgggaacctctggtgaacacgccgcgaagcctctataactaccagctcctttattcagaagtcgggaaaacctcaatgagcaaggtctacacgatcgccgtcctggtgggcagcttgagaaaagagtcgatcaaccgcaaggtcgccctggccctggccgagctggcccccgccaatctcaagttgaacattgtcgaaatcggcgatttgccgctctacaacgaagacctcgagggagcaacaccgcccgcagcctacagtactttccgcaaacaggtgagttcatccgacgcagtgctgttcgtgacccccgaatacaaccgctccgtacccgctcctttgaagaacgccattgacgtgggttcgcgtccatatgggcaaagtgtctggggcggcaagccgggagccatcatcagtgtgtcgccgggtgccatgggcggtttcggtgccaaccaccacttgcgccagtcgctggtgttcctggatgtgtggtgcatgcaacagccggaagcctacctgggcggagcgggcagcgtgttcgatgaggcgggcaaagtgtcggaaaggtccaagccgttcctgcaggcctttatcgatgcctacggcaagtgggtggaaaaacagaaggcttgatctggcaatgagttcaagtgtgggagggggcttgcccccgattgcggtgtatcagtcagccaatgtttagctgacgcactgctatcggggcaagttccctcccgcattttttcttatcgcaaccagttagtccgcgccagttcaatcacctcatccccacgcccgctcatcaccgccttgagcatatacaggctgaaccccttggcctgctccagcttgatactcggcggcatcaccaactcttgagtggcggtgactacgtccacaagtaccgggccgtcatgggccagggcgcggcgcaaggccggttcgaggtcttcggactgctcaacgcgaatacccaggatgcccatggcattggacatggcggcgaagtcggggtttttcagctcggtgccggtgtccaggtagcccgcggctttcatctccatggcaacgaaccccagggacgagttgttgaacacgatgagtttcaccggcagtttcaattgcgccagtgaaatgaaatcccccatcagcatggtgaagcccccatcgccggacatggagatcacctggcgcgcgggaaatgccgcctgggcgccgatggcctggggcatggcattggccatcgagccatggttgaacgagccgatcagccggcgcttgccgttcatcttcacatagcgcgcagcccatactgtaggtgagccgacgtcggcggtgaagattgcgtcatcgtcggccagttcgctgagcaagcgcgctacgtattggggatgaatcggccggttggctttggacggttgtgccaggtcatccaggccttggcgggctttttcgtagtgcttcagcgaggtttcgaggaagctgcgatcagtcttgcgggtcaggcgtggcagcagggcgtcgatggtttcactgacatcggcggcgatgcccaggtccaacgtcgcacggcgaccgagggcctgcggatcgcggtcgacctggatgatcttggcgtcggtcgggtagaactggcgataggggaagtcagtgccgagcatgatcaaggtgtcgcagtcgagcatcgcatggtaaccggagctgaaaccgatcagaccggtcatgccgacgtcgaacgggttatcccattccacatgctccttgccgcgcagcgcgtgcaccaccggcgcgccgagggcatcggccaaggccaccacttgatcgtgggcgccggcacagccgctgccgcacagcagggtgactttctcgctgtcctgcaagatctcgctgaggcgttgcaggtcctgctgcgccggcaaggtgcgcggcgcatgcagggccggccagggcttgagcgtgtcttcgacttccagcagcgacacatcccccggaatcaccaccaccgccacgccgcgattgaggatcgccgagcgcatggcacggtgcagcacctggggcatctgttcggggttgctgaccagctcgataaagtggctgcactccttgaacaattcctggggatgggtttcctggaaataattcaggccgatctccgacgacggaatttgcgccgcaatcgccagcaccggcacatggttgcgatggcagtcgaacaggccattgatcaaatgcaggttgcccggcccgcaactgccggcacacacggtcaactcaccggtagcagcggcttcggcgccagcggcaaaggccgcgacttcttcgtggcgcacgtgcatccactcgatgctgtccatgctgcgcagcgcgtcggtcaagccattgaggctgtcgccggtcaggccccagatgcgcttgatgcccgcctgttcaagggtggtcgccaactgctgggccaggttgattttcgccatgaagaactccaatcgtcagtgagttgaaaagctgctgatcagtagaggacagttcgattacggcgaatgctcaccttatagtgtgaagattgcttcatggccacgcggtattggcgggtgcgccgggggatgaaccactggtcgcgtaccaacgccatgcacggggcgacgttggccttggtctgcccacccaaatttacagagccaagcagtaccaaatgtgggagggggcttgcccccgatagcggtggatcagccaacgaatctgttgactggcactccgtcatcgggggcgagccccctcccacattttgatactcagcgtcgacggaacagtggcaacggctcgtcggtggcggcctgataggtcaccgaaaagtccttgagactttccagtgcttcatacgggtctttgtcggcgcgcaaggcgaaggcatcgaacccgcaacggcgcaggtagaacagctggtcacgtaacacgtcgccaatcgcgcgcaattcacccttgtagccataacggtcacgcagcaggcgggcgttggagtagttgcgcccgtcggtgaaggccgggaagttcagggcgatgacctggaagtgttccacatcgtcaccgatttcctcggcttcttcatcggcgtccagccacacgcccaggccgccgtcgcgggccttgagggcgtggccgtgttcgcgccacagggccaacggcacgatcaggtcgtcgcagttggagatgccgtcgaagctcgcgtccttgggcagcaggtgccaggtttcgtcgacgacttcgttgttcttaatgattcgctgcatagacgcgctccttgaacaggtcgatgccgatgcgctggtaggtgtcgatgaaacgttcatcttcggtgcgctgttcgatgtacacgtcgatcagcttgccgatcacctcgggcatggcttcctgggcgaaggatgggccgaggatcttgcccaggctcgcatcacggctggcgctgccacccagggacacttggtagaattcctcgcctttcttgtccacgcccaggatgccgatgtggccgacgtggtggtgaccacaggcgttcatgcaaccggagatgttcaggtccagctcgccgatgtcgaacaggtagtccaggtcgtcgaaacggcgctggatcgattcggcaatcgggatcgacttggcgttggccagggagcagaagtcgccgcctgggcagcagatgatatcggtcaacagaccaatattcggtgtggcgaaaccgccttcgcgcaactcgccccatagggtgaacagttggctttgttcaacgtccgcgagaatgatgttctgctcgtgggaagtgcgcagctggccgaagctgtagcgctcggccaggtcggcgacggcatccagctgcttgtcggtgatatcgccaggggcaacgccggtgggtttcagtgacagcgtcacggccacatagcccggcttcttgtgcgccagggtattgcgcgtgcgccagcgggcgaaacctgggtgctgctggtcgagggcggccagctcggcgtcctggttggccagggccttgtactcagggtcgacgaagtgcttggccacgcggtgtacttcggcttcggtcagggtggtctggccgccgcgcaggtgttccatctcggcgtcgactttctgggcgaacacctcaggggtcagtgccttgaccaggatcttgatccgggccttgtatttgttgtcgcgacgaccatagcggttgtagacccgcaaaatcgcatcgaggtagctcaacaggtcctgccacggcaggaactcgttgataaacgcgccgaccaccggcgtacgtccgaggccgccacccaccagcacgcggaaacccagctcgccggctgcgttgtgcaccggctccaggccgatatcgtgcacttcgatggccgctcggtcggaggtcgagccgttgatggcgatcttgaacttgcgcggcaggtaggcgaattccgggtggaaggtggtccactggcgcacgatttcacaccagggccgtgggtcgatcaattcgtcggcggcgacgccggcaaactggtcggtggtcacgttgcgcaggcagttaccgctggtctgaatggcgtgcatctgcacggtggccagttcagccaggatgtccggcacatcttccagggccggccagttgaactgcacgttctggcgggtgctgatgtgggcgtagcctttgtcgaagtcgcgggcgatcttggccatcatccgcgcctggcgcgaagtcagttggccatagggcacggcgacccgcagcatcggcgcaaagcgctgcacataaaggccattttgcaggcgcagagggcggaactcttcttcgctcagttcacctgctaagtagcgtcgggtctgatcacggaactgcttgacgcggtcctcgatgatgcgctgatcgtattcgtcgtatacgtacatataggtcctgttctcggcaaatctgcgcgcacggccgcgcactcacaacggagccggcgcacgataccagtttgcgtatatgcgcaaaagtgatgtttgggtatatgtaaataaccaaaatgactaatgagaactgttatcgccatacccacatttgtcatgcgggcaatcatgatctttactgtggtcgagtcttagtgccgtcacctataaaaccgacaagaggcgatgcaatgagcaattccaccaaagcccgtaaacctgacagtaccgtggatgcctgggccattctgttcctgatcattctggtggtcgggaccgccgtgttctgggtcagccaccagtaataaagagggttgattgggcctcgattggctgtcggattgccactatcatgacgatccgttttccaggttcgagcaaccatgttgaaggttttgattgcgtgtgtgtggctggcaatatcggcgcacggggcgatggcccaggccgcgtcggtggtgtttctcaacccaggcacttctaccgaaaccttctgggtcagctatgcgcaattcatgcaggccgctgccaaggacctcggcctggatttgcgcgtgcgttattccgagcgcgaggcctttaaaacgttggcacaggctcgcgaagcgttgtaaggcagagagcggcccgactacctggtgctggtgaacgagcgttcagcctgcaactgctgctgcgctaaacgccggccaggtgcagcaccagcttgacgatgccgaacagcgtcaaggcaaataccacggtgaacaggatgcccagcaccacaaaatggctgggtttgccatgggtaaagtcgcgggcgcggttcttgccgctttgcacgccgaaggcggcggccatgacactgtggagcatttgccagaaggtcggtggtttgttgtcgattggatcgctcatgagaacctcgtcaggtgcagcgttctctagagcatagacaatgcctggggcagggcggctttacctgccttctttagccggttgcactcttaggtatgcaccaccgtccatggaccgcgcccaggtgcttgccgctcaagcatccgatgccgcagccctgtccatcttcgcttcattgagtcattggcgtgcatccgcaccgcgtattggcgatgcggatggggagcttatagcggcgttcactcagccccggggaggttccaagtcaaggaacagttgcttgtccagcggcggcctgatcgtggctttatccaggttgaccacggcgcggttttcagcaacagccctttcgatcaattgtttgcgcgtgagcaaccgctcggccggaagcttcaagtggccgaagctgtgctgcgcagcgggcgtttggacggtggggtagtggaaatgcgcgtaccacaagacatggggggtgcctttctcgtacaccgcgtattcgctgagaaaatccccggcagccagtggctcacgactcttggccaagttgatatcgacaaagccgtggcgccatagataggcaacattggatgccttgggcagctgtcgcttgtagccctcggcacacacctcacgggcgagcttttgcgcagacgcggcctcgtcccggtactgcttgatcaattcggcggcgttggcttggctggcatgatcgcgctcgatctcttcggccagggcttcgattttgcgcgcatgctggctcagcatgtcatcccagtccaatgggctgagcgtttcacgtcgggccgggtcttgaagttttctctgttgggcgcgaatcgtgcgttcgatacctgcccgttgggccatcacggtttcggcgctctgcctgatggtcttcagtgcgcgaacttttgcggctgtcgagggcgtggacggttttggtgtatcgactttggcccacacaccttcattgacatgttcatggtaggtctcgacagtttggccggtgagcggatccttgatgtcgacaaagctgccgggcatcgctgggtctgcggggcgcaagtcgcccaccagagtcatgtgcttgcgcgtcttgaacactctgcggctggcgggtttcggccgggtgggggcagctacgttaggcacatgggcgaagccttcctcggcgagaatcacatcggccagttgcgcttccaggctggtgcgggcgatcaccagttggtccaggaactctgtgcgataggcttcgcgcacaaagcctgagcccatgtccgtgagggcgttgaccgcgttctccatgcgctcatagcgttcgagcgcgctcttgaggacctcgatttgttcgctcgtggagtagccgctggtggtgcgcatttccgtatgcgccaatacgctggtggtgttcttgggatcggtgagttccttgataaaaggcagctccgccgggcttcgcgaaccatgggtgcgatccagcaccagttcggcaagaaacatcaggatgttctgttcgacggtgacggcggacaggtattggtcctcgggatgctctttcaacaggaactcgcgcagttccggatcagcctgcttgagtgtagtttcgatttttttggccggttcgagcatctctcgcaacgcttcgatctgcagttttcgggtttcaaggaacatctggtaggcgtaaggaatgccctcaggcagttcacggttgacccggtcaaacagttcttcggcattttcgccctggtcggtttcaaggatgtcggtaaacttttgcagcttggcttcgaacaccgagccccagtagtcataaagcgatctggccgcgacattgcgggttttcttatgtcttgcgtcggtgttatcggcctccatcagttcgcggcccttgtcctggatctgttgcatggtcgcattgcccagctcggcgtctttctggtaacgctcgaaggcgatgtcccactccagcttggccttcgtcgccatcgcacgcctttgctcatggcgcgcagcgagcttgtcctgcaagccagggatctcactcgccgtgcgcagcctcaaccagtcctcgcgtagcttttgtttttgattgaccagttcgacacgcgccttgtccagcgctgacttgaacggtagcgaagccatcgcccggggcaggaactccaggttcagtcgcgcaaggtctgcctccagcaccttcaagcgatcacgatgctggcgctcccatcttccacggcgctccctgggcatgccaccctccagccgcgccttgcgttccaggcgccaatgcccctggccgtcgccggtcagcttgaaaccggggcgcagggggtgttgtgggtccaccagatagacctcgccgaagccgggcaccacgctgacctggaacaacagcccgcccaggcttgcatgccaggtttcgccaatgcggtacaaacccttgaatgggccgctggcctgggcgacgggcaatgggtcgggccaaggtacgtgcaggtcgagcaataatttcaacaatttcgcaccggcctgggggctggcaatcgagcggctgaaatccagcggggtaagcccggtggcgggcggttcacctggcagcgccacctcaccatgacgtacctgaggcgcggcaggcgcctggacctgatgcgcagggcggcgccaggcggccagcgctggtggggcgtcctcgtgtgcctgcggtggggtgcgcggcgacgggctggcagcgtgcaacagcaccatggcggtgttgagcaataggtcgatcaaggccagctcgcgagtggtcgggtcgcggctgtccaggcccgccaggtcttgctgcaggctgccgaccagtaccaggaaccagccggccaacatcgccgggccgcgggtcagtggcaacagcagggtgttgaacagcagccaggcgccctccatcacgatggcccagcggctttcgctgttggacaccgactcgcggtccgccagctccaccagggcccgcgcggtgctgccaaacaaatggctgagcagttggccattgacttgcgattgcagccattcttcggcgccttcatccaccgccagggtcgcgggctcgggcttgtccgggatggcgaactcatccccggccagaaagcgaatgatgtgcggctccttgatacctccatgggcgtagatcggtcgcgccttgtcgctcagccaggtcagcacgctggcctgcaggtcaccgggagcggccagcgcctcaagcagtgcctggcgcgtggggtactgatacaacgcgtcggtgtacaaggggcgatacagcaagtgcgggccgatgctggcgtctcggggctcgatgatgaagacgttgttgacggtgtctggtgtggcaccggccttgcggcacagggccaggggccgcaggacgatctcctggccgtcgacaatccggtcgttcggtgtctcgcccatcagggcgtttacatagcggtagccctgggtggtgacaccgtattgctgcctgatcgcgaattccagtgccatgcgcggcagttgcaccttgagttcgcgagtaaagagttgttcccgacgccgcgcatcgtcgctgtcggacagcagcaggtccttgatcgtctgtgggtaggccgtaccgatgtcgacccgctggatcaggcccgaggagcccagcacgtaatcgtcagtcagccatggcggcagcgtgccgccatttttggatgacagcgtcagcgtgcctttgggtttgccggcgaggtttttcactgccagttcggtcagtgaaagcctgacgtggtcgataatgcccgcgccacctgggtagccggcggccacggcaaagtccagcagcacgtcgtcggggtcgtagtcgccatggtcggcctgcatctgcttgcgcagggctgcgcggctgaaatcatgcaggttttcgatgccctcattgtaggaacgcccctggttgacccgcagtaccgtggccccctgctgcaagtgcaggtggtaggcgaaacggtcatcggcatctgcctgccggagccagccaggcagttgggcgccgatctgctgcatcagcgccgggttgcctgccggcgctggcaggaacagcatggccggatccgtgagcaggtccaggcgccggtctacctgcgcttcgctgacgccgcgcaggtcgacggcggccaggttgtcgagttgctggttgaggattaacccggcctgttgttcgaacaggttgccgttcggttcattgcgccgccacgtcaggctatcgaactggaactggcgttgcaggcggcggctccaggcctggccaaatgcgtccagtgagtcgaatgcctcaatcgccccggccacgccgcacagcaacacttgcttgtcgcgtatcagcagcaggtccggcgtcagcaggcgcacttcttgcgcggccctggccagtgtggtttcgatgaaatacgcataggtggtgggcgtggagcgtggcaggcgttccagacgccccggccaggccgcggcgaccgccagcatgtcgcgctgggtgtcgctcaggcttgaggcggcgacggcggcggcggtcatctggccctggagaaactctcccagccattgccagcgactgcggccatggctatcggcctggctccagtaatcggccaggtcctgctggaacgacagatacagcgaggcgcgcagttcgtcgataacctgcgcaatcacctgcatgtcgacgtcggccaggccgctgcccggtgcgggcgacaagtaatacggcagttcaccgcgagggctcaggtcaagtagctgagggttgagaacgtggtcgagggccacatgggccagcaagggaaaggcatagccgccgctgggcgtagggctggccagcttgagcgtgagcaggtcaaattgcaggttcgggtagcgttcgctgatacccgtgcgcagggccttgaacaccactgaaaacaacgccgggcgcgtggcgaaatgggcgtggactgcctggctgggcaattggcccagggccgtaggtgaatcggacatggtgaaatcctttttcctgtgtgaatccggctgggttagctgccgggtcagcggaccgaggatcggtcctgcacaggaaaacggattttgtggtcacgggtgcggcatcgggataccgcaccccttggccaatggcctagttgtcgtaccgcaggtcaggcgccagccagcgctcggtcacagtacctccagccccaggaacagctcctggtcgagtggtggcctgatctcggctttctcgaggttgaccacggcacggttgtcggcgcgtgcttgttcgatcagttccctgcgggtgaaccggcgctcggcaatggttttcagatggccgaaggcaggttgcgaggcaggtgtatcggcggccggatagtggaagtgggcgtaccacaacacggtgtcctcaaagggttttccggcattgatctggtttttgtcgcggattgcatactcggtcagaaagtcaccggccttcaaactgacacgactgcgcaccaggttgatatcgacaaagccatggcgccacaaataagcgacattggcggctttcgggcgctgccgcttatacccttcggcgcacgcctcgcgagcgtgttctgtggcggcattcgcgtcagccagataagcattacgcagtgcgacggcctctggattggcggcgtggttgcgtaggagttcctcggcgagggcttcgaacttcgctgcatgctggctcagcatcacatcccattcatgggggtcgaggccctcgcgtcggctgggatcctgaagcttgcgctgttggaagcgaatgcttgcatcaataccggcccgctcgcctttgacgagcgctgcctgctctttgatcgcttttaacgtgcggccagcagcggcgctcggctggggtggttgcgcgggtttgacgatgttccagacgcctgtattggcgtgttcatggtaggtggcgacggtttgcccggtgagcgggtccttgatgtcgacgaaactgtcctcgacacctggctcgttcggacgcaggtcacccaccagggtctcccggtcatgggtcctgatgaccctgcggctggcgggtttctgtcgggcgtctcggttggaggcttgcctagggacaaagccttcttcagataggatcaactgggccagttgcgcttccagggtagtgcgggccacgctgaactgctccaggaaagagcttctgtagtgttctcgcacaagctcggaacccatttcagataacgagttaacggcgttttccagtcgtgcgtactgctggagtgcatccttgaatacgtcaatttgttcggccggtgagtaaccgctggtggctcgtatttcggtataggtaagtatggaagtcgtcgctcggcgatcggtgagtaccttaaggaaaggacgctcccttgggatatctgtgtttcgagcacgatcgactatcaactcaacaaacgccaacagcatatgctgctctataacgaccgaggaaacagtgttgttggacgtgattttgttcgtgagccgagccctcaatgccggattggcctgttgcaggatggcttcaattctttgtgcaacgctgagcatttccttgagcacttgcaggcgctgcgtcgcaccgctgatgaactcctcgtaggcgtcggtgatgtgcttgggcagttcttggtcgacccgtagcagtagctcggagaggctttcgccgcgtccggtttccagcgtgtttttgattttctgatgcagattcgagtaagacaacaataagtgactgtgaatgttgtcggtcgcgatatctcgtacctgcgtgtattgagcctgcgttctgtccagatccaacagttctctggccatggccagagacttttcctgggtggaaatatacgcttgggtgttttcctggtaattgtcgactgcaatgctccaagcgcttgtggcacgtgctgtcgagtctttcctctgcgcatgacgctcagtgattttggggcgcagttcgggaagtaatgtggagctgccgagcctttcccagtccgctctcaaggcttgcttgtgttctgtcagttgaccccgagcccttttcactgcgtctgtaagctgttgcgcctggggcgccaatgcacttgcttcaatactgagggcttccaatcctgagctcagctcctccaatcgtttcttgcgttttccttgccattcactgaaccgttctctaggcatgcctccctccagccttgcgcggcgatccagccgccaattgccctggccgtcgctggccagttggaagcccgggtgctgcgggtgctgtgggtgcaccacataaacttcgccaaaacccggcaccacgctgacctggaacagcagtccacccacactggcgtgccaggtcccatcaatgcggtaaagccccttgaggacgccgcctggttctgcgaccggtaaaacgttgggccacggtacatgcaccttgaccaatgctttgagcaacgctgcactggcttgggggctggccagcgagtggctgaaatccaaggcggtgtggccagacgccgggggctcaccgggcagcatcactgcgccatggcgcaccaccggcttgccttgcggatggggcaggcccggccggcggcgccaggcttgcagatgctctgcgcgacgctcggtcgggccaggcgtgtgcgaggaggcagcgtgcagcaacaccatcgcggtattgagcaacaggtcgatcagtgccagctcgcgggtcttggggtcggtgctgtccaggcctgccaagtcttgctgcaggctgctgaccagcaccaggaaccagcctgccagcatggccggcccacgggccagcggcaacagcagggtgttgaacagcagccaggcgccttccatcatgatggcccagcggctttcactgttggacaccgactcgcggtcggccaagtcgaccattacccgagcggtgctaccgaacaggtgattgggaaggttgccattgatttgcgactgcaaccattccccggcaccttcattgatggccagcgtggcgggcgccggttttgcagaaacgctgaactcgtccccaggcaggaaacgaatgatgtggggttcgcgcaagccgccgtgatcgtagatggggcgggccttgtcgggcagccaggtcagtacgctgtcttgcaggtcgccaggctcggcgatcgccgccaacagcgcctggcgcgttgggtattcgcgcagggcgtcggtgtacagcggccgatacagcaagtgcgggccgatggtcgcgttgcgcggttcgataatgaaagcgttgttgacttcatcgggcgtggccccggtttcgcggcacagggccagggggcgcaggacgatctcctgctcgtcgacgattctgtccgagggcatgtcacccatcaacgccttcacgtagcgataacccttgagggtcacgccgtactgttggcggatcttgtattccagcgcttgcaggggcagatgcaccttgagttcgcgggtaaacaacgcttccctgcgccgtgcgtcgacgctatcggacaacagcaggtccttgattttttgggggtaggcagtaccgatgtcgacgcgctggatcaatccgttgctgcccagcaggtagtcttcggtcaaccagtgcggcaatggtgcggcagttttggacgatagcttgagcgtgcctttgggttttcccgccaggtttttcagggccagttccgtcagtgtcatctgcacatgttcgatgatgccgtagccgcccggatagccggccgcgatggcgaagtccaacagcacctcgtctgggtcaatgtccccatgatcgacctgcatctgcgtgcgcaatgcgctgcggctgaaatgctggatgttatcaatgccttcattgaacgaacgaccctggttttgtcgcaacacctgcgccatgtcctgcagatggcgatggtaggcaaaccgatcggcggcatcggcctgcctgagccattcgggcaactgatcgataaccttttgcaggggcgcggcggcggcagtgggcagtggggaaaaaaacagcgccgggtccgttaggcgttccaggcgccgctcaagggtttcttcgtcttgcccttgaaacgtcaacgccgccaagtcctccagctgctggttgaggatcaggccggcctgctgttcgaaaacatgattgtccggttcgttgagccgccaggtaatgctgtcgaactggaactggtgctgcatcctctcaacccaggcttggccgaaagcatccattgaatcgaacgtctcgacaacgccggccacgctgtacagcaacacctgtttttcgcgcaccagcagcaggtcaggggtgagtacgcggacttcctggtcggcgctggtgagtgtgttttcaatgaaataggcatgggtgctggacgatgagcgcgacaggcgttctgccagcactggccaggcagcgacggtcgccagcatgtcgcgctgggtgtcgcccaggctcgaccaaccagctgccacggcggtcatttggccgttgagcagttcgccaagccattgccagcgactgtagccgtgactgtcgatctggctccagtagttcgctaagtcgtgctggaaatgcaggtaaagcgatgacggcaattcatcgatgatctgcgcgatcacctgcatgtcgatcagcggtggggtatcgggtttgaggatggtgggtatttgttgggtcaggtagtaaggcagttcgcgcggtgagtgcagatcaagtaactgtgggttcagtacatgggcgatagcgacttccatcaacgccttgtaggtgtaatggccagaggggtgtgggctggctagtttgaccgtgagcaggtccagtttgagcgatgggtaacgttccaggatgcgcccgcgcagtgtgttgaacaccaccgaaaacaagcgcgggcgggtagcgaaatgttcgtgtacggcctgggcaggcctttggctcagggccgaggttggcaaggggggagtcgggtcggacatgacgatttccttttcgcgtgtgcagccggtttttggctgccggctcagttgaccggtaatcggtctgcgataggaaatcccatagtgcggctaccggtgcgttacggggataccgactgcaacgatgggcgccatgatcctctgtcattcggtttcaattacacaacagagcgccctgaagccgtcgccccgcagagcctgcacggcgactttctgaacaccccggccctcagttgtcatatcccaggttcggtgccagccagcgctcagtcacgataaggtcttggcccttgcgcgcggtgtagctggccacctggtccttgtcgaccttgcccacggcaaagtactgcgcctgcggatgggcgaaataccagccactgaccgccgccgccgggaacattgcgtagtgctcggtgaggaatacaccgctgcgcccggcgtgcatttcccgggcctctgggtccagaagttgaaagagctgggctttctcggtgtggtccgggcacgccgggtaacccggggcagggcggatgccgctgtactgctccttgataagcgcctcgttgtccagttgctcgtccttggcgtaaccccagtgttctttacgcacttgctggtgcagccattcggcgcacgcttcggccaggcgatcagccagggccttgaccatgatcgagttgtagtcgtcgccggcatcttgatacgccttggcgacttcttcggcgccgatgccggcggtggtgataaacccgccgatgtagtcggtcacgccgctgtctttaggcgcaacgaagtcggccagggagaagttcggcttgccgtcggtcttgatgatctgctggcgcaaatgatgcagcctggcgatcggctggccgtcgtcgccgtagacctccaggtcatcgtcctgcacctggttggtaggccagaaaccgaacacggcgcgggcgctgatgagtttctcgtcgatcagcttcttgagcatttcctgggcatcggcgtacagcgccgtggcggcttcaccgaccacctcgtcttcgaggatgcgcgggaacttgccggccaggtcccaggagataaagaacggcgtccagtcgatgtactcggccagcaccttgaggtcgatattgtccagcaccttggcaccggtgaaggtcggcttgaccggggtgtaggtgctccagtcgaactgtggcttcttggcgatggccgccgggtagctcaggcgctcggtgcgcgcactgcggttagaggtgcgttcacgcacgtcgatgtattccagacgggtcttctcgacgaagccggccttcaactccttggacagcaattgcgtggccacacccaccgcacgggaggcatcggtgacgtagatcaccgcgtcgttactgtacttgggctcgatcttcaccgccgtgtgcgccttggaggtggtggcgccaccgatcatcagcggcaggtggaagtcctggcgctgcatctcacgggctacgtgcaccatctcgtccaacgatggagtgatgagcccggacaggccgatgatgtcgcacttctgttccttggccacctgcaggatcttctccgccggtaccattacgcccaggtcgacaatgtcatagccgttgcaaccgagcaccacgccgacgatgttcttgccgatgtcgtgcacgtcgcccttgaccgtggccatcaggatcttgcccttggcttcgggcttgtcgcctttttccagctcgatgaacgggatcaagtgggccacggcctgcttcatcacccgggcggatttcaccacctggggcaggaacatcttgccggcgccaaacaggtcgccgacgatgttcatgccggacatcagcgggccttcgatcacttcgatcgggcgtgcgaacgactgccgggactcctcggtgtcttcgacgatatgggtggtgatgcccttgaccagcgcgtgttccaggcgcttgttgacttcccagccacgccactcctcggtttcggcttccttgacgctgccgtcgcccttgtacttgtcggcgatggcgaggagggcgtcggtgccctccggggtgcggttgagcaccacgttttccaccgcgtcacgcagctcggccgggatctggtcgtagatctccagttggccggcgttgacgatccccatggtcagcccgctgcgaatcgcatatagcaggaacaccgagtggatcgcctcgcgcaccgggttgttgccgcggaacgagaacgacacgttggacacgccgccggaggtcagcgcgtagggcagttcgtcacggatatacgcacaggcgttgatgaaatcgacggcgtagttgttgtgctcttcgataccggtggcgacggcgaagatgttcgggtcgaaaatgatgtcttccggcggaaagccgacttcattgaccaggatgtcataggagcgcttgcagatttctttcttgcgcgcttcggtgtcggcctggccgtcttcgtcgaacgccatcaccaccacggcggcaccgtagcgcttgcacagcttggcgtgatggatgaactgctcgacgccttccttcatgctgatggagttgacgatgcccttgccctggatgcacttgaggccggcctcgatcacttcccacttggaggagtcgatcatgatcggcacccgggagatgtcgggctcgccggcaatgagattgaggaaggtcaccatggccttcttcgaatcgagcatgccctcgtccatgttgatgtcgatcacctgggcaccggcttccacctgttgcagggcgacttccagggcttcggtgtagttgtcttcgcggatcagccgggcgaacttggccgagcctgtgatgttggtgcgctcgccgacgttgacgaacaacgagctgcgatcgatggtgaacggctccaggcccgacagacggcaggccttgggaatgtccgggatcgcgcgcggcgcataaccggccacggccttggcgatagcttcgatatggcccggggtggtgccgcagcaaccgccgacgatattgaggaaaccgctctgggcgaattcttcaatgactttggcggtttgcgccggcagttcgtcgtactcgccgaattcgttgggcagcccggcgttagggtgcgcagatacgtgggtattggctttgttcgacagctcttccaggtaggggcgcaactcgctggcgccaagggcgcagttcaagcctacggagatcggcttggcgtgggccacggagttccagaacgcttcggtggtctggcccgacagggtacggccggacgcatcggtgatggtgccggaaatcatgatcggcagttccacgcccagttcctcgaacacgccttgcacggcaaagatcgcggccttggcgttgagggtgtcgaagatggtctcgatcaggatcaggtcagcgccaccctcgatcaggcctttagtggcctcggtgtagttttccaccagttcatcgaaggtcacgttgcggtagccagggttgttcacgtccggcgacagcgagcaggtgcggctggtggggccaagcacgccggcgacgaagcgcggcttggccgggttctcggccgtcttggcgtcggcgatcctgcgcgccaggcgtgcgccttctacgttcagctcataggcgagttcttccatgccgtagtcggccatggagatacgcgtggcgttgaaggtgttggtctcgaggatgtcagcaccggcgtccagataagccttctcgatcccgccgatgacgtcggggcgggtgagcaccagcaggtcgttgttacccttgacgtcgcttggccagtcgacgaagcgtttgccacggtagtcctgctcctcgagcttatagctctggatcatcgtgcccatgccgccatcgaggatcaggatacgttccttgagggcttggtgaagggcttgcagacgagcgctacgatcgggcatgggactactctggtcaggcattacggagggcatggatcatagcaaacctgtgccgatttggagcatgtgccggttttgcatgaatatcgttcatgttgagggcggccgtggcccggtagaatcgccggcacttttagcgcacgcattgaatcgggaccggatacatgtcacttcgctttttcaccagcgccttcctggcactggtcgcctgtaccgcccaggcacaaggtcccgctgcggcgatctcctatacccgcgacatccagccgattttcaccgagaagtgcgtggcctgccatgcctgctacgactccgcttgccagcttaacctgggcagtgctgagggcgcggcccgtggtgcgagcaaggtgccggtatacgacggcgagcggagccgggcggcaccgaccacccgcttgttctacgacgctttcggccagcaggcctggcagcagaagggcttctattcggtactcgatgcccagggcagccaggccgcgctgatggcacgcatgctggagctggggcacaacgcgccgttgcagcccaatgccaagctgccggaagacatcgtcctgggcctgaaccgcgaaaacatgtgcgcgacgcctggcgagttcaacacctacgccggcgcccatcccaaggaaggcatgccgctggccgtcactggcttgtccgaccagcaataccagaccctgcaacgctggctggcctccggtgcaccgattgacgaacaaggcctggcacccagcgccaaagaggccctgcaggtgcagcaatgggaaaacctgttcaaccagcccggtgcccggcaaagcctggtggcgcgttggttgtacgagcatctgttcctggcccatatccactttgagaacggcgagccggggcatttcttccaatgggtacgttcacgtacgccaagcggccagcccatcgacctgatcgccacgcgccgtcccaatgatgaccctggtaccaaagtctattaccgcctgtggccggtgcagggcgtgatcgtgcataaaacccacatcacttacccgttcagcccggcgaaaatggcgcggatcaaggcgctgttctattccggtgactggcaagcgagtgcgttgccgggctacggccccgggcgccgcgccaacccgttcgaaaccttcgaagccatcccggccaaggctcgctaccagttcatgctggataacgccgaatacttcgtgcgcacttttatccgcgggccggtgtgtcgtgggcagatcgccacggatgtgatccgcgataacttctgggctctgttccaggacccggaccacgacctctacatcaccgatgcgcgctatcgtgggcagaccacgccattgctggcgatgccgggacagaacgatgacgtgggcagcgtgctgagcctgtggctggcctatcgcgataagcgcaaccaatacgaagccttgcgccgtgacagctatgcagacgtgccgccaccgagttggtcgagcctgtgggcgggcagtgacaatgccttgctgagcatcttccgtcatttcgacagcgcctcggtcaccaaaggcctgatcggcgaggtgccgcaaacaatgtggctgttcgattacccgctgctggagcgtacctattaccagttggcggtgaacttcgacgtgtttggcaacgtgtcgcaccaggcccagacgcgcctgtacttcgacttgatccgtaacggcgccgagcagaacttcctgcgcctgatgccggctgacagccgcgaggacttccttgatgactggtaccagaacagcggcaagctcaagctgtggctggactatgaagccattgatgacgacaagcccacgggcttgcatctggacgagaaggaccccaagcgcgactttgccaaccagctgttggcgcgttatggcgctttgaatgcaagcccggatccgatcaaccgctgcacgggggcctattgctcgcgcagcgctatcgacccaggcctgcaggatgccgaacaggcgcttagccgcctgacgtcgcggcctgcggcggggctcaaggtgatcgaccagttgcccgaggccacgatgctgcgcatcgagaccaccagcggtcagcgtgtggtgtacagcatgctgcgcaaccgcgcccacagtaacgtcgcgttcctgctcggtgaggcgtatcgctaccagccggggttggacacgctgaccatctatcccggggtgatgagcagttatccgaacttcatgttcaatattccggcccgggaagtgcctgaatttgtcgcacgcatgcagcaggcccaggatgccaaggggtttgagcagattgtcgagcgctggggtgtgcgccgcagccatccgttgttctggcagtatttccacgacttgtcgcggtacattcatgaaaccacgccggtggaagagggcgtattggacatgaaccgctatgagaacctataactacagctattaatccggtcatttctccacgcgggggctgaagcagtcggatatctgtcgataggctggaaaaggtactccgacgatgttgatttcagtgcaagcgctacgggcgctggcggcgtgggtggtgttcgggcaccacttcacccaagtgttttttgaattcgaggtgcataaccccctggcttatctgtttgccgacaaaggcggcatcggggtggacatattcttcgtcatcagcggcctggtgattttcctcgccaccgcagataaggcgctcacgccgtggcaattcatgctgatgcgtctggcgcggatcgctccggcgtattggttctatacgctgctcatggctgtgctggttctgacattgccgtcgatgtttcccgatgctgagctggcgctgggccatgtgctgctgtcgctgctgtttatacctgctgagaacccaggagggtatggggtctatccgctgctggatgctggctggaccctgaacttcgagatgctcttctacgttctgtttgccctggccttgctggttggccgttcatatcggttgtgggtggtggcaggtttgttatacctggtgtgctgtgccctcagtcccgccctggacctggccagcggtttttaccataacgacatcgtgcttgagtttctgatgggtatcgtgatcggcatgttgtaccagcgtggctggtgccgggcccgggcgtggctgccattatccgggatcgcggtagccctggcggcgatctatcacggggcagatgtaccccgtgcgcttgagtggggtgtgcccagcgcaatattggttatcagctgtgtaactctggagccttacttccaaggttcgcgcattttgaaaatgctcggcgattgctcttattcggtgtacctgatccacgtgctggtgctggccgccgggcgatgggttgctgagcgaaacgcaatagatccctacacaatcctgccggtttgcatcgtagtgacggcgctgggcgcatacgtcagctaccaatggctggagaaggcaacctatcgcccgctcaagcgttggctgggtgtcgaggatcaggcaattatttcccgacaaaaatactaggactttgtacctctgtaatgatttggcgtaaactgccggcaagcctgtgaggagtttccatgactgccataaccattaccgacgccgcccatgattacctggctgacctgctgtccaagcagaacaccccgggtattggtatccgcgtctttatcacccagcccggtacccagtacgccgagacgtgcatcgcctactgcaagccgggtgaagagaaacctgaagacaccgccctggggctgaaaagcttcaccgcttacatcgatgccttcagcgaagccttcctcgatgacgccgtggtcgactacgctaccgaccgcatgggcggccagttgaccatcaaggcgcccaacgccaaggtgccgaacgtcaacgctgatagcccggtcaacgagcgcatcaactactacctgcaaaccgagatcaacccagggctggccagccatggcggccaggtgagcctgatcgacgtagtggatgacggtatcgccgtattgaaattcggcggcggctgccagggctgcggccaggcagacgtgaccctgcgcgaaggcatcgagcgcactttgcttgagcgcattccggagctcaagggcgtacgtgacgtgactgaccacacgcagaaagaaaatgcctactactgagtaaggtgttcactgcgaagaaaaaacggcgccccgtgagcgccgttttttgtgcttaaaattcaggggcttatgatatctatctaataataaagattaagtgtgggggggcttgcccccgatggcggcctgacgaccgatcgggatgttgtaggttgatcgagtacatatccgttatttaggtaacggccactattggttccgctcttacagcgggtcacttttgaaaagcgcaaaagtaaccaaaacgctattgccccaccactcggcacctcgcctaggctcggtgtgcccgtaatccgacagggatttggggggccgccgccacgcgccatccatggcgcggggcggctaaaccggcatccctgccggtttaccccccaaatccctgtcgaattccggccagcgtggtttaacggggcgcctaggatcaacagcagatcaagatcaagagcggctcgctgcgcatcgtggttaccggtgactgctatgaagtgtgtagatacctatggccatcgggggcaagccccctcccacattttattggaatttattcatttaaatcagtgcgttgatttaattttataaagtaaaaaatcaaggtcggtacaggtgcgcatgtcccgcccgatacagtgaagactcactgaaagtgtcattggccagcacccggcccaccacaatcaacgccgtacgccggaaccccttggccgcgaccttctgggcaatatccgccaaggtgcccacggcccaatcctgatccggccaggttgcacggtgaactacggcaatcggacaatcggcgccatagtgaggcagcaggtcggcgacgatcttctccaggtgattgacccccaggtgaatcgccatggtcgtgccgtgccgggccaggctgtcgaagccctcaccagcgggcatgctggttttatccgcatagcgagtcaggatcacgctctgggcgatgtccggcagggtcagctcggtttccagtagcgccgcgcaagccgctaccgccgtgaccccgggaatgatctggaagggaatgcccagctcacgcaagtgacggatctgctcgccaatcgccccatacaggcttgggtcgccggagtgcacgcgtgccacatcctggccttgtccatgggcggtcgtgatcaagtcgatgatctgctccagatgcagttcggcgctgttgaccacctgatgcgcccgatggccttccagcaccgccgcaggcaccagcgagccggcgtagatgatcaccgggcaactgcggatcagccgctggcccttgacggtgatcagttccgggtcaccggggcctgcgccgatgaagtagacggtcatgggaaattcctgttgaaaaacgggtgagcatgaagattattcatgatcgataacggcaattatcgggattttaactggcgcaggctaatgcaaaggtggcctggttggttttccggcgggtaatcagcaggcgggatgggctgcccgagaggtgttcggccagggccagggcggcactttcggcgacgccataacaacctgcatgggcaaaagcgaccgctgacttatggctcaagcgatgttcataacctgccagttgttcggcgttgaaacactgtagcggtaggcccagaagatgggcgagggccaccaacccgggctcatcctgtttgcgatcaaggctcgccagggcgctgatacgcttgcgttcaatgccgccctcggcgagggcggcgtcaaacaggtccagaagggcgtgaacatcacaaccgcgctggcaccccaggccgaccaccaggatcatgccgagtatcgatcgtcgcggtggcggcggaataaccaggcgctgatcaggccaagggccagccagaacgccacgttggtcaattgcgaggcaatctggaattgtgcctcgagagcctccggggccagcatcgagtgcacctgcggctgcggtgcgccgatcacgtggggcacggcaaggatcgccacgcccagcactttcaacagccagttgcggccgaacacgatcagcgcaataccggcggcggtggaggcggcggtgcctatccaccagctctggcgcagcgtcaggtcagccgcagccgtgcccggcaattccggtggcaggcccagggtgggtgccagcacgaaggttgcgtaacccgccaggccccagagcaagccctgggcggtgcgggtcggtgcgcgcagggtgtacaggccggccagcatcagtgcaaaaccgacggcaaccaccaggttgccaccggtggtggagagcacccgctgccagccatcttccggctcccaggcctcggcatcgtgggtgtgcgcagcggcgccggcatgctcatgggtgacttcggtggttaccggcggcttttcataggtctccgcctgcaaaatcaacggtgcaacccacaagctttgcagcagtgtcaacagtagggcggccaacaagccggtgaaccctgcggtctgggcaatacgcttgatcatatcggcaggtctcagtggcacgggaacgcggcgctgtggcgggtatcgtgggccgcgttgtgcactgcctcgatatgggagaaaccggcgaaatatacaaggcacgcgccgaggatcgacgcaccgattgcggcggtcaggcgttggctcaaggtggcagtgctgctggcggagtgcgaggtgctggtggtgatcgacatggcgcgtccctatcaggtgtcagagtgaaacgagcgcatgcaaaccacgcgagccaggcacgcagggttctgaacagcgcccgcccaccgcgggtttgttatctgattttttcgggccggtctccgggcttgcgaggggcggctcttggaagagttccacctgataagcgtctccttcccatgcacagcacagtggatttgacgcttcgctcgcttaccgttgcgggggcagcaccggacttgccataggtctatggcgcaccggtttcccgtttcaccctgtgaagggcacccgaaacaagatgtgtaggagagcatgcggcgagcgcttacgtcaaatggcggaatgcgccgccaaggcaacgagaggggtggccctgtacgcgtccacaatctttatttacttgtcgttagcgaatgcagcggaacatgagcttttacatgtttcaaaaggaagaaaggttattcgttctgttgccgaaatataaaaatatattgtatgggtgtaagtgggttattcgggcttttacttacttttcaataggttgttgagacgggatgttcagtgaactaatgctccattcgtaggttggttatttagagtgatgcaggcgttgaatcgttgggcaagctgtccgggaacgctttttgcgtttctccctactgatgctcgtggttgtggttttgtctcccttgaatagtcaaaattgatggtgcccattgtgcagataactaacagcgtgcaacgctcctataacccgtccgcagaggctcaacaaaacagctcttccgatcccacgttgcgtacattcgacccgcatttaaggccaataccgggtcttgacaagccgatttttaccgcggaccagatcgctcagcacctcacccgaagtggccagaaatggaatgacagcaatggtgatggtgtcacgcaggtttcctatacattcgatacccagggggaaggggagagagcgttcaatgccacccagaaaaaccaggccagactgtccatgcagtcctgggccgatgtggcgaacgtgtctttcgaggaacgtaccgaccgtggggaagggcacctggctttttccaatagtgaggtgccccgggttgcatccgcccaattgccaggcgaagacgttaaagtcctcatcaatccccgttttggcacgaatgctgcccctgccattaacaatcatggccgatatacgcttacccatgaaatagggcatggactgggtcttttgcatcctgcggactatgacaatagcaacgattccgcctatgccagttactttcgcgacgccgtttatgctcaggatactcgtggccatactgtcatgagctacttcgatgccgacttaagtggtcagaaccatcaaggaaagtactctgctgcaccattgatgggtgatattgcgggtgtccagcgggtatatggtgccaattataggacacgtaattcagacaccacctacggttttaactccaattcgggtcgagactattatcaactcgatcatcccagggatacggcaatattctgtgtgtgggacggtggaggtaacgacacgttggatttttccaaatatcgccaaaaccagactatcaacctcaacgctgaatcctattccgatgttggaggcttgcgggggaatgtttctatcgccaaaggcgttacggttgaaaacgcaatcggcggctctggtcatgatgcgatcatcggcaacgatgcggacaatgtgctcaagggggcagcgggcgccgattggctgaggggagcagggggggcggatacctttgcttatgaccacgccagcgattccacgttggaaaatcctgacctgatcatggactttgtgagtggcaccgacagaatcgacatttcggccttgttgaaaaacgccggtattggcgcgttgacgtttgtaaggcggttatcgggcgaaccgggtcaagctgttctaagttacaaccgccacgccaacctgtcgaggttggctatcgatctgacgggcaacggccgttttgactttttcctcaaaagccacggtccgataaatacacccgacatcatcagtaatgttccggttaagtgggcctattcctaaaaaagaagcagcatgccagcgggtagggagtagccgcttcaacaggccggccgctgcctgagtggtttcggcgtttctcgaggtcggatgcgcgatcaacattgaccccttctcccgcactgcgtagccttgctcgctcgaggttcttcggcccaggccgaagctaagaagggaacgcggtccaagccgcggctgcccccgcaactgtgaagggtccagttgactgccatgccactgccgagacggcgggaaggcgcagtcagcgttggtcgcaagacctgtacgccccaagccaggagacctgcctcgtcaccgattttccaattcaaccgggcggggtgatccggtgacgaaatccgctgctgcgcgccgccgcagggcctgtcgtcccgtatgcccgccccaaagggcatccgatgaaaacactggccaaactccccgtcaccatcgttaccggcttccttggctcgggcaagaccaccttgttgcgtcatatgctcgacaacgcccagggccgtcgtattgcggtgatcgtcaacgaattcggcgagctgggcattgacggtgaaatcctcaagcagtgctctatcggttgtaccgaagaagaagccaatggccgcgtgtacgaactggccaacggttgcctgtgctgcaccgtgcaggaagagttcttcccggtgatgcgcgaactggttgcccgtcgcggtgaccttgaccatatcctcatcgaaacctcgggcctggccctgccaaagccgctggtgcaagccttccagtggccggagatccgcagcgcctgcaccgttgacgcggtgatcaccgtggtcgacagcccggccgtggccgccggcaccttcgccgcgttcccggatcaggtcgacgcccagcgcaaactcgacccgaacctggaccacgagtcgccgttgcatgaactgttcgctgatcaactggccagcgcggacctggtgatcctcaacaaagccgacctgatcagcgccgaagacctggcccgcgtgcgcctggaagtcgccgaggagctgccgccagcagtgaaggtcatcgaagccagcagcggtcgcctgccgttggacgtgctgattggcctgggcgcaggctccgaggagcacattgacgctcgccacagccatcacgatcatcatcatgaaggtgaagacgatcacgatcacgatgccttcgactccatctccatcgacctgccccaagccgaagaagcgctgctgctcgacgccctggctcaattggtggtgcagcacggcatcctgcgcgtcaaaggtttcgccgcgatcccgaacaagccgatgcgcctgctgatccagggtgtgggcacgcgcttcgacaaacacttcgaccgtgcctggggggccgatgaagctcgtaccacgcgcctggtgctgatcggccaggaactggatgccgccggccttgaagcgcaattgcgcgctgccctcagcgtttaaccatgcacctgctcaggacccaacccggtggtttcgtcgcggacgacaatattgccgaccttggccaaacccctgctgaactggtgatcctgtgcagcggcgactccagcctggcgctgctcgccgaagcggcccggcagttgcccgaggattacccgagcctgcgcctggccaacccgatgcaggtgcagaaccacgcctcggtcgacctgtacgtcgatgaggtgttgcgccacgccaaggtcatcctgatttccctgcacggcggcattggttattggcgctacggcatcgagcgcctggtggagctggccgaacgcggcgtcacgctgattttggtgccgggggatgaccgacccgacccggagctcagcgccctgagcactgttgatgccgaacagcgcgagcgcctgtggcatttcctgcgccagggtggcctgggtaatgcgctggatttttaccattgcctggccagcgcccatctgggccgcgactatctctgggccgagccgcaaaccttgccgcgtacggcgatctatcaccccaatacagccaatgcccgcctcaatgactggcaggtagattggcgccccgacttccctgtggctgcggtgctgttctaccgctcccacttgcaggcggccaataccggtttcatcgatgtgttttgccagcgcttgcaggcggcgggccttaatccgctgcctatcgcggtggccagcttgaaagaatccggttgccttgcggtggtcgaggacctgctggacgacgtgcaagccgccgtgatcctcaacaccaccggctttgcccagtccagccccgaagccccgcacctgcgcccatttcgccgcgatatcgcggtgatccaggcgatctgcgcccaggacaaccaacccggctggcaggccagtgagcaagggctcggccctcgtgacctggcgatgcatattgccttgccggagctggatgggcgcatcatcagccggccgatcagcttcaaggaccttgcctggcgcagcgaacgcagccagtcggacgtggtgtgctaccgcgcagcgcccgaacgcatggattttgtcgctgaactggcgcggcgctgggttgacctggcccgggtgcccaatgccgacaagcgcattgccctgatcctcgccaactaccccacccgtgacggtcgtattggcaatggtgtcggcttggacaccccggcggccgcgctgaatatcctgcgcgccttgcaagctgaaggctacccggtggcggaagtgcttcccgacagtggcaccgcactgatccatgcgctgctcgggggtgtcaccaatgacctcgacagcctcgacctgcgcccgtgccatcaaagcctgggcctggaggattaccaggcgatgttcgagcgcctgccggactctaatcgccaggccgtactggaacgttggggcgcgccacaaaacgaccccatgtttcgcgacggccgcatgatgatcgccggcttgcgcctgggcctgaccttcgtcggcatccagccggcccggggttaccaggtggacgccagcgccgtgtaccacgacccggacctggtgccgccccatggctacctggcgttttacttctggttgcgccacacctacggtgcccatggcgtgatccatgtgggcaagcacggcaacctggaatggctgccgggcaaaggcgtgggcctttcggaaaactgctggccggatgcattgctcgggccactaccgaacatctacccgtttatcgtcaacgacccgggcgagggtgcccaggccaagcggcgtacccaggcggtgatcatcgaccacctgatgccaccgctgacccgcgccgaaacctacggcccgttgcgtaacctggagctgttggccgacgagtactacgaggcgcaattgctcgacccgcgccgcgcccttgagctgcaaaaagacattctcaagctggtgcgcgaaacccgcatcgaccaggagctggagctggacagcgaggctgacgccgacatctggctgccgcgcctggacacctacctgtgtgacttgaaggaatcgcagatccgcgacggtctgcatgtttttggcgaatcacccgagggccgcttgcgcatcgacaccttgctggccttgttgcgaattccccgtggcgacggccgtggcccgcaatcgagcctgctgcgggtactggccaaggcattcgacctgggctttgatccgctcgattgcgccttggccgagccctggacgggacggcgtccgcccgtgttgcagaagatcgacgggcagttatggcgcaccgccggcgatacccgcgaacgcctggagttttacgcagcacgcctgatcgagcaggcgctggaaggtcccctcgagcagttggaagagcccggctggcaggacgtgaagtcggtgatagaaagcctgcgtatcgtggtagcgccacgcctggacgcctgtggcccagcggagatgcgcggcttgctggatgccctgggcgggcggtttgtaccggcagggcccagcggtgcgcccagtcgcggtcgcctggatgtactgccgacggggcgtaacttcttcactgtggatgtacgcaacctgccgaccaccacggcctggcgcatcggtttccagtcggccaatctgattcttgagcgacatctacaagatcacggcgaccacctgcgccagcttggcttgtcggtgtggggcacggccaccatgcgcacgggtggcgacgatatcgcccaggccatggcgctgatgggcgtgcgcccggtatgggccaccggcagccagcgggtggatgattttgaaatactgccgatcagcctgctggaccgcccgcgtgtcgacgtgaccctgcgtgtgtccgggttcttccgcgatgccttcgccaacctgatccgtctgttcgatgcggcggtgcaggcggtagcggccctcgacgaaccggatgacatgaacccgctggccgccaaggtgcgcagcgagcgccaggcgttgctggcgtcgggccttaacgcagaggccgctgcgaagcaggccggctggcgcatcttcggcgccaagcccggtgcctatggcgcgggtgtgcagggcgcgattgacggacgcctgtggcagagccgtgaagacttggctgagatctacctgaactggggcggttatgcctacggtgggtccgacgagggcaccgccgcccgcggacaatttgcccagcgcttgagccaggtgcaggcggtattgcagaaccaggacaatcgcgagcatgacctgctcgactccaatgactactaccaattccagggcggcatgcttgccgccgtggaaaccctgagcggtgacaaggccgccagctatcatggtgaccatagccagccggacctgcccagaatccgtaccttgaaggaagagctgaaccgggttatccgcgcccgcgccgccaaccccaagtggatcgaaggcgtaaagcgccatggctataaaggcgcgttcgagatggccgcgaccgtggacaacctgttcgctttcgacgccaccaccgcgctgatcgacgatcatcaatacgcgctgctggccgatgcctacctgctcgaccctgacacccgcgcctttgtgcagcaacacaaccccgacgccctgcgggacatgaccgagcgtatgctcgaagcccagcagcggggcatgtggcaggagccgggggcgtatcgcgaggcgttggaaaacctgttgctggatatagaagaagacagccgatgactgagactccccatttcccgctgtccgccgtggtcggcgccgacgagctgaaactggcgctgtgcctgactgccatcgacccgaggataggcggcgtgctgatcgaagggccgcggggcatggccaagtcgaccctggcccgtggcctggccgacctgctggccagcgggcagttcgtcaccttgcctttgggcgcgaccgaggagcggctggtcggcaccctggacctggatgcagccctgggcgaaggccgagcgcagttttcccccggcgtgttggccaaggcggatggcggtgtgctgtatgtggatgaggtcaacctgttggcagaccacttggtggacctgctgctggacgtggccgccagcggcaccaacctgatcgaacgtgacggcatttcccatcgccattcggcgcgctttgtgctgatcggcaccatgaacccggaggagggtgagttgcgcccgcaactgctcgaccgcttcggctttaatgtggcgctgagcgggcagaccttgcctgccgagcgcgggcagatcatccgtcgtcgcctggatttcgacaccgatccagccgcgttctgcgcgcagtgggctgaaccccaggccgccttgcgcgagcgctgcacccaggcgcgggcacggctcgacagcatcccgctggatgacctggcattggcccggatcaccgaacgctgttttgctgaaggcgtcgatggcttgcgcgccgatctggtctggttgcgcggcgcccgtgcccatgcggcgtggcgtggcgcgtcagccatcgccgaggaagacatcgatgcagtggccgagtttgccttgcgccatcgccgtcagccgcaaacgccaccggccgcgccgccgaatgaggggcagtcgtcgaagccgtctgagacctcccctggccagggtcaatggggcgatatgcccgcaccggccttgcccaccggcgcacgccgcgatgtgccggcctggccaaaaaagccctaggcattcgcccccgacctgacgcgggggcggatgcccggccccaggcgggcagactggacaatggcaggcagggcaaggcgcgcagcgcacagcagggcacgatcaattggccgggcactttgctcgacggccggccgcaatcgcgggacgatttgctgtttcgcctgcgtagtcgttcagcgcctgaattgtggttggtgatcgtcgatgcctcggcatcgactcggcgccatcgcgcgttgaccgatgccaaggggttgttggcccagctgtttgacgatgcttaccggcaacgggcgcgcatggccttgctgacggcgagcggcgcatcgccgaagtggcaggtgcaaggcctgaaggctgccaaaggcctggcgggctggctggatcagctcggtgccggcggcggcacgccattgctggcggcactggccgaggccggggagtggctcgcggcgcggcgcaagcgttatccggtggagcaacagaagttgctggtggtgaccgatgggcggctcaaggcgattgacgcgttaccgcgattggagtgcccgggagtgctggtcgatattgagcgcgggccgatcaggttggggcgggctcaagagctggcgatggggttgcagttggagtataggcatatcgatgatgtgtagtgcctggaccatcgccatcgggagcaagccccctcccacaggggaatgcgtgtgctcaaaatgtgggagggggcttgcccccgatgaggccttcaaataccccacagcttcatcagcccgcccccggtacattcggccaaagatcggccaccaggaacaaccgttccgcttcctcccactcctcaccgctctgcaccatccgcaccagcaactgcgccggcgccatcgggtccaggtccgccagccagccttgcatctgttcttcactccacacctcatccgccgggtaatgcgccggtgccagccaggcatggcggggtaagggctgccagcggccgggcggggtggtgctgacaaagtcccgccagtcgcgttgatgcagccagcgcccgcgcaaatgctgggggtgagcgccaaggggggattgcgccgcgccgggccagggatagagcagataaccgcccagccacaaatgcgcatcgaactgttggatatccagcgccgccaaggcttcgcggctctcggcacgtgccgagatcggcaactggtgctgggccaggtgtgccaacttgcggtcgagccggtcatggcagccagggccaagccattgcgcggtgtcttggccatcgccgtcctgagggcccaggtagagcttgatcgccagttccaggtggtgcacgccatcgcggtcgcgcagcagcatgtccagctcgcccagggtatgcccggcgcgccggatcggcaggttggcggccagcaattccacgcccggcgcatgttgcaccgcgaactgccacaggcgttcgtaatagaggcccaggcgccgcgtgcgtgacaggttcagccactgctgcaaggcactgctgtcgcggtccaggtcacgcagccaggcttcgagcaagtggggcgcctgtacccagtcactgccggccaacggatggcgctgcggccatggcgtctgcgcgagcatcggcggggcgagtatcacccacgccaggtcgcgcacctcggggtggcgcaattgacggggcagggcgtgcaagtcagggaacactgtcatggtccgagcatagccttttcagacgtgcgtaaggtgcctgagaaccattgtcatcaaggctctgcggcgacaaaggattttgcctgagacggcctttcgcccataatcgttctttttggtcgcaccccacaccccgcaggagccccatggagcaatttcgcaatatcggcattatcggtcgcctgggcagtacccaggtgttggacaccgtccgccgactgaagaagtttctgctcgagcgccacctgcatgtgatcctcgaagacaccatcgctgaaatcctcccaggccacggcctgcaaacctcgtcgcgcaagatgctcggcgaagtctgcgacatggtcattgtggtcggcggcgatggcagcctgctcggcgccgctcgtgcgctggcgcggcataacgtgccggtgctggggatcaaccgcggcagcctggggtttctgaccgatatccgccccgatgagttggaagtcgaagtggccaaggtgctcgacggccattacctggtggagaaccgcttcctgctgcaagccgaagtgcgccgccacggcgaggccattggccagggcgatgccctcaacgatgtagtgctgcacccgggcaagtccacgcggatgatcgagtttgagttgtacatcgacggccagttcgtgtgcagccagaaggccgacggcctgatcgtcgccacccccaccggctcgaccgcctacgcgctgtcggcaggcggtccgatcatgcatcccaagctcgatgccattgtgatcgtgccgatgtacccccatatgttgtccagcagaccgattgtggtcgatggcaacagtgagctgaaaatcgtggtgtccaaagacatgcagatttacccgcaagtctcctgcgacgggcaaaatcatttcacctgcgctcccggtgacaccatcaccgtgagcaagaaggcacagaagttgcgcttgatccacccgctggatcacaactactacgaagtgtgccgtaccaagctgggctggggcagccgcttggggggtggaggcgactgatgctcgatcccgcgcgtagctacgacctgattggtgacgtgcacggttgcgctcatacccttgagcacttgctcgaccaattgggttaccacaagcagggcggcacctggcgccacctgtcacgcatggcggtgttcctcggcgatatcatcgaccgtggcccgcgcatccgcgaggcgctgcatatcgttcacgatatgaccgaggccggccaggcgctgtgcatcatgggcaatcatgagttcaacgcgctgggctggaccacgccggcgccgcctggcagcggcaagcagttcgtgcgagagcacaacccacggcatgcgcgcttgatccaagagaccctgacccaattcgaacaccacccggccgactggcacgacttcctcggctggttctacgacatgccgctgtttgtcgatgccgggcgtttccgcgtggtgcacgcgtgctgggacgagggctttatccagccgctgcgcgcgaccttcccggatggctgtatcgaccagcacttcctgcaggccgccgccgtgccgggcagttttgcctgcaacgccttcgaccggctgctgcgcggcaccgatatgcgcttgcccgacggcttgaccctgaccggtggcgatggcctgacgcgctcgttttttcgcaccaagttctgggaagacgaccccaagacctacggcgacatcgtgttccagcccgacgccttgccagagccggtggcgcgcacgccgttgtcttccaagcaaaagaattcgttgctgcgctacggcgtcgatgaaccgctgttgttcgtcggccactactggcgcagcggcaaaccggcgccgatccgcccgaacctggcctgcctggactacagcgcggtgctgtacggcaagctggtggcgtatcgactggaccaggaaacccagctggatccacgtaaattcgtatgggtcgacgttgagcgaccagaggccattccatgagtaccgtagctgtattgcgcttgcccctgagcgtcgacctgggtggtttcgtcaagttgctgcaacgcatgcaagtgccccatcgcgtcagtgaagaggcgggcgagcaagtgttgtgggtgcccgaaaccatcagtgatgacgtgcgcgtgttgtatcagcgtttccctgccggtgacccggaccagcagttggatattcccgaacaggcaccggttgctcggccaagctttgtccagcaagtgcgccatagcccggtcaccgcgctggtgctgctggccagccttatcgttggtgccgtgaccctgctcggcgaaaacctgcaagccatggcctggctgaccttcctgccgttccgggtgctgggcgagtacatccagttcacgccgctcgccgacacgctggcttcggggcagtggtggcgcctggtcacgccgatgctgattcacttcggcatcctgcacctggccatgaacggcatgtggtactgggagctgggccggcgcattgaagcccgccagggcagtatcaacctgctgggcctgaccctgttgttcagcctggtctccaactacgctcaatatgcctatggcgggcccggcctgtttggcggtttgtccggcgtgctgtatggcctgctcgggcattgctggatctttcaattattgtcacccaaccccgcctatcgcctgccccgtggggtgctggtgatgatgctggtgtggctgctgctttgcctgtcggggctggtctcgatgatcggcttcggcgaaatcgccaacgcggcccatgtgggcggcttggtcatcggttgcctgacgggtttgctcggcggtttgtacaaccgtcgcaaagcgtctatttgataaggaagagccttatgtcctcttttgctgcaatgatcgaaaacatcaccccggacatctacgagagcctcaagctcgccgtggaaatcggcaaatggtctgacggccgcaagctcaccgccgagcagcgcgagttgtctttgcaggcagtgatcgcctgggaaatccagaacctgcccgaagagcagcgcaccggctacatgggcccgcaggaatgcgcctccaagtcggcgccggtgccgaacatcctgttcaagtcggatgcgatccattgattgaaattggtcgcggtgcagtcagcaaaatgtcggcgcaactcggtgagccgactgttcaatacgcttttcgcctgggcgatgtcgaggtgccggtcaaccctctgatcggcacccatgtgcgcctcgaatacctgggtgccattcattgcagccattgcgggcgcaagaccaagaccagcttcagccagggctattgctacccgtgcatgaccaagctggcccagtgcgacctgtgcatcatgagccccgagcgctgccattacgacgccggcacctgccgtgatcccggctggggcgaaacgttctgcatgaccgaccacgtggtgtacctggccaattcgtcggggatcaaggtcggcatcacccgcgccacccaattgcccacccgctggctcgatcagggcgccagccaggcgctgccgatcatgcgtgtcgccacgcgccagcagtctggcttcgtcgaagacctgttccgcagccaggtggccgacaagaccaactggcgcgccttgctcaagggcgacgcggtagcagtggacctcaagcaggtgcgcgatgagctgtttgcttcctgtgccgaaggcttgctgggtttgcaggaacgctttggcctgcaagccatccaaaccattgccgacatcgagccgattgaaatccgctacccggtcgagcagtatccgaccaagatcgtcagcttcaacctggacaagcacccgattgccgaaggcacgctgttggggatcaagggccaatacctgatcttcgataccggcgttatcaatattcgtaaatacacggcctaccagctcgccgtgcatcagtagaaggatcccaagcatgcgcaccgaacaaccgaagatgatctaccttaaggactatcaggcgcctgactacctgattgacgagacgcacctgaccttcgagttgttcgaggaccacagcctggtccacgcgcaattggtgatgcgccgcaaccccgagcgcggtgccggcctgccgccgctggtgctcgatggccagcaactggagctattgagcgtgaacctggctgaccaggaactgacggacgctgactaccagctgaccgacagccacctgaccgtgcagcccaaaagtgcaaccttcaccctcgacaccaccgtcaagatccacccggaaaccaacactgccctcgaagggctgtacaaatccggcagcatgttctgcacccagtgcgaagccgaaggctttcgcaagatcacttactacctcgaccgtccggacgtgatgagcgtcttcactaccacagtgatcgccgagcagcacagctacccggtgttgctgtccaatggcaacccaattgccagcggccccggcgaagacggccggcattgggcgacctgggaagacccgttcaagaagccggcctacctgttcgcgctggtggccggtgatttgtggtgcgtggaagacagcttcaccaccatgaccaaccgtgaagtggcactgcgcatctacgtcgaaccggaaaacatcgacaagtgccagcacgccatgaccagcctgaaaaaatccatgcgctgggacgaagaaacctacggccgcgagtacgatctcgacatcttcatgatcgtggcggtcaacgacttcaacatgggcgccatggagaacaagggcctcaatatcttcaattccagcgccgtgctggctcgcgccgaaaccgccaccgacgccgcccaccaacgggtcgaggccatcgtcgcccacgagtacttccataactggtcgggcaaccgcgtgacctgccgagactggttccagctgtcgctcaaggaaggcttcaccgtgttccgtgactcgggcttctctgccgacatgaactcggccacggtcaagcgcatccaggatgtggcctacctgcgtacccaccagtttgccgaagacgccgggcccatggcccacgcggtgcgcccggaaagctttattgagatctccaacttctacaccctgaccgtgtacgaaaaaggctcggaagtagtcggcatgctccataccttgctcggcgccgacggtttccgcaaaggcagcgacctttacttcgagcgccatgacggccaggccgtgacctgcgatgacttcatcaaggccatggaagacgccaatggcgccgacctcagccagttcaaacgctggtacagccaggccggtacgccacgtctggcggtcagcgagtcgtatgacgctgcggccaggacctacagcctgaccttccgccagagctgcccggccaccccggataaggtcgagaaactgccgttcgtgattccggtggcactcggcttgctggacgggcagggcgcgggtattgccttgcgcctggccggtgaggcgacggctggcggcacttcccgggtgatctcggtgactgaagccgagcagaccttcaccttcgtcgacatagccgaaaaacccttgccttcgctgctgcgtggcttctcggcgccggtgaaactgagcttcccttacgaccgtgaccagctgatgttcctgatgcagcacgacagtgacggcttcaaccgttgggatgccggtcagcaactgtcggtgcaggtgctgcaggaactgatcggccaacatcaggcgggtcagccgctgaagctggatcagcgccttatcgacgcgctgcgcactgtcttgagcgatgaaagcctggaccaggccatggtcgcggaaatgctctcgctgccgagcgaagcctacctggcagaaatcagcgacgtggcggatgtggatgccattcacgccgcccgtgagtatgcccgcaagcaattggccgacaacctgttcgaaggattgtggctgcgttaccaggccaaccgcgacctgtccaagcagacgccgtacgtggcggaggccgagcactttgcccgtcgcgccctgcaaaacatcgcgttgtcgtacctgatgctcagcggcaagccgcaagtactcgcggccaccctggatcagttcgatactgccgacaacatgaccgagcgcctgaccgccctggcggtactggtgaactcgccgttcgaggcggaaaaagcccaggcccttgcggtgtttgccgagaactttaaggacaacccgttggtgatggaccagtggttcagcgtccaggccggcagcaccttgccgggcgggctggcacgggtcaaggcactgatggagcacccggcattcaccatcaagaacccgaacaaggtgcgtgcgctgatcggtgcatttgccgggcagaacctggtcaacttccatgccgcggacggctcgggttatcgcttcctggcggacctggtgatacagctcaataccctgaaccctcagatcgcctcgcgccaactggcgccgctgacgcgctggcgcaaatacgacagcgcgcggcaggcgctgatgaaagcggaactggagcgcattcttgcctccggcgagctgtccagtgatgtgttcgaggtggtcagcaagagcctggcgtaatttgggggcagggtggctgccggcggttattgagcgggtgatcttcaatccaagggggcttggttccgctggggccttacagccgaccgttatctaaccagcgccctgatccaatgtgggagggggcttgcccccgatggcggcctgacagccgaccagaatgttggatcagaccaagtacatatccattgtttaggtaacggccactattggttccgctcttacagcgggtcacttttggaagagcgccaaaagtaaccaaaaacgcttcgccccaccactcggcacctcgctcaggctcggtgtgcccgtaatccgacatggatttggggggccgccgccacgcgccatccatggcgcggggcggctaaaccggcatccctgccggtttaccccccaaatccctgtcgaattccggccagcgtggtttaacggggcgcctgagatcaaaagcagatcaagatcaagatcaagagcggctcgctgcgcatcgtggttaccgtcggctgctacgaagttgtgtagatatctatgctcatcgggggcaagccctttcccacattcatggcatttctgacggagttagaggtcttgaaagcggccggctcgaaggtcgctatcgagcccgtagtactgacatttgctgacaggaacctctgctaagctgccgcacctctatccctgattctggtggcatcaacgtgtcgcgcaccactcgcctattaacgttgcttcaggccctgcggggcagaaaacgcccggtcaccgccgccgttctcgcggcgcaactggaagtatcggaacgcacgctgtaccgcgatatcgctgaattgaccgccttgggcgcgccgatttttggcgaggccggggtcggctacgtattgcgcagcggcctgtttctgccgcccctgatgctcaacgccgaagagaccgaggcggtcgtgctgggcttgcgttatgtagaccagcgcggcgatgacgtattgagccgtgccgccgccaacgccctggcgaagatcgccgatgtactggaccctgcggctcaagaggcgttgcgtaacccgacgctgctccctggacctcccggcttcggctacccggaaaaccgcgtcccgcttaacgtgtttcgcgatgctattcgccatcaggccaagctgcatatcagctacgccgacgccagccaaatccagagccaacgccttatctggccgctggctctgggctttctcaatgaggcgcgggtgatcgtggcgtggtgcgagttgcgcagtgcctatcgcacctttcgcaccgaccgcgtggccagcgccgatgcccagggtgagcgttaccccgggaggcgcagcgacctgttgcgaggctggcgcaagctgatggagcagcaagagtccgcgccgtttactcctgacaaaaactgacacacccgtggcttagcatggcgtcacaaatcatccaggcaaggagttgtgccatgtcttttcccgagttggccccggccatcgtggcttatattgcagcaaccaataccggcgacatcaccgcgatcccccagtgtttcgctgacgatgccaatgtattcgatgaaggcgaacatcaggtgggtacggccgccattgcacgctggatggaagataccggccgccgctaccagccacgggtcgaggtgctcagcgtgcagcaacgcaccggcaaagtgctggtcagcaatatcgtctccggtaatttccccggcagtccgcttgagctgcgctacacctttcggctgaacgaacagggcaagatttcacggctggatatctgcgcgtaagtcatactggcacacatgactttcgactcgccgctcgccgcttaccaacatgccatcgcccagcaaggtttcgtccctgacgatgcccagcagcaggcggtgcacgccctgcaagcctgtcacgaggtcttgcaccaaggccgttcgccgattgccggggtttacctatgggggccggtaggccgcggcaagacctggctgatggaccatttctaccaaagcctgcgtattcccgcacgacgccagcattttcatcacttcatggggtgggtgcaccaacgtttgttccagctcacgggaacccaggatccgttgcgggcgttggcccgggagttgagtcgggaggtgcgggtgctgtgcttcgatgagctgtttgtgaatgacattggtgacgcgatcatcctcggtcgcctgttccaggtgatgttcgagcagggcgtggtgatggtgtgcacctctaaccagccgcccgatcagctatacgccgatggcttcaatcgcgagcgtttcctgccgggcatcgctgcagtccagcagcacatgcaggtggtggcagtggacggaggcgaggaccatcgcttgcatcccggtgcaggcatgcagcgatactgggtgaaccaaccggctgcactggctgcggtgttcaaccaattaagcctggggcagcgtgtgatcagcggggcagtgagtgtaggtcaccgttctatcgtggcggtacaggccagtgacagggtgctctggtgtcgttatgccgagctgtgcgagcaacccctggccgccatggactttatgctgctgtgtgatcgctaccaggccatcctgttgggtgacgtccctaacctcagcgcacagaggcgtgccgggcggattgcccgtggcaccgaggacggcgtcgaacgtgtagtggcgggggatcgcgaattgccgcagctgtcggtacacgatgacagcgtgcgacgctttatcgcgttggtggacgaatgctacgaccgcaaggtgccgctctttatcgacgccgcggtgccattggagggcctttacaccgaaggctacctggagtttcctttccgtcgcaccctgagccgtttgcaggcgatgcagttgcaacgcttcgccgtctaggaaaaatcgccgtttcagggatgtttgcaggttttgacgcgttcaagcttcgcgatttctgtcgggcatttgtagttaatctccttcatctgttgccgactccgcgcttacaatcgcagctctcaaagggaaacgaatccctggttgtcgttatcgaggaaggaaatggacaccccagacatcctggtgctgcaagccagctacaccaacgccgtgcatgccgatgccattggcctgttgctcaatcattatgctgaagattcgatgggcggcggccacaccttgccggccgatctcttgcagcagctgcctgccgagttggccaagcgcccacacgcgttcagcgtcctggcgtttatcggtggcgaaccggcggggttggtcaactgttttgaaggtttctcaacctttgcctgccgcccgctggtcaacgtccacgacgtggtggtgatggataggtttcgtggcttggggttgagtcagaaaatgctgcagaaggtcgaggaaatcgctcggcagcgcggctgctgcaagatcaccctggaagtgctcgaaggcaatgaactggcccagtcggcctaccgaaagttcggtttcgatgattcagtatttgatccgagtcatggacgtatgttgttctggagcaagtcgctttaataaataccaagcgaaaaaaagggcgccgttaagtggcgcccaatataccttcgccaacggagcggaatggcgcagggtgttgcagattaaatcaacattaaatcaactgttcggttgttcctcattgacggtgtcgaccttcaaggtcttaccgtctgcggaggccattcgctgttcagctgcgccatgggtttgttgctgaatgaagctgaagttctggtagaactccttagaacgctctgaaccgccctctgcaaaggcggcggcggaggtcagtgtcatcaggctggcaaacatcaaggtcgagagtttcatcgcagtattcccattaagagtgataggtgtctggccgttccttgatcagaagcatggggcgactatggacgtatcgtattaagtgggagttaacgcaaagtgcctgcgaagttaacagtttgttaacttcgcaggcacggggcagggcaggggttcaaagacgcaaggggatgaagaacttcaggcctggacgagaatgattgtatcgttctgtcgccgagcccaggtttacttcagcaccacttcactgctatcggccttctttggcttgatcaggctgaagtcgatcagcgccttctgcttggtttcgtaagggttgccgatcagcaagggacgtggcttgaagctgtcgctgaccaggctcttgctgtggtccagctcgtcaaaactcaagccggccatgtcggcccaggtgtgaatcagctgcgagctgctgtacggccgctgcaggtcgccggcgaagctccagtcgtggctttcgcgccacttcggtgaggcgtaggccatgaacgggatggtgtacatcggcgcggtcggcttgccttcgttgcggcccagggtgtcgtggccgacggagtcgaacacgtcttcgccgtggtccgagaggtacagcaggaagccgttggggtcggtcttggcatagtccttgatcaggctggagaccacgaagtcgttgtacagcacggcgttgtcatagctgttgtacgtcggcaactgcgcatcgctgacacccgcgggtacgccctggcggtcggtgaacttgtcgaagctcggcgggtagcggtactgatagctcatgtgagtgcccagcaggtgtaccacgatgaacttgcgctcagcggtatcggccagggccttggagaacggcgccagcacatcgccgtcgtactgacgggcgttctggttgcggttgttattcaagtacacctgctcgtcagcctgttcggaaaaggtcgtgagcatggtgttgcgcttggtcatggtctgctggttggtgatccagaaggtcttgtagccggcctgcttcattacgctgacaatcgacggcgtcttgaggtacaggtccgggttttcttcgtcggcaaaggtcagcacctgttgcagtgcctcaatagtgtaggggcgcggggtgatgacgttatcgaacacggccagttggtcgcgcagcttgtccagctccggcgtggtattgcgcgggtaaccgtagaggctcatacgctggcggttggtggactcgccgatcaccagcaccagagtggacggctggccggccatgctgtccttgaggttcttcaatggcgggatctggctggcactggtcagcatgccttgcatattgtccagctgttcggtgtagcgacggtaggcgacgatcatctgccaaggcacagccggttcgatacgggtctcgaaacggtcgatggccaattccatggtttcgctggtagcgatctgcttgaccagcgggtagcccacaacggccaggacgatggccaccgctgccacgatcgactggccgcgcggcaggtacacagggcgcaggcgtgtccagaggaagacggcaaaggcggtgtgggcaataaatgccagcacgatccaccaggcaaaatattgggtcgcgtattcgccggcttcagagatgttcgattcgaacatgatgaagatgacgctctgggaaaattcctgctggtaaatgaagaaataacccaggctcgccattgagcaggcccacagcaccacgccgatcagtgcggcaagcaggcgcgtacgacgcgggaacaacaacatcggcgccagccatagcgcactcatgaagaaggcttggcgaaaaccactgaagccggaggtgccggtcagttggattagcagttgagtaatacccgagaaataccagaaaaacagaaataaccagccaaggccggcccaatcaaagcctttcgcagtcgtcgtgctgcgtttgaacatcgccatccagcgccccatcagagaatgattgtcgcgcacaggcgcgcgacatcgggccgctcaggaagtgagcggcatcgcgggcgggagtatcgggacaggcgtgtgaaaactttgtgagttttctgtaagtattgccttacaaactaaccagaggcgatcagcagagcgcaggcttggcgtcagacggcaattcgagctggctttgaaggtacgagcgcaggcgcaggacttcctgctgcaactgatcgcgctcatctttcaactgacgcaattcatcgcgacggatgctgacgtagagggtctgtggcgggcgggtcatctgtgctgtgctcattgcttacctcgcaaatagccggtagatcgcggtgccggaacaggtttccagcaacagtcgagagcaagtttgaattcttttgcgagacaagggaacttttttatttttcgcggtcgtgtgacttttccgaggatgatggtgaaacgatggcagtttttttgtcatgaaactacacggatccgctctggactaaccctcattagcctcattgcgctataaactatgtcacacattttttagcagttaggagcatcagcacatgcaactggggattatcggactaggccgcatgggcggtaacattgcgcggcgcctgatgctcaatgggcataccaccgttgtatacgaccgtaacgaagcctttgtcaaaggcctgagcgaggagggcgctaccggcgtcgccgacttgaaagccctggtggccggcctgcaaaagccccgtgccgtgtgggtaatgttgccggcgggcgcgcccactgaagacaccatcaacgcgctgagcgagttgcttgaaaacggtgatgtgatcatcgacggcggcaacaccaattacaaggacgacgtgcgtcgcggcaaggccctggcggaaaagggcctgcactatgtcgatgtcggcacttcgggtggcgtctggggcctggagcgcggctactgcatgatgatcggtggcgacgtcgagaccgtgcagcgccttgacccgatcttcaagagcctggcgccgggcatgggcaacatcccgcgcaccaaggaccgttcgccgtctgccgacccgcgtgccgagcacggttatatccatgccggcccagcgggctccggtcacttcgtcaagatgatccataacggcatcgagtacggaatgatgcaggcgtttgccgaaggttttgacattctcaagaccaagaactcggaaaacctgccggaagaccagcgtttcgacctcaacgttgccgatatcgccgaagtctggcgccgtggcagcgtggtgtcgtcctggctgctggacctgaccgccgacgccctggccaccgatccgaagctcgatggctactcaggttccgtggccgatagcggtgaaggtcgctggaccatcgaagcggccatggaacaagcggtgccggtaccggtgctgtcgacgtcgttgtttgcgcgtttccgttcccgccagcagagcacctacggtgacaaaatgctgtctgccatgcgcttcggctttggtggccatgtggagacttcaaaaaaatgaccgccaacggcaagaaacccaaggccgaacccgcaccccccaccaccctgtttctgtttggcgcccatggcgacctggtcaagcgcctgctcatgccggcgctgtataacctgagccgtgacgggctgctgggcgatggcctgcgcattgtcggcgttgatcacaacgccatcagcgatgccgacttcgccaagaagcttgaggacttcattcgcaccgaggccgccagtaaggtgcgcggcaatgccgaaaatgccctcgacccggcaatgtgggcaaaattggccaagggcatcagctacgtcgagggcgactttctcgacgacagcacctacgctgatatcgcgcagaagatcgccgacagcggcaccgccaacgcggtgttctacctggctaccgctccgcgcttcttcagtgaagtggtgcagcgcctgggcagcgccggcttgctgaacgaaacggatgagggctttcgccgcgtggtcatcgaaaagccgttcggctccgacctggccactgccgaggcgctgaatgcgtgcctgctcaaagtgatgagcgagaagcagatctaccgcatcgaccattacctgggcaaggaaacggtgcagaacatcttgatcagccgtttctccaacgtgctgttcgaagcgttctggaacaaccactacatcgaccacgtgcaaatcaccgccgcggaaacggtcggtgtggaaacccggggcaatttcttcgagaaaaccggcaccctgcgcgacatggtgcccaatcacctgttccagttgctggcgatggtcgccatggagccgcctgccgcctttggcgccgatgcggtgcgtggcgagaaggccaaggtggtcggtgcgatccgcccctggtctttggaggatgcccgagccaactcggttcgcggccagtacaccgccggcgaaatcgccggcaaggcgctgccaggctatcgcgaggaagccaacgttgcgcctgacagcagcactgagaccttcgtcgccctcaaggtaatgatcgacaactggcgctgggttggcgtgccgttctacctgcgtaccggcaagcgcatgagcattcgcgataccgagatcgtgatctgcttcaagcacgcgccctatgcgcagttccgcgacaccgaagtcgatgagctcaagcccacctatctgaagatccagatccagccaaacgaaggcatgtggttcgacctactggccaagaaacctgggccgaccctggagatggctaatatcgagctgggttttgactacaaggatttcttcgagatgcagccgtcgacggggtacgaaaccctgatctacgactgcatgaccggcgaccagaccttgttccagcgtgccgacaatatcgagaacggttggcgtgccgtgcagccgttcctcgatgcgtggaaggaagatgacggcatccagacgtacaaggccggtgaagatggccccgcggcggcagacgcgctgctggcccgtgatggccgcacctggcatagcctcggatgagtgacgcgacgattcatcccatccgatttgttctcagcgatgtggacgggaccttattgcatcccgaccacagcctcagccagcgtaccgccgacgcgattcgtgcgatgcgtgaagccggagtgctattcagcctggccagcgggcgtccgcccaaggccatgctgcatctgatcgagacgtttggcatcgatgtgccggtggccggtttcaatggcggtacgctggtcaacccggatggcagcatcctggttgcgcaccatctgccggcagaggcggcgctggtcaccctggcgctgttttcagccgagccggacgtggaggtctgggtgtttgccgacggcgactggctgcgccgtgacccgcctgggccgatggtgcagcgcgaagccgatggcttagggtacgggccagtggtggtggagagtttcgagccctacctggatcgtgtcgacaagatcgtcgccgccagtaacaacacgcagttgctggtggagctggaggcgcaattgcagccgaaggtgcaagggttggctcaggtgtcacgttcgcaaccggtgtacctggacgtgacggcgatgctggccaacaagggcgaagcattgaaaaccctggccgagcatcttggggtgccgcttgaacagaccgcagccatcggcgacggcggtaatgacccggccatgtttaaagtggccggtttatccatcgccatgggccaggccgaagaaaccgtcaagcgccaggccaatgtggtcaccggtagtaatatcgaagacggcgctgccgaggcattcgaacggtttattctcgcggcacgttaaacctgaagtctcgctgcacaacttccagcctgtgtttcccaagggctggaagttgttgtagtgaattacttcggcattgcccagtgttgcaactggtagccatctttatcgagctcggcgcgagcctgcaacaacaggttttccaattgcgctggatcggtataagtcttcgatgacagctgtttgctgccgatacgggtattggtacggtcgatgacgctcaggctgagggcgccattgccatcgtgccaggccacgcactggaagggttggaaggcacggtctgcaatcaaaagagcttcgttgatgcgcagcggagcgttcatttgggtcttctctctgtatgcccattcaagtgagtaccggcggttgggctgaccgtgcggtgggttacttgtactgatgcacgatgatggggtgcgggtcacatgctagagcaagaaattttaactttccctgattaacatcatctaaatgcctgttttgaaagctgaatgaaagtttccgccgccggcaacttgcgagcgccacatggttttttgcccgcacttatagcgaaatggtacaaggcaggcgtcaatatcttgctagggttaccgccaggcgccacaaaccattgtttctaaataactttaataattctggcgccaaggaatcgacatgcttgtgacacccgtccaacgtcgcttgctggtggtcgacccctgtgatgattgccacgacctattacccggactgcgcacggccggttgggaagtggatagttgtgccttgcaggcggtaggtgagcgctcctgcgatgtggggctgctgcgcttgcagcccagccatctggagcgccccgaagcggtcaaggaattgattggccgcagcggcaccgagtggattgctgtgctcagccaggatgtattacgcctgcagaacgtcggtgattttgtctgcgaatggttctttgacttccacacgttgccgttcgatgtgtcccgggtccaggtgaccatcggccgtgcgttcggcatggcgcgcctgcgtggcaagggttacgcgcctgtagatgagccccacgagctgttgggcgacagccgccccattcgtgaactgcgcaaattgttggccaagttggcccccactgaatcccctgtgttgatccgcggcgacagcggcaccggtaaagagctggtggccaagaccttgcaccggcaatcccaacggcacgctaaaccgttcgtggcgatcaattgcggtgctatccctgaacacctgatccaatccgaactgttcggccacgaaaaaggcgcgttcaccggcgctcatcagcgcaaggtggggcgcattgaggccgccaacggtggcacgctgttcctggatgaaatcggtgacctaccgctggagctgcaagccaaccttttgcgtttcctgcaggaaaaacacatcgagcgcgtcggcggcagtcagccgatcccggtggatgtgcgggtgcttgccgcgacccatgtcgacctcgaagctgcggtggagaagggcacctttcgcgaagacttgtattaccgcctgaatgtcctgcaagtggtcaccgcgcctttgcgcgagcgccatggcgacgtggcgatgctggccaaccacttttcgcgtttctatagccgggaaaccggccggcgcccgcgcagtttcagcgaggacgcgctggtggcgatggggcaacacccttggccgggcaatgtgcgggaactggccaaccgcgtgcgtcgcggcctggtgttggccgaagggcgccagatcgaagccgttgatctggggttgcaaggtcagccggccctttcggcgccgatggcgacattggaagattacaagcaccgcgccgaacgccaggcgctgtgcgatgtgctcaaccggcacagcgacaacttcagtgttgccgcgcgtgtgctggggatttcccggccgacgttctaccggttgctgcataaacaccagattcgctgatggcggtgtgtcagctatagataagctggctgacacactgctatcggggtgtagtcagaagtaatacgggaatttcaggctgaaggtaaagtccggcgcatcatcggtcatgccgatcgccaggttcggcacgatggtcaggttatccgaggcggcaatggtcatgcccacgttgaagtaaccggcattggcgtcgctggacaccaccgattgccagtcgccgccgtccggcttgagcttgctcttgcgctgtaccaggtcggagaccgagaacgacatgctcattttttcgttgagcgcgaaggctacgccgacgccgaactggaagctgtcgcccaggcggactttaccgccgaccttctggttgacgtcgctgctgatatcgtcaaacgaatcttcaaagttgtgggtatacgacagcgaaccaaacaacactgccgggtcgaaggtcttgaccagggaaatacccggggtgaccgaccagaccccgttgcccgtcggcaggctttccggcaggtagaggttgtcgttgttgggctgccggaccagcttgatgccgaaaggctctttacccgtgggcgccttgacccgtacagacaccaccgcatccggcagggtcggggtttcgtcgagaaacttgtaggccacgccaaagttgacgtcgccaatggtcgggtcgcgggtcaccgagccttccgaggtggcggtggcatcgttgccggcgccggccgactggtaggtcgagtcgcggtacaccaccggtacgttcaggtcgaactgccaacggttgtcgacgttgtaacgcccggtgaggtccagggtccagctgtcggacttgatccggtccaggttgatgttgccgaggaagatcgagtccagcgcgaggaagccattgagggttaattggcgtgcgtcataacgggcataggtgatgccggtttcaacgctgaacttgccgttgccgaagaagccactggcctcgttgtagaggttgctcacactttgcgccggggccgaatcgtccttgagggattggccgtaggaactgcctgcaccacccgaggcggctgcggctccagtacccgtggtcgcaacagcgttaccgccattcttgaagtcggcaggtgacttggccaggcgcctgggggcgggcgtcgccggttgatcctctacctgacgtacacgttgctccagcacagccaaggctttttgctgcacgtcataacgttgcttgagttccaggagttccctcttcagggcttcgatatcggcgtctggcgcggcatacaacagggatgcgggcaagagcgtacttaaacaaaccaccgcacgtagcgataacgatcgatgcatgaaataagccgtcctttactaatgcgtaagtgtcgaagggtcagcgtagttcaataaccgagcgtacgtaggcctttgagctgatccaaattgcaattcaacgcggcgttattcaagccgttattgttcatcaccacgttgatctgagtgatatttctgacaaggttggtattgccggtcagcaccgtaccctgcagcacgttgccgccaccgatctgctgcaggctgctgccttggttgtggttggcctggatcgccatctgcacgccgccattgttggccgatacgctgacgcggcccgctgcgctgtcaccgctcacggtaccgccggccaccagtacctgcccggattggacgttattggcgggggtaacgccgttttcaacattgatgccgacgttgttgtaggcggtgttgccatcgccggccgtgcgcacactttgggtcacgccctggccgctgcccaggcccgcccccccgaccacgttaccggtgccggtggttggaggcgtgccggtaccggtcgaaccggtggtttgcacatagaactggggggtgatagtggtcttgtcgatctgcatgttggccgtgccggtgatgctgtcaccgacggcattggtccaggtgctgctcatgacgatgccgaagctgatgatgcgccccggcattacgtagcggccacgcagttcggccatttctgcgtccttgagttcgataggcttaaaccccgatgacgcataagcgggcattgaggctgccacgcacaacagcgtcatccaacggcaagtgttcatctgcggctcctggggcgtcctgccccttattgcgcttctagaagaagtcgctctggataaaaccgaaatccatcagctctgcatcgcccaccggcttgaactcattcatctggctcttggcagtcagcggcatgggcgggtcgagcaggacgttggccttgtcgtaaccttcacccagcacggcgaagacaatgccattccagcctttgacgaaatcgtcacgggaatagcgcttgtggcccagcaccgggtcgccgatatatacccagtccttgtcggcccgttgcatcaccacgaagtgcttgtagccacggatttccagcagcaccaccacggggattttcacggtcagcaaggtatccggcgcgatcttgtagccgcgggcacgcatgccgatgctttcgaggtagcgcttcatgtcaagcatggaaaagccctgggttcgcaccaggtcctggtcggcggtcaccagcatgcctttgatgatgtggtcttcgtcgacgtccagccaataggcctggcgcaggatggtggcgagtgccgcggcaccgcagctgaaatcggttttctgttccaccaggttggcgaagcggcgctcacggatgctctcgaccttcttgtagatcaccgcgccgccgggcatggcggagatcgccatggtgcctgcccaggtcgtgccggtgagcaacatcaggagggtgagaatcgcgaggcgcatgatcggatcacctgctggacactggaataagatagggccttgttgccaaggccccgttggatcagaagcgcacgctgctgctgcagacgctgcaaccttggccgatcgccaggctgttgctgccttggttgcccgcaccggattgcaggttgacgcctacgttgccggagttgcggttaaccgagttgtcgaggcttgcgttgttggacacgtattgcggcttgccaccataaccatggctgctggcggccgcattgaggtagctgttgttgagcgagttttgctcggtgttggaggccgctgcgatgttcttgccatcggcagtagtgattgccaggttgtttttaccttggttgccttgcccggcctgaccgttgtaacccacgttgccggagttaccagtgatggaaccgtcaagagaggcgttgttttgcgtgcctttgttgacgaagttattgcctgaactgccttgatctacatcgatcaccgcaaacacagtggcaaagtcaccttttgcactggagatggcaccggcattgtcggcctggttaccggaccccgattgcgcgttgacgccgacgttaccgctgttgctgttgaccgagttatcggccgaggcgttgttttcggtgttggtgtcgtcgaatttgttgtgttcgcttttttgcacatcagtgacgacagcggcaacagtgccggtgggttgaggggttggatgccagccacccgcttgagcagcagcagccatgagcgcggcgagagcgaaaaccagtggtttgagcgccatttgaggtttcatggtgtttctccttgcttctaattagttgggttaagtgttggtacggtctaactaacgtctaccaagcggttacttgatagtgatacccagggtgttagccactcggttccccaccccggcactctggttcacctgaatcacacctcggctgccggtgaaggcctggtcgctggtaacgacctggcggctgccagtggtgggggtgagccctgagtcagttgccagcgtcgtcgtgttctgttgcaacaggacgctgtcatcgatgctttgcgggccagggttgaggctgatccgcagcgcattgatcgattggttattggccccggccgactggttgacgcccagtacacctttgccattggtaaaagaggtgccctggatcgtcgccttggcgttcagggccgggtcgaccttgccgttgaggttctggatgtcgacggtggtggcttggccaccgaacgccatggcgcggctgttggagctttgctgctgagtgccggccgcctggttgatcgacatcaaaccttcgaaatgctggccgctgttgttgatcacggcggtgttgtcggccatggccaaggcgctgcccagcagggcgaacatcaacagggcacgattcatcacttgccccccagcatgttgccgaggttgttcaagggcgccatgccgcgctggatcgagtcgctgatctgcccgcccatgctgttgcccgcaccatggccggcggctgcgccagtgcccagtgtcgacatgccgtgctgtgtggtgccaaggccagacaaactggcattgggctggatggagcgggcgaggcttgcgccgctgctgatgccgccaatatccgcgtcgctgagttcgccggacagggcgttgatgatctctttgctggggttggcgttggcggtagtggggtaggggtcggggccgaaggccgggcggccgaccatatgcccctgcacattacgacccgtgacgataacgccgtcaccggcaaagctcggaatactgataccggcgctgagtacacagccgaccagcagtgcggtcatcgaaccttgagcaagtgtgttcacggcggcagtccttatgcttcacgctgaccctaaacagcgttgtcagggaaagagcagaagccgtgccgcttttgattttttgttgatttacagtgggttatgtttaaagccaggcaaagtgatggcaacgctgtttcaacgttgaaacagtcccccggcgcttgagacaggcccatcctcacctcgcactgtctcagcgatgtaacaccgcccatgacaaatggatgaatccgcacaatgcgggcgattcaggggcgggaagtgtttcaaaactgagactgcgggcgtgagcgaacccactcctgcatggggtctcaacccttgggggttttacctgggatggaattgagtacggggttgccgtcctggttctgggtcagatagaccggcagtaccttgggcagggagggaacgaggttgctgacttcattgatattgtagatgccgccgatgcggatcttgccggtaccggcgtctgcgagcatgaccggcgttttcaggtaacggttgatcagcggcagcgcatccgtcaggggcaggttgtcgagcaccagcttgccgtggcgccatgccagcgcactgtcatcggggctgatggcggcgacttgcggggtgtcgtcaccctggcgaaagctggcctgcatgccagggctcagcggtacactggcgtgctccgcgtcgctggaaacctgcaccgagccttccagcaatatcacccgcacctgttcgtcgtattcccagacgttgaactgggtaccggttacccgcacctggccttcgccggcccgcacgataaacgggtgttcgcggtcgtgggtcaccttgaagaacgcttcgccctttttcaaggtgacccggcgctggtccttgtagtggctgtagaccagctcggtgcccaggttcaactccacttggctgccatcgcccagagtgattttttccaggccattggttgcctcgaaatgttcataagaactgggcaaccaaccggcttcccagccggtaaaggccgcaagcggcaatgcgccaaggcagaccgctgcggccactgcgtagttgcgtaaccggctgcgtggcttgacgggggccaccgtcggggcaggtggggggcggggcaggtgatcggccacctcccagatctccagcatggccgcatattcgaaggcgtgcagcggatgagcatcgtgccattgcgtaaaagcctgacgttcgctcgccgtgcaatcggcggcatgcaggcgcatgcaccaatgcgcggcggcgtcggtgatcgcatcgtattcggcgtctgaaaggggcttttcgctcattgactcatcctggtttgccgcattctaaccccccgaggcaggcggcgagaaccgccatcatggcgattgcacatcaattggaacttattcttatttggtaatacctaaaatatcaggacaagtgtccggcattcccacaatggagtacgaatatgttgaagaaaaccttagtcgccctgtgtgcaaccactgcgctgctcagcgctggcgccgccctggccgataagccgggcgccggctggatccctattgagaaggccattgaagtggcgaagaccaaggctgggtatgtcgaggtctattcggctgaagccgacaacgacggttactgggaagtcaaaggtcgcaagtccgacggcactgtctatgaagcccgtatcgacggcgcctccggcaatgtcctgcgcgaccagaaagactgatttgcccgctgggggcctgctcaggcccccacatcaagcatacgccccagatgcgttatcaggtaagtgactgagtctgcgttggatagaatcacgtcaatgcgcttgtcaacgttgctcataaagatttgcctggcttcaatcaggttcttggcaccggtggtgctcaggactttgcgcttgaggtagtgggtggtagtgaaaaaaccgtagtcctcccaggtattcgaaacatcatcccacgtcttgaacaatacgctggccggcgtcaatgtggacaaggcagtggtttgcaaatcatcctggcgggtcttcaccgcctgggcgccaggcttggcggtgtcgatcaggtcgcgaaacggctctaagctgcgcaggtaggcaatatctgctgtctcgaacctcaggtgggtcagttcatgaatcagggtagcggccctggcgtgggccgacatgtcgaagggaacgctcaacctgtccaggtaatccgacatgttcggatcaaagaatcgctcgaataaatacactttgcgttcgctgtcagtgaccagcaccatggcgtattcactggtaggatccaccaggctggcgccgctgacgaaacgcatcgagtcagcgctgatcaacgtggggtcactcaactcgtccaatattccgtcgacaatgtgctcgattttcctgacctggtctgggctcaggttgagggtgccgaacaggtcgcacaagaacaggccgacccggctgtctggcgtgagcaggtttgcaaagtgctggatgttgcgcttgcagttaacggcatagtaggtcgccacattcagcgcttcgtcgatggcctgggctttccagctggacactgaggcaatcgccctgataccccgcgcttcaatattgatatcgtgccgttcggcccgcagcactttgtggcgcgtccaggcttgaccgaagcgcggcttgtgtatggccaggtccaccacccatctcccctcggcgttgcggccgacgtaagggccttgctgatcgtcgccgcccaggcgccagtggtccttggttttcttcagcggatacaccttgccgcccagtggcacatagtctttggcgctggtcttgtccttgtagacatgggaggcggtgttcagctcaaggtcctgcaggtcgatgtcgtgttcctcgaactgttgcaaccgcgtacgtgaggtggcggtgaggtccaaggtggccagggtggtggccgtgggcagtgtgccctccggcaggtcgacgacctctgcctcatcgggcggcggggtttcgctgccgtcgagttcactgtacagcgaggccatttgcaccacggccaggatgaagtccttcattgcggctttccactggtgcagttgcaacgcttccatcgagcgcttgaccagcttgtagctgcgccagaccaccagcggataggcgagtttgcccgccatgaagtacaccgccgtgggaatccccttgccgagtaggtcgacgaccttgtcccagagcagcttggtgccttttttgaactggcaggcgagcatcttgagcaggatcagcgtgttttcactgaacaggtaatgcagcaggttacccatgaccggagccgaggcaaggtggacttccgatgggcgatgacgattgtcctgccacaagccacggtaaatggcctggtgcggatcctccaggtgctggagggcccagtcctgcagctcgcccgggcgctccagttcatccagcaacgcttgttcgctggcgtattgcttgagcacatggtgctcgctgtagggggcatacagcaccacagggccggcctctttgctgggcgcgctgatcaggtacatgcccagtaccttggcggcagtggcgcctgcggtcgccaccaattccacgggccggatcagcgcagacgcgccctccagcgccgcgcgcgccaggccgtcgggcatgtcgaacacttgctggaccaggcccatggcctcgctcgagaggcgttcttgaagatgttgctcgtgggcatattgcaacacctgccaaggcaattgccggcagaaccgacgccggcgtgcacgggctgcctctgtgttggtgcccagcgcagtttgcaggtgcttctggtagatcgatttcaagtccaactgccgcaccatctggatcaccgcattggcatccagggtagggggcaagggctcggcgctacgtgagcgcgggcgaataatctggctgttcaggtccggccagtggcgcaaggcaaaatcggtcagattgtagtcgtggatatcgagggcctggtgtacgggaatcagcacgttatcagggctgatggtctgcttgggaaagcgtgcctggagcagctccagcagggcggaaaaggtatgctcgcggatggtcgtaatgccatgcaggtagtcttcctcctcgggggcgctgttgtgatattgctccagcagttcggcgtggtggatctgctccgcggctggcgccattgccagccagacgggcagggcctgctggttgaccatggcctcggccaacgcctgggcccgccccaggttggttggggcaggcgtctgcaggaccgcatccaggcggtcctgcacggcgcgcgcgggcaggtccattgccaacagatgatccaccgcgtccatgacgcagttgccgtaagttttcagacgatcatccagcaggttctcgtcaatacgttgcagtggccccaggcgatactgccgatgaggcacgcgttgggaaaacggcaggttctccagcagcgagaggcgtttgatcggatgctccaggcgcttggtgagggcctggagcagggccgggaccgaggcaaatacctcatggccgcgccggggcgtccatagagtcgcctggcccgagcgcctggggtcaaggccgccacgctcggtgattacaaacaggttggccaacggcagcagcgtatcgtacgtgccctgttgcaaggtcagtgcgtaggcatccgggaggaaaccgttgatcccatggcgggtcagacgcaccaggctgtcggtgcgcaacaccgtatccagaatggcatggggagcggtcggcagggttttccccagcagccgtagttcagcctcgctgcgcaggcccagcagcatcgagtgcgcatgtttatcgcgggtgttttccaggaacagacgcgggagttcacgcagatcatggccggcaaacacgttcagcacctgttcgatgatggcgttaaagcttttgaggcttatgttattgagctgttgggccacaccctggtcgcgctttgtgtagaaacccgtcctggatgacaccggcagcggtctgctttcctgggccaggcgctggatgaagtgttcaaccatgctcagggacgaaagcgccggacgctcctcgcgctgctgggcgcgggaggcgtaggtgttgatgttgacctcatcggccttgaggtccagcaggtgcttttgcagttgcatgtccagcgccacggctgccatgccgcgcagtgtcgggtgcttagcgagctcaatgcttaacccctcttgggcagcttgcaggcggcgcagatgcaatttggcgcgctcggccaggaccgtggaggggcggccattaccgctggtcacaggatggaccgtccagcgcccgttggtttccaggtcgaccaaccgatggtcgagcatggtgcggatgtccaacgcgtaatcgagcaaggcgtccagatccacctggccggcgcttgcgcgatagaggcccagggcgtggttcatgttactgatctgcttggcggcaatgtcttcgatcatgctggtaaacacatgccccgtgacggggcgcgcagcaatgtttatctggtccaggccgatgaagatgttgcgttcgtccagggacaggaaattaagcagctcatcttcgtgtccggcggccttgagcatgctcaacagtgtgtccttgaggtcatccaggtcttggagtacctgcaggccacgggattgggtgtacagataggcgtggttttcgtgcagcatcagggtgctggccaattccacgtagtgctggtagggcgcatagatacgcactttttccacgctcaggttggcggcgtaggcgctgcgagcggcctggtcgtctaggaacatggcctggagcatatggctatcggtggagctaaggatgccggcctggcgcttgagcagtatatcgaggcgaaatttgtcggccatgacttgcgcaaacagttgcaggcgcgaggtgccaccgtcgatgtcctcgttccagtaggtttgcagcaggctatcgagcagtttggacagcgtaccggaggtttgttcgacgaggcgctcccagtgttcccggtcttgttgcaactgggtcggggtgaagtcggtggtgacatgcttggggttgaagaactcgcgggtttgccctgtaggccaggcgtgtttcacgtagaacagcaggagcgcttcccgtagcggcagcgggtcgatccagcgccggtcggcatccgtcgggctttgcataaagcaattgacccgcgtatcccgttgatccaagccggggaaatacggatgggccatgatgccgagcagggtgtcgagcataccggacagggtcggggttttctgcaactgagccaggatggcgtgtacgttggcctgctggcaggcctgcagggtttgttcctggtccgccatgacggcaccttcgactagtagggttgtcagcgtcatggccgtgcccaccggcaggctgttgcgctgggcgatcgacaggaaactgagcaattcgacgcgctgaaccgggtcggccagtgcctggctgacctcggcgagcagcgtggcatgactgtcaaagacttggataccgccgtagggggtatacagcagggccttgctaccgtccgggctggggctcatcaggaacacaccggccagtgggatcacggctttgcccgctaccgtgagcaacagcttttcgacacgcatggcggggctttggaggcggctatcctgacggctggcagcgctggcgtaatacacgccatgtagccattccaggtccttgaccgtaagccccagggcgcgctcgcgctcgctcagtgtcgaacgattgacgggttgcaaaaattcgtcgaaaaaatacggtggggtgacgcgagtcatggcctggctccagcgtgaatacggaaacgcagggtagtcaggcccttgtaccgggcgggggtaactattgagccaagcggcaagttgacagtgagcgctgtgcgtggtgtttaatcgacgatctggatttgtccattcgttgccccttccaatcataaaaacggagcttcaaatgtctgcacagtctccgacagtcgccacggcttcgacctcgatcccgttcaccgagctggtgaccttgctgcaacaggtatttgttcggcatggcacgtcgcccgaggtggctttggtgctcgcgcacaattgcgccagcgccgaacgcgatggcgcccatagccatggggtgttccgtattcccgggtatgtctcgacgctcggcagtggctgggtcagcggcaaggcagtgccggtggtcgaggatgtcgcctccgggtttgtacgcgtggatgccaacaacggcttcgcccaaccggccctggcggcggcgcgcagcctgttggtggagaaggcccgcagtgccgggatcgccttgctggcgattcgcaattcccaccatttcgccgcactgtggccagacgtggagccctttgccgaagaaggcctggtggccctgagcgtggtcaacagcatgacctgcgtggtgccccacggcgcggatcggccgctgttcggcaccaaccccattgcatttgccgcaccccgcgccgatggcccgccgattgtatttgacctggccaccagcgccattgcccatggcgatgtgcagattgccgcacgcaagggcgagcgcttgcccctgggcaccggggtcgacagcctgggccagccgacccaggaccccaaggccatccttgagggcggcgcgttgttgccgtttggagggcacaagggctcggcactgtcgatgatggtcgaactgttggcggcagccctgactggcggcaatttttcctttgagtttgattggtccaaccaccctggcgcccgcacaccctggaccggccagttgctgatcgtgatcgatccggccaaaacggcagggcagggcttcgccgagcgcagccaggaactggtgcggcagatgcatgcggcagggttgaggaggttgccgggggatcggcggcatcgcacgcgggcgaaatcgttgcaggagggaatcatgttggaggtggaggtattgcagcaattgcgcgagctggcgagttgaaacaatggcgtggcagcggtgggccgctgccacgccatgggtcagttgcggcgacccagcaacaggccgaccaccaggccgaaaccggcggaaatcgccacggtctgccatgggtgtccaccgatataggtctcggtggcatcgaccaccggcttgctgcgttcacgcacgctggacagcgagtccagggcttgcttgagcttgatggcgacctgctcgcgcagggtttcaccttcttcgcccaccagggatgcgctgttcttgagcagtttgtccgactcctcgatcagcgcggtcaattcgctgaaagcttggtccttgatttgttcttcggcagcttgggcggcggttttgcgggccattggggtgactccttgcaggtgaatgtgacagtgaacaatggagtgtcgggcagcggcaaaagttgcagttattttcccgggcgttcatctgcggaaaaatccggatcgggaactttagacctacagtgtaagatgtcacctatttgtgcagcaggtaacttaacatgagcttcaatctcgccaacaagaccctcgccgaacgcgccgagctggaagatgaaaagtcccgcctctatgacctgtggcaaaccaacctgggcaaggccaagggcgaagccgcgcggttgttcggcgagcgcgccaagcgcaagggcaagtgggccgaatgggtgcgtgccgaactggacggcatgtcgccgccggagttttccaacatggtgcgcagtgaggtcaacaagctgatggcggcggcgaagtaaagcacgccacaaccgcctcgcgcaccttgagcaacagcggatcaagctgggtctgggtgcgccaacccagctccaccgggtaacgcggcagcgccaacgggcagggcaacacctgcaggccggtcatctgcgcgatggcctgggccgcgtgcccgggaatcgtcgccactgccgcgctgcctttgagcaggtacggcagcgcggcgaagtggctggtggacgcgcacacctgacgtctcaagccctgcgccgccaagccttcgtcggtaatgccgataaagccgcccgacgacaccagcacatgctcccgtgcgacgaactcctcaaggtcgatacgttgctggccgggcgccaggctggacgggtctaccaggcagcgataatcgccttcccccagtacctgtcgactcaacctgcgctcggcaaaaccgccggcggtgacagccaggtccaggttgcggtcaagcagggcgccagcgacgatctggctgtgggtctggcgaaagattacccgcagttttggcaggcgctgagcgatggcgtccatcagtcgacggccgtaggcaatctcgaagtcgtcggacagccccaggaccaccgagcgcccctcgtagtgcaggttatccgggttgatcatcgccaggctctgccgacagcgatccagtgcctcgctgatcaccggtttcaactgattggcgcgcaatgtcggcgccaggccgcggccggtgcggatgaacaatgggtcgccatacacctcgcgcaaacgccgcaagccggcactgatcgccgattgcgtcacccccaggcgcaacgctgcgcggctggcgctggactcgtcgtgcagggcttcgaaggttttcagcaggttaaggtcaacctgggcgatattcatttggctcatatcatttagcactggagtgggctttattcatgatcgagcctggccggagaatgggcaacccccactttcggagtgattctgatgcctgtttctatcgtcgctgccttgcaaatcggttccttgcccagtggcaaggctgacacccttgcgcagatcctgacttttgaagatgagattttgcacagtggcgcgcaattggtggtcatgcccgaggcgttgctgggcggctaccccaagggcgaaagcttcggtacacagttgggctatcgcctgccccaagggcgtgaagcgtttgcgcggtattttgccaatgccatcgacgtgccgggcgtggagaccgaggcgctggccgggttgtcggcgcgtaccggtgccagcctggtgctcggggtgattgagcgcagtggcagtacgctgtattgcactgtgctgtacttcgaaccctcaagtggtctggtcgccaagcaccgcaagttgatgccgaccggtaccgaacggctgatctggggcaaaggcgatggctcgacgctgccggtgatcgacgctgcagttggacgtatcggcggggcggtgtgctgggaaaacatgatgccgctgctgcgtaccgcgatgtacgccaaaggggtggaggtgtggtgtgcgcccacggtggacgagcgcgaaatgtggcaggtgagcatgcgccatgtcgcccatgaagggcgctgttttgtcgtgagtgcttgccaggtgcaggcatcgccagaggcgttgggtgtcgaggttgccaactggcccgcagatcgcccgttgattgccggcggcagcgtgattgtcgggcccatgggtgacattctggccgggccgatgctgggagaggcggggttgttgacggcgcagatcaataccgatgacttggtgcgggcacgctacgattatgacgtggcggggcactacgcccggccggatatttttgaactgaccgtagacgagcgcgcccagcccggcgttcgcttcatcactgactgaaccgggtcaaaccaaagcttttgtaggagcgagcttgctcgcgaaaaacccataggcgccgcgtttgttcaggaaacacgcgttatcgttgacgtttttcgcgagcaagctcgctcctacagttgatcttcagcatttcgcggatttggatcagatctttctcgcatcaccaggtggcggtattgggcaaatccagggtgccacgctctacaaagcgcatggtgccgaacaacccgcccgccagtttgccacgcagcacgtagggcaggttattcaggctttgggtctggctcaggcccagggtctgacgcaacatagaaaacgccgaaacactgaccggcaccatcagcaccgtctcggagaaacgtgggatgctgccggcctggtcactcacgcctgaggccaacggtcggccattgacttccaggtccagggccacgccgttgtagtcgatcgcggtttcattggggttctgcacccgcagcttcaccgcgaagcgcacttccaggtcctggctttgcagcggctcgatgcccactacgttgatgttgaccgggtcacggttggggaacagcgcgcaggcgctcaaggtcagcagcaacagcgatagaaccatgagcttgcgcatatgaaaggtgctcctattgtttcgtgacgtcggggtcttgcatgaccttgagggtagaagactccggatcgaattcatcttcttccagctctatgaactcttcgggcaggaaaatgttcagcaggattgcacagaacgcacccacggtgatgggcgactcgaagatgttgtgcagcgccttgggcaggtcgcgcagtacttccggtacggcggcaacgcccaggcccatgcccagggagattgccacgatcagcacattgcgccgatgcaggccggcttcggcgaggatcttgatcccggccacggccacggtgccgaacatgatcagggtggcgccgcccagcaccggcttgggcatcagttgcagcaccgcgccgatcatcgggaacagccccagcagcaccagcaggccggcaataaaataggcgacgtagcggctggccacgccggtcaattggatcacgccattgttctgggcgaaggtcaccatcggcaagctgttaaaagtagcagccatcgccgagttgaggccgtcggccagcaggccggacttgatgcgcttgatatacagcgggcccttgaccggttgttgggaaatcatcgaattggcagtcaggtcaccggcggcttccaggggcgaaatcaggaagatcaccgccaccgggataaacgccacccagtcgaacgagaaaccatacttgaacggcaccggcacgctgatcaacggcacctggggcagggcggccatgtcgacccggcccagccaccacgcgacgaagaaacccaggctcaggccgatcacgatcgaacccaggcgcaggaacgggttgctgaaccggttgagaaccacgatggtcagcagcaccagcgccgccaggcccatattgcccgcggcgccgaggtcgccggcgccatagccaccggccatgtcggtgactgccaccttgatcagcgacaggcccatcagggtaatgatggttccggtgaccaccggggtgatcagcttgcgcagcttgccgatgaattggcttagcactacctcgataaacgcggcgaaaaagcagataccaaagatcgtcgacaggatttcatcggtgccgccgccccgggccttgaccatgaagccggcgctgagaatcacgctgatgaacgaaaaactggtgccttgcaggcacaacaggcccgagcccaccggcccgaatgtacgcgcctgcacgaaggtgccgagccccgagacgaacagcgccatgctcactaggtacggcacctcgctttccaggccgagtacgccgccgacgatcagggtcggggtgatgatgccgacgaaactggccaagacgtgctgcagggcggcaaatatcgcggcggtgaagtgcgggcggtcttccaggccatagatcaggtcggatttatagcgcgggcggggggcttgagcgtcagacaaaatgatggctcgggtcggaaaatggaggcgaagaatgccagaaaccgccagccgtcagaagtgtaaaaaaatattaataaagaccctgcgcaaaaccccggccccggccgatagtaaatataggcccacattaaaaccacaacagtggtgaccaaggtctggccagtgcgttgacgctgacggatcgtttcgcggcagggatgctcgcaaacactacttctgagagcagccctatgtcccttcgtcatctgaatatcgcccctcgagcgtttctcggtttcgccttcattgcagtgttggtggtcatcctgggggtgtttgcggtcaaccgcatgacgcagatccggcagtcttccgtggacatgagcgcaacccagctgcccagcgtgacgtccctgggcaacatcactgaaaacgtactgcgcatgcgcatcctgtcgttccgggtgttggtcaatcgcgaaccggctgccctgcaggaagccgaaacccgcatcggcgtactgaccgacaaggtcaaggctgcccaggcccattacgtccagttgccgatgggcgagcaagaggcagtgttgtacaagaccttcagcgtgacgctggataactacttgaaggcccaggccgacatgctggtgctgtccaagcaaggcaaggtcgatgaaatgcgtacgctgatcaacagtcgcatcaaggacggcaccgaccagatgggcgagcagttgaacaagctgatcgccctcaacgccgccgatgcgaagaccgctgacgcggcggctgggcaaagttatgagggcgcaatcaccggcgtggtggcggtgtcggtggtggccgcattgctcacggtgctgttggcctggctgctgacccgcagcatcgtcacgccattgcgcaaagccgtggaagttgccgagaccatcgccgccggcaacctcagcaaaaccttcgcggacgatggcaaggatgaacctgcgcgcttgctcagtgccttgtcgagcatgcaggccaacctgcgccagaccatccagcatatcgccggctcggccacgcagctggcgtcagcggcggaagagttgagcgctgtcaccgaggaagcctcccgcggcctgcagcaacagaacaatgagatcgaccaggccgccacggcggttaacgagatgaccgcagcggtagaagaagtggcgcgtaatgctgtctccacctccgaggcctccgggcagtccaaccaggcggcgcgcgatggccgcgaccgcgtgatggacaccgtcggcgcgatccagaccatgacccaggatgtgcaaaacaccgccgtgatgatcgaaggcctggcgactcaaggtcgggatatcggcaaggtcctcgacgtgatccgggcgattgccgagcagaccaacctgttggcgctcaacgccgcgattgaagccgcccgcgccggtgaggccgggcgtggctttgcggtggttgccgatgaagtgcgggccctggcccatcgcaccgcgcagtcgacccaggaaatcgagaagatggtcgccggcatccagaacggcaccggtgaagctgtgcagtccatgcagcaaagcaatcaacgtacccaagccaccctggaaatggcccgtgctgccggcgtggccctggagcagatcacccagtccatcagcctgatcaacgaacgcaacctggtgattgccagcgcgtcggaagaacaggcccaggtctcccgcgaggtggaccgcaacttggtcaacatccgcgacctggccacccagtcggcggcgggcgccaaccagaccagcgcagccagccatgagctgtcgaggttggcggtggatttgaatgggatggtggcgcggtttgtaatctgacctgatttgaaacgcggtcgaatgtgggagtgggctccctcccacatgggttcactgtttccagacagccgcgttcaccaggttttgtggccgctcacccgacaaggcctgcagcagattatccaccgcacacttggccatcgcctcgcgcgtttcatgggtggccgagccgatatgcggcgtcgccaccacgttgttcaagcgcagcaacggcgagtcgtggctgagcggttctttctcgaacacatccaaccccgccgcccggatggtgcgttgctgcaacgcttcgaccagcgcagcctcgttcaccaccttgccgcgtgaaatattgataaagatcgtctccggccccatcactgcgaactcttcggcgccgatcagcttctcggtttcggcggtcaacggcagggtcaggcagacaaaatccgcctctttgagcaagtcctggaggcttcggtactgcgcaccaaagcgcgcctccaccgcaggctttggcgaatggctgtggtagatcaccggcatgccgaagccaaaatgcccacgctgggccaaggcttcgccgatgcggcccatgccgatgatgcccagcgtcttgccatgcacatcgctgccaaaatgcgccgggccgatgttcttgttccactggccggcacgcaccatgtcggccaactcgaccacacgccgggcggtcgccaggatcagcgcaaagccggtgtcggcggtggtttcggtgagcacatccggggtgttgctgagcaggatgccgcgttgggtcaggtaatcgatgtcgtagttgtcgaccccgaccgaaacgctggccactgcttccagcttgggtgccaggtcgagcaactgggcgtccaggcgcaggcttgcacccaacaggccatgggcgccgggcagcgcatcgcgcagtttggccaggccggtctcatccagtgcatcgatcagcgtgacctcggcctgctcatgcaggcgagccatcagcggcgcggagagtttcttgtacaacacaacggactttttcatgaggtttttaccttcaactccagggttggcgccggcgagcggtcactggcgccgggcttgaggaaaatcgtcagcaccaccgacagcagcagcgcgccgctcatcaacaggtacgaagcgccgggcgaaccggtgctgctgttgaggtagcccaccagatacgagccgccgaacgagcccagcgcgcccatgctgttgatcagcgccatggcgccaccggcgacgttggccggcaggatttccgggacgatggcgaagaacgggccgtagggtgcatacatgcatgccccggcgatcaccagcagggtgtaggaccaccagaaatgttcagcgcccaatacgtaggacgcgtagaaagcgatggacgcgatcagcaacggtggccacacaaaacgcttacgcttttgcagcttgtccgagccccaggacaccacgagcatgccgatcaccgccgccaggtaaggcagcgccgagagccagccggcttcgaccatgtccatctgcaagccggccttgaggatcgatggcagccacaacacgaagccatacacgccgatgctccagcagaagaattgcagggcgaggatgatcaccttgggtgaacggaaggcctcggcgtagttcttcaccgccttgatccccacctgttcggcggcgagggcggtttccaggtcttttttatgctgttcactgagccacttggcatcggcgggtttttcatccgccagtttccaccagataaacgcccacaataccgccggcaggccctcgatgataaacatccagcgccagctgaaatgctgcaccaggtagcccgagaccaccgacatccacagcatggtcaccgggttgccgaggatcaggaaggtattggcccgcgagcgttcggcacgggtgaaccagtggcacaggtacaccagcatcgccggcatcaccgccgcttcgactaccccgagcatgaagcggatggcgatcagcatataggcgttagacactacaccggtcagggtcgccaggccgccccagaggatcaggctgacgaagatcagtttcttgacgctgcgcttctgcgcatagatcgccccgggtacctggaagaaaaagtagccaagaaaaaacagtgcaccgagcagcgaggacatgcccggcgtgatcatcaggtcttcggccatcccggaggcggcggcaaagccgtagttggcgcggtccaggtaggccaggctgtaggtgataaaaacgatgggcatgatgtaccaccagcggcgggtggcgagtttcacggtttccatggggttgctcctgagcttgttgtagttgtggcaacaggtaatgggtcaagcaacggatcgtgtgggcagttcgctgcggctgggcaagccttccatatcgccacgactctgcacggcgcggctgccgatccagttaccgcgctgcaccgcctcggggaagcttgagttttccagcagggcgctgatcatgcccacggcaaaaccatcgccggcgccgacggtgtccaccactgcttccaccttgacggcagcgacaaagccctggtccatgtgggtgcggtaataggcgccgtcggggccgagcttgatcgccacggcttcggcgccctgatcgaggtagaacgcggcgatgtcggccgggtcgtcgaagccggtgagcaggcgaccctcactcagaccgggcaatacccagtcggccaggccggcgagggcgttgatgtcgcggatcatctgcgcctggctggcccacagggaggggcgcaagttcgggtcgaacgacacactgcgtccggccttgcgcatctgcgtcatcagctcgaaggacagttcacgggtggcatccgacaatgccggtggaatcccggtggcgtgcagatgacgggcttgaagcagtgcggggctgatatcggcgatggacaaatgactggccgccgagcctctgcggaagtactccacctggggatctgcgcccgcttcttcacgggacttgagttgaaaaccggtggggtgcagtggatcgactgctacatgacggcaatcgagcccctccttgctcagcgtctcgaccacaaaacgcccgagagagtcgttacccacccggctcagccaggcgacgttgaaccccaggcgcgacaaaccaatggcgacattgctgtcggcaccggcaatacgcttgtggaactgcccgacctgggccaggtcgccggtctgctcagcgacaaacatcgccatggtttcaccaaacgacaggatatcgatctcagacatgggcattctccacacggggttggccaaggtgggcgagggtggcgacctgctgcgcggtgacctcgatcaagtcatcgccctgcaacggaaattccaccgcccgggtaataccttgagtcatgtgcttgagcagttgttcccacagatgcaggtcggtggcgccgggcggcaaggccaccagcttgccgtccgggcgacgggccacggccttgcagtgcaggtaatccacatgccggcccagcaggcgtgcggcggtgagcgcggattggtcctgccactgccagttgccgatatcgaaagtcatcttcaccggcaggcccaggcgttcgacttcggtgaaaaaccgctgcatcggttcgatgcgcccaccgtgcagggtctgatcgttttccaccagcagcttgaccgggtggcgattgagcagggcgtgcaggctttccagatcgttggtgtcggtgaagtagccgagggagactttcagccagcccgacccgaacgcctgggcgcggtccagggttgcggcgagttcggcattgggctgggcgcggccggcgacccagagttccaggggcgacgaaaacacgctgttcaggccttgctcggcggcggcctgggccaaagtggtgggatgttcgttggtcagcagctcttcacgccattcgatgcgttgggcgccggctgcgctgagcagcgcgacaaaactcaattggccctgctggcgcacaagctcggcgccgtagctggaaaggctgatggagacggggtatttatgcattgttgtttacctctgaaaccggtttcattttcatacgcagaacaaatgtgtgagggggcttgctcccgatagcagtgggtcagctaaagatagctgacggacataccgccatcgggagcaagccccctcccacagggcgttgtgtggagccgcgaacaatcagctcgggcaagaaatccagggtgcgggctggtgccgtgtcgccgcgcaggcgcttgagcaagcagtcgaaagcgctggcgccaatcgcttgcgtcggctgggcgagggcggtgatgccgttgcccaccagcgggtaccagtccaggtcatccagggcgatcaggccgacatcgttgaacagctcgcagcctaatgccttgagcccacgtgtgcaggccagcgcagcaacaccgttggcgcaaaaaagcgccttgggaccgggcttggccaaaaaggtctgcaggcggctttccagttcgtcatccaactcaaccacggcaccggtcaagcctgggcgcctggcaatctcggccttgaaactctccaggcgctccaaacgtgagctggtgccatcggtggtctcgctcaccagcagcacatcgcggtagccctgctgttcaagatgttccaccgcgatacgtaccgctgccgggttatccaggcccaccaggtcgctgtgcaagggttcgaccttgcggtcgaccagcaccaggggcatttcccgttgcagttccagcagttggtcgaggtggtggccgagggtgttcacgataagcccttcgatgttgtacgagcgcagcgccgccaagtgctggcgctcctgttcgtcatcgcggtcggtgttgcacaccaccaggctgtagccgtgctggcggcaggcggtttcgacgccgtgcatcacggcaatggaataggggttgcggatatcggctaccagcataccgatcaggcgcgtacgcccacgcttgaggccgcgggccatctggttggggcgatagccgagttcgtcgatagcctgttcgatacgcagggcgatggcattggagagcagggcacggtcatcgccgatgaagcgcgagacgctggccttggacacgccagcgcgctcggcgacgtcgagcatggtcacgcggctacgctgggcagcggaaaagttgttcacggccattgaccttctgttcttattggaatgactgaaaccggtttcaggaaaccattaaagtaggaaagtcgtcaagaaattgtaggacgtgaccggatgaccgggtgttcagcgaaacacgctcacccaggttgcagctagcagcaccagcgccatcgcgcgattgaaccattgcatggcttgggccgaccgcagtatccgggctgaacccgagcccagcagtgcccacagacccaggcagggaagtgaaatcagaaaaaacaccaaagacaggtacatcacctggctctcgcgttgcgcgccagtacccgcaaatacgctcaccactgccagcgccatcacccaggtcttagggttgaccaattgcagcgccgcggcaccggacaggcccaagggttcctgcctggcatcggcctggatggcttgagccggggcgctgaagattcgccaggccaggacactcagccaggctacgccgacccattgcatcgcggtttgcaccttgggcatttgcaccagcgactggccgatcccgcagcccaccagcagcacgatccccgcagctcccgcgcaggcaccgaaaatgatcggcagcgcagccttgaaaccgtaacgggcgctgttgctcagcaccaggatattggtgggcccgggggtaatggaggcgacgaatgcaaacagcatgaaagggaacaaggtggactgcatggcggggagactccgatgaaccaatcgatggagtcgagcttcacaaacccacgcgctacctgtctggaagatttgagcaacgcttgcgataggccgccggggtcaggccgtaggcgcgcataaaccagcggcccaggtggctctggtcggcaaagcccagcagagtggccacttgcgctggcggctcgcctttagccaacaagtgccgggcacgcgccaggcgcagttgcaccagataagcatggggcgccaagccgaaggcgctcttgaaggcacgggtcaggcggaagcggtcgacgttgcaggcccgcgccagttcatccatacccacgtcgtgatgcagatgtgcatgcagatattcccgggccttgtgggccacctgtggcagacgcgggtctggatgataacgggtgcgccagtaaagttggccggtgatgagctccagcaactggtccatcgcacgctggcgcacgatgcgcaattcgctgctgtgcagcgactggaacgcttgactggtggccaacgccaggcgtgggtcgcagatcaaggtatcggcaaagctcaactggctgttggcaggcgcctcttcaaataccgcactcacttcccgcgccagccattgcgggtcgaggtagagcatgtgataggtgaagccatctacggttggtgcgtcgccgtcatgcaactcgccgggctccagtaggaacacctggccgggtacactgttatggcgggtgcggcggcaattgaactgctgcacgccttgttcggtgacgccgatcaggtagctatcgtgccaatgggggtcgtaggcgtggccttcgaaatgcgcacgcaacgtctcgatgccggtgtcggcgtcctgggacaggtcgatccaattgtgcgcggccataaaccaccgagatggaaaagttaagcgtattcatgctcggcggttgtgtgagcgtctagaaggtttgtgcagccctagccgaacagcccggcggcgatgttgatcgaaaaccccaggatggcggtattgaatagaaacccgatcaacgactgccccagcaccaccttgcgcaggccacgggtagcgacgccgacatccgaggtttgcaccgccacaccgatggtgaaggaaaaatacaagaagtcccagtagttaggggtgagcaagccttcggcaaagcgcagcgccggttccttgcccggccaagtgtaatagagcctggcgtagtgcacgctgaaaatcaccccgatcagcagccatgagccgatcaccgtcagccctgtaaagccgtagtgcagcaggcgctcggaggtggccaggtccttgctgccgaccagttcgaaggtaatggtcgccaggctggcgatggcggcgatgcacaccatgaacagcaccaggccggcgttctcgtcctcgatttcggcgatgcgcttgacatcttcggccttggcgcgaatggtcagccatagcatcaataccaggtaggtccagactccggcgttccagccgatcaggattttgctggcgagagtgtcggccggtaccagaatgcccacgacaaggcccagtacggcggcggatgagaggcgagggtgggtgcgggcgaggaagggcatggttggtcacagctggcgatagttgagcagactgtacctgatcctgtgggagggggcttgctcccgatggcagtgtatcagtgccaaatatgctgactgatacaccgccatcgggagcaagccccctcccacattggattaatctttgttgtgtcgcttgcgcaccagcttcatcaccaccacaaaaaacaccggcacaaacaccaccgccaaggtcgccgtgatcatcccgccaatcacaccggtaccaatcgcctgctggctggccgaactggccccgctggcaattgccagcggcacaacgccgaggataaacgccagcgaggtcatgatgattggtcgcagtcgcaaccgtgcagccttcagggtggcgtcgatcaagtcctcgccctggtcatacaggtccttggcgaactcgatgatcaggatcgcgtttttcgccgacaggccgatgatggtgatcaggccgaccttgaagaacacatcgttaggcatgccacgcagggacacagccaggactgcgccaagcacgcccaggggcaccaccagcaacaccgaagtcgggatcgaccagctttcgtacaaggcagccaggcacaggaacacgatcagcaacgacagcaccagcagcaacggtgcctgggagccggacaggcgttcctgcaaggacaagccggtccattcctggcccaggcccgcaggcaactggctgaccaggcgctggatttcctccatggcctcgccggtgctgtgccccggcgccgcttcaccgctgatggcgatggccgggtagccgttgtaacgggtcaactgtgtcgggccctgggtccacttggcttcgacaaaggccgacagcggcaccatcttgccggcgttgttgcgcacgttgatcttcatcaggtcggcaacctggctgcgctggtcgccttcggcttgcaccaccacgcgctgcatgcggccctggttggggaagtcattgacgtaagccgagccgatcgcggaagacagcacattgcccacatcggcgaacgacacgcccaaggcattggcctgcttgcggtcgacttccagctgcacttgcggcgcttcggccagggcactttcgcgcacgttggccaggatcgggcttttcgccgccgcgtccagcaattcggtacgtgcggccatcaacccggcatggccgacgccaccgcgatcctgcaggcggaactcgaacccgctggaggtgccaaggccatccaccggtggtggcaggatcgcatatgcaatcgcatccttgagttcgctgaaggccatgttggcgcggtctgcaatcgacgctgccgagtcatcgctgccgcgctgtgaccagtccttgagcgtggtaaacgccagcgccgcgttctgcccggcgccggagaaactgaagcccatgatcatggtggtgtcacccactcctggctcctcggcgttgtgcgcctcgatctgctcggccacctgcaccgtgcggttcttgctggcgcccggcggcagctggatatcggtgatggtgtagccctggtcttccaccggcaggaacgaggagggcaagcggctgaacaacagccccatgcccaccagcaataccaggtagatcagcaggtagcggccgctgcgcttgagggcgtacgccacccagccttcatagcggttggtgagttggtcaaagcgcttgttgaaccagccgaagaaaccgcccttggcatggtgctcgccctgggcaatcggcttgagcaaggtggcgcacagggccggggtcaaggtcagggcgaggaacgccgagaacaggatcgaggtggccatcgacagcgagaactgctggtagatgacccccacggaacccggcatgaacgccatcggcaggaacaccgccaccagcaccagggtgataccgatgatggccccggtgatctggcccatggcttttttcgtcgcgtccttgggcgacagaccctcggtggccatgatgcgctcgacgttttccaccaccacgatggcatcgtccaccaggatgccgatggccagcaccatgccgaacatggtcagtacgttgatcgagaaacccagcaacagcatggtggcaaaggtgcccatcagcgcaatcggcaccaccagggtagggatcaaggtgtaacgcacgttctgcaggaacagaaacatcaccgcaaacaccaacgccatggcctcaagcaaggtgtagaccaccttggtgatcgagaccttgacgaacggcgaggtgtcgtaggggatcttgtattccacattggccgggaaatagcgcgacagttcgtccatctttgcccgcaccagggttgcggtgctcagcgcgttggcgcccggcgacaattgcacgctgacggcggtggagggcttgccgttcaggcgagtagagaactggtattcctggctgccgacttcgacccgcgccacatcaccgatgcgtacggtagagccgtcggggttggccttgagcacgatgtcggcaaactccgcaggggtcgacaattggcccttgaccaggatcgccgcggtgatttcctgagtattggtgcccggcaagtcaccgatgctgcccgccgagacctgggcgttctgggcgctgatcgccgcgttgacatcggccggcgtgaggttgaaaccgatcagcttctgcgggtcgatccagatgcgcatggcgcgttcggcgccatacagctgggccttgccgacgccgtccaggcgcttgagttcgttcatcacgttgcgcgccaggtaatcgctgagcgccacgtcatcgagcttgccgtcgttggaggtcaaggtcaccagcagcaggaagccggcggagactttttccacctgcaagccttgttgggtcacggcttgcggcagtcgcggctcgaccaccttgaggcggttctgcacatccacttgggccatttccgggtcggtgcccggctggaaggtcgcggtgatcgtcgccgaacccaggctgctctgggattcgaaatacagcaggtgatcggcaccgttgagctcctgctcgatcaggctgaccacgctttcatccagggtctgggccgaggcacctgggtacaccgcgtagatttccaccttcggtggcgcgacgttggggtactgggctaccggcagctgcgggatcgccaggaagccagccagcaggataaacagggccaccacccaggcaaaaatcgggcggtcaataaagaactgcggcatgacgggttattcctttacgagcgggctgtcgtccacttcaactttttcaccggggcgcgcgtgttgcaggccctcgacgatgatgcggtcgccgggcttgaggccgctggtgacgatccagcgatcctcgatcaccgcacccaattccaccggttgctggctgacggtctgctcggcgtccagcagcagcaccatcgggatgccggcactgtcacgggtgatggcgcgttgcggcacactgatgccttgcttgtccacggcctgctccaggcgcacccggacgaaactgccgggcaacaggtcgaggtccgggttggggaactcgctgcgcagcgtgatctgcccggtgccagggtcgacgctgatctcggcgaacagcaatttgcccggcaacgggtacaggctgccgtcatcctcgatcagggtggccttggcctggtcctggccgacctgcttcaagctgccggcgcgaaaggcgcggcgcaggtcattcaactctcgggtggactgggtgaggtcagcgtggatcgggtccagttgctggataatcgccagcggcgtggcttcgttctggccgaccaacgcgccctcggtgaccagggcgcggccgatgcgcccggaaatcggcgcagtcacagtggcatagcccaggtttaacttggcacgctcgacggcggccttgttggcggcgatttcggcgttggcctggcgcaaggcagcacgggcgttgtcgtattcctggccgctgatggcgttgccttcaaccaactggctgtaacgctgctcctgcaagcgtgcctggaaggcattggcctcggccttgctcaggttggcctgggcactgtccaggtcggccttgaacggcgccgggtcaatacggaacagcacgtcgccctgtttcacatcgcgcccttcgttgaacacccgctgcatgaccacgccggcaacccgggcccgcacttcggcaatccgtggcgcggcgatacgcccgctcagttcgttggtgatggacaggggcttggcctgcagggtttcgatgcgcactttggccaggggcatttgtggcgcctcgtctgcagactgaccacacgcgctcagcgccagtgtgagggccaacaggcaaaacggcgcaaatagattcttcgacatgctcttatcccaatattgactggcgcatcctaaggacacctgcgccgtggtgctgtgaagctgtgtaggtcgtgtgtgaagaagtgtaaggtacggcgcgcgtggcgtcggtggcgtatatccttgcacaaccttgcttacaatgaagatcaaatgtgggagggggcttgctcccgatggcagtgggtcagttgcacaagggttgactgatccaccgctatcgggagcaagccccctcccacatgggatttgtgtacgacttatcactgtattttctggaaacacctccatgcccaacatcctcctggtcgaagacgacgccgcactctccgagctgattgccagctacctggaacgcaacggctaccacgtctgcgtgctcagccgtggcgaccatgtgcgcgaacgtgcgcgcctgaacccaccggacctggtgatcctcgacctgatgttgccgggcctcgacggcctgcaggtctgccgcctgttgcgcgccgactcggcgggcctgccgatcctgatgctgaccgcccgcgacgacagccatgaccaggtactgggcctggagatgggcgccgacgactatgtcaccaagccctgcgagccgcgtgtgctgctggcccgggtgcgcacgctgctgcgccgcagcagcctgtccgaaccccaggtggccaacgaccggatcatcatgggcaacctgtgcatcgacctgtcggagcgcaccgtgacctggcgcgagcaggcagtggagctgtccagcggtgaatacaacctgctggtggtgctggcccggcatgccggcgaagtgctcagccgcgaccagatcctgcagcgcctgcgcggtatcgagttcaacggcaccgatcgctcggtggacgtggcgatctccaagctgcgccgcaagttcgacgaccacgccggcgaggcgcgcaagatcaagactgtgtggggcaagggctatctgttcagccgttccgagtgggaatgctgaaccatgttccgtgtgctgctacgcctctatctgatcaccatcgtgacttatagcgcggcgattttcctgattcccaagctggtgatccagctgttcgaacaccgctacatggactacaacgtcgagcagtcccgtggcctgcaaaaattgatggtcaagcaataccagcgcgcgccggtggagcgctggtcccaggtcaccgaccagctgagccaggatttcgcgccgctgaaggtcgagctgctgctgcgccaggacgcccgctacacaccccaggaagaacagctgctggagcaaggcaagccggtgatccgcctgggcgagtggggctggatggaagaaatcagctcgccgatcaaccagcagttcgcggtcaaactcaccgtgccgccggatccgctggacatgaacctgctgtattggtcgatgaacgtgctgatcggcgcggcactgttggcgtgcctgctggtctggctgcgcccgcactggcgtgacctggaacgcctgaaaagcaccgccgcactgttgggcaagggccacctgggggagcgcacgcgactgccgcccagttccagcatcggcagcctggcggctgtgttcgataccatggcggacgatatcgagcacctgctcaaccagcagcgtgatttgctcaatgcggtctcccatgaactgcgcacgccgctcacacgcctggacttcggcctggccctggcgctctccgaagacttgcccgaggccagtcgcgagcgcttgcaaagcctggtggcgcatattcgcgagctggacgagctggtgctggagttgctctcttacagccgcctgcaaaacccggcgcaattgcccgagcgagtagaagtggcgctggacgagtttatcgacagcgtgctgggcagtgtcgacgatgagctggaaaacccggagatcgtcatcgatgtggtgctcgactgcacggttgagcgtttcagcctcgacccgcgcctcactgcccgggcgttgcagaatttgctgcgcaacgctacgcgttactgcgacaagcgcatccaggtgggcgtcaaggtgtgccccaacggctgtgaaatctgggtggatgacgatggcatcggcattccggcggatcaacgcgagcgcatcttcgagccgttctaccgcctggatcgcagtcgtgaccgcgccaccggcggtttcggccttggcctggcgatcagccggcgtgctctggaagctcagggcggcaccttgacggccctggcgtcgcccctgggtggtgcgcggtttcgggtgtggctgcccactcgaaccgattagaaaaaccgcggggaagggcgcacactgtgcgccccgctttacccgaggagagattggcaatgactggtgttcacacgtctgctcaacagggtttctcgacccaggccgtcacctacgcccaaggccgaccggactatccgcgccaactgaccgcctggctggccgaggcgctgcagatcaattcgcaatcgacggtgatcgacctcggcgccggcactggcaagttcacccgcttgctcagcagcctggcgccgacgctgattgcggtcgagccagtggcagagatgggcgcgcagttggccaagctattgccggatgtacgcctgctcgacggcaccgccgagtccatccccttggcgtccgccagcgccgatgccctggtgtgtgcccaggcattccactggttctccacccacgctgcactggcggaaatccaccgtgtgctcaagcctggcgggcgactggggttggtgtggaatgtacgtgatgagtcggtggactgggtggcggcgatcacagagatcatcaccccgtatgagggcgacaccccgcgctttcatagcggacgttggcgcgaagccttcaccggtgagtactttggcgctccgcaaatgacctgttttgcctaccagcacgtgggcagtcctcaggaagtgatcatggatcgattcctgtcggtgagttttatcgcggcgctgccacctgcggaaaaagccacagtcaccgcgcaattgcgcaccttgatcgacacccatcccgccctgcgaggccgcgataccgtagccttcccgtaccagacccaggcgtacttgtgtgagcgactgagctaaaaggcataaagtcagatcacattggtataagtagttataagaaaaatcgctatcctgcggccagaaatttataaggccgcaggtagctgtaatggatgtaggtaattttggttttgtggtggccggcctgatcgtggggtttatcgtgggtatgactggtgtcggcgggggctcgctgatgacgccgatcctgttgtggttcggtatcaacccggccactgcggttggcaccgacttgttatatgccgccatcaccaagtccggtggcgtgctggtgcacggcaagaacaagaacatcgactggagcatcaccggctggctgaccctgggcagcgtgccggcagtgttgttgaccttatggttcctcgccagcctgcacaccgaccccagcgcaatgaacgccgtgatcaagcaggccctcggcgtggtgttgctgctcacggccctggcgatcctgttcaagaaaagcctgttggcctttgcccagcgccatgccggcgacgactaccatatgcgcccgcgcaacctgaacgcactgaccgtggtcaccggcgcggtcctcggtacgatggtggccttgacctccatcggcgccggcgccctgggcacggtggcactgtttatcctgtatccgttcctggccacgcggcgcctggtcggcaccgagatcgcccacgccgtgcccctgaccctggtggcgggcctgggtcatgcgagcatgggcaatatggattggcacctgttgggctttttgctgatgggctcgttgccggggatctactttggcagccatatgactggcaggattccagacggcgtattgcgcccgtgcctggcggtgatgttgatggccgtgggttacaagctggcgttctaagctgcacatttgccccagtaagtgttgctccagcaacagcctatcgacaaatcactgtgatccccgacattaaccgccggatgatccaagttggcatttctgctgcaacacccatggcgcgggcctttgcctgagtctggcacgcttgctgctccagcacccttacatcctttcgtgtgaggtagtgttcgatgagccagcaagccgtgaaatttgcctattgggtgcccaacgtcagcggtgggctggtggtgagcaggatcgaacaacgtacccattggggcatcgattacaaccgcaagctggcgcaactggccgaagccgccggcttcgagtatggcctgacgcagattcgtttcaccgccggttacggcgccgaaaaccagcacgagtccgtagcgttcagccatgcgttgctggcggcaaccaccacgctcaaggtgatcgcggcgatcctgccaggtccctggcaaccggcgctggcggccaagcagttggcaaccatcgaccagctcaccaacggccgtatcgcggtgaatatcgtcagtggctggttcaagggcgagttccaggccattggcgaaccctggctggagcacgatgagcgctaccgtcgttccgaagagttcattcgcaccctcaaaggcatctggacccaagacgatttcaccttcaagggcgacttctaccgtttcaacaactacaccctcaagcccaagccgttgggtcaaccggagattttccagggcggcagctcaagggcggcgcgggacatggcagcaagggtttcagactggtatttcaccaatggcaacacccccgaaggcatcaaggcccaggtcgatgatatccgcgccaaggccgctgccaaccaccattcggtcaaggtcggcgtgaacgcctttgtgatcgcccgcgataccgaagaagaagcgcgggccgtgctggcagaaatcatcgacaaggccgacccggaggccgtcaacgcctttggggatgccgccaaacaagcgggcagggcatcaccggagggtgagggcaactgggccaagtccagctttgaggacctggtgcagtacaacgatggcttcaagaccaacctgatcggcacaccacaacagatcgccgaacgtatcgtcgcgctcaaggccgtgggtgtggacctggtgctcgcgggcttcctgcactttcaggaagaggtggagtacttcggcaaacgtgtattgccgctggtgcgcgagttggaagccacggccgatgcaggcgcgagcggtttttccaggcacagggcagcggtgtggtcttcgtagtagtcatcgacccaggcaaagcgctgatagccgttgcgctcgtacagggcgagtgcgccggggttgtcggtgcgcacttgcagtcgcagggacgcgcaattgttggccagggcgcaggcttcgatgtgccccagcaactgatggcccaggcccatgcctcgagcgtgctcggcaatagcgatggaatacaagcgtgccagacgagtgccgcgacgaaacagcaccagcccatagccgagcaattgcccgtgctgctgcacaagccacaactgaccattggcccggctgatcatccagcgcagactgcgcggtgacagccggtcactacgaaaacactgctgttccagcgccactaatgcaggtacatcgtcgagggttgcaacgcgaaagaaaagcgccataagaccaccgtaaaagttgcgtaacgaaacgggacttccctaaaagatcgtgcttaatagaaaaggtcgagttctctaaagcggatcaactattatgtcggcggtacacagtcattggcgtcaagtatccgagcaaacagtcgcggcgacaataacctccaacggttatttatccgcgccactcctaagttcaagccaagtcgtaattattgtcgaacgcaaggaagattgggcctcttacttccccagcgaagacatcgtcactgcccagcaatacctggagcagacccggaaaaacgagacgggcaagcgtgtgcaggtgatcaacctgtgccgcagctacaagtacctggggcacggctactattgctcgttgctggccgaggcgcgtgggcacaaggtgattccatcggtgcgcaccatcagtgagctgaccaggaaggccctgtatggcctggccctggatgacctggataaaaccctcgaaaaagccttgagtcatcatctctacagcaataccgaaggctttaccctgaccctgtattttggtcgaacgacgatagaacccttgcaagagttggcgcgccagttatttgaaacctttccctgtccgatcttgctggttgagttccgtcaacataatggctggcatatcgaaggggtgaagtccggcgtattgcacaagttacgcgacgatcaggaagaccaattcgcccacgccctcgacaacttcagccgcaaagtctggcgtcagccacgctcgcgccgattggcccgttatgacctggcaattcttcacgatccccaggagcaactgcctccgtccaacccccgtgccctggaaaacttcatacgggtcggcaagggcctgggcatcgatgtggagttgatcgaacgcaaggattacgcacgcctggccgaatacgacgccttgctgatccgtgagaccaccagcgtcgacaaccatacctatcgcttcgccaagaaagccgaaagcgaaggcctggtggtcatggatgaccccgcatcgatcctgcgctgcaccaacaaggtctacctcaccgacctgttgaacagtcaccaactgggcatgccagcgaccgagattctctacaaggaacgaccgcaggactttgaacgcgtcggcgagcgcctgggctttccgctggtactgaagatccccgatggctgtttctcccgcggggtgatcaaggtcgaaagccaggcggcgttgctcaaggccaccgccgagctgttcgagcattcggtgctgttgctggcccaggagttcttctacaccgaatacgactggcgcatcggcgtgctcaaccgtaaaccgatctttgcctgccagtacttcatgtccaagggccattggcagatctacaaccacaaggccatcggccaggccatcaacggcgagtgccgcaccctggcggtccacgaagcgcccaaggccgtggtggagctggccgtgaagaccgccaacctgatcggcgacggcctctatggcgttgacctaaagcagtccggcgacaaagtggtggtaatcgaggtcaacgacaatcccaacctggatgcgggcatcgaagacgcctacctgcaggacgacctgtatggcctcgtactggaggagttcgtgcggcgccttgagcttaaacgccagggccaggtgtggtgaaaaccggcgtttgcagggtcagcacttcaaacccatccgccgttaccgccacggtatgctcccactgcgccgacaggctgttgtccttggtcaccaccgtccagccgtccttcaggctgcgcaccttggcgctgccctggttaagcatcggttcgatggtaaacaccatgccctcgcgcaactccaggccggtgccggggcggccaaagtgcaggatctgcggctcttcatgcatctgccggccgatgccatggccgcagtattcgcgcaccacgctgtagccgttggcctgggcgtggctctggatcgcatgaccgatatcacccaggcgcgcgccaggcttgacctggcggataccggcccacatggcctcgaaggtcatttccaccaagcgtttggccttgggcgccacgttaccgatcatgtacatcttgctggagtcggcaataaaaccgcctttttccagggtgatgtcgatgttgatgatgtcgccgtccttgaggaactgcttggcgctgggcatgccgtggcacaccacttcgttgatcgaggtgttgatgcagaaggggtagtcatactggcccaggctggcggggcgggccttgagttcgtggcggatgaaggcttcgacggcgctgtccagttccagggttgagcggccggcggcgacaaagccgtcgagcatgtcgaacacctgggccaacaggcgcccggattcacgcatcacggccaattgcgcggcggtcttgatcatcagttgcgcccccggatcaggtcgggcttgtccagcaacagcttgttgatcagctcgttgtaaggcaggtgtgggttgagttcggcgagcaggccgatcttgatccagaactcggcctgggcgttgatggagcggtccatggcggcgctggccaggcgaagctgttcgtgcagttggtcggtgatcttgacgatgcccatgaggtttcactgttaggggttaatatacaaatcgtatacgtttcgtatgctatgcgtaaaccccatgggccagattacccgcttgatagttgcgacatgttgccgaaaagagcttcggtgcgagttgctgtttaactagatgtgcagggttaaacgtttaatcgaagtggttcgacgattatttcaaggctgcaatctgcttcatattaaagggtaggttgcttatgaggaaaagttacaacaacgccgggatttgccgagtaggcttggtgagtacaggcgtctgccagggttggcaagacggggcaggccagcgcctgccaagcccataagaatctgattggcagtctcaaaaaaggagaggttggccatgctttcggaacttgaacttcgcagcattattgaaggaagttttctgcctaaacggtgcgaatgcaccaaagccgaggatgcttcgttgacgatcaaggtgtatgacgaccgtgaccgtgaccgggtggacttggaagtcaaaggtataaacgctgacaaactcgacagcagtcgagccatttgtaacctgatcgccggtttgcgtgaagacctcaaacacacccagacccacacccccgccctgcgtcgagcaggagcgcgcggttatttttagttaaggcttgaatttaagttgacccagggcctggcattcgccgggcccgttgctatgcgcgtcagcccagctgatgacggtacggcaggtcgggtccggtcttggtacaggtcaacgcagccgcgcgaatcgcaaagccgagcatgctgtcaatttgtttgcgtgtcagctgctgcagaccctccagtgaatccagctgctgctcggtcagccaggcaatcagtgccgcctggaaggtatcgccggcacccaccgtatcggccatcaccaccttgaccgccggctgagaccagttgccgtgctggcgactgaataccgaagcgccgtcgccgccacgggtgagaaacaccaattggcaacgatgctgcagccagccttgtactacgctttccggtgactggccggggtagagcaggtgcaaatcttcgtcgctgaccttgatcaggtcagcatgctgcaccagttgcgccacgcgctcgcgccacagctggatatccggctgcgggttaaggcgcacattcgggtcgaggctgatcaggcgcttgccgctctcgcgcttgaccaggttcagcagggtgtcgccaaccggctgcaccaccaggcaaaacgacccgatatgcagcccacgcacctcatcacccaaggttggcagatgcgccgtttgcagttggcggtcggcgcagccttcgccacggaagctgtactgcggcgaaccattggcacccacggcgaccatcgccagggtggtcggcgcgtcgaattccaccaggaagcgttcgctgacgccttcgtccttgagcacctgcagcaagcggcgaccgaggtaatcggtggacacgccggcaaagaaccctgactcaatgcccaggcggcgcaggcccaccgccacgttgaacggcgagccaccggcaatggccttgtaattgagcttggccggctgcccacgggcatcttcctcgctgaaaaaatcaaacagcgcttcaccacaaaccaggtacatagtcgttcgctcttaaagggatgccacgtgctgttgataacgctcatacgcctgttgataggcactgacattagccggcatcggcaaggtgcggctggccgggtcgatgctcacgcatttttcgcacaggctggccagggattcgccactctggcaccaggccgcctggatcgccgcgcccagggcagcagcctcgctttgttcggtacagaccacttcggtgtgcatgatatcggcgaccatctgccgccacaccgggcttttcgagccgccgccgatcaggcggatgctctggctttgcaggccggtgtggcgcagcaggtccagaccgtaacgcaggccgaacgtggtgccttcaaccacggcgcggcacagattggcgcgggtcaggttggtcatggtcaggccatgcaggctgccggtggcgtggggcagggcgggcacgcgttcgccattgaggaacggcagcatgctcacgccatcggcaccgataggcgcctgttcgaccagggcgttaaaggcattcaggtccagttcgaacagctcgcgaatcacgccggtggcgttggtcaggttcatggtgcagatcagcggcagccagccgccactcgacgaacaaaaggtcgccaccgaggcctgcgggctgacgttgggctggtcggcaaaggcatagacggtgcccgaggagcccaggctcatggtgatcacgccgggggcgatattgccggtgccgatggcgcccatcatattgtcgccgccgccgctggacaccacggccttggggttgatgcccaggcgttcggcgatggccggcaggatcgtgcccactgcttggttggcttcgatcaactgtggcaaggcggcttcaaggcgaccgctggggtcgatgtgctggagcagcgccacatcccatgtgcggctgcgcacatcgaaatagccggtgccggaagcgtcgccgtactcggcgcaggcacggccggtgagccagtagttgaggtaatcgtggggcaacaggatatgggcgatgcgtgcgaagacatccggatgctgctcgcgggtccagagcagtttggagacggtgtagcccggtgcgatcgccacgcccaagcgctccagggagccgctttcgccgcccaggtggtgcagcaggcggtcattctcgggagtggtttcggtgtcgcaccacagcttggccgggcgcagcactgcaccttgctcatccagcagcaccaggccatgttgctggccggaaacgccgatgccgaggatgtcctgaccatccacgccggactgttgcagggcgcggtgggtggcttcggtaaaggcgtcaagccattcctgggtgtgctgctcacggcggccattggcgccgctgatcagcgtatgcgcggcggcgcccaggcccagtaccttgccgctggaggtgtcgaggacgatggccttggtgccttgggtgccgcagtcgatgccgagaaacaggttttgctgggtcatgaggatttgctcagcagtattatttttggattggtaacccggtcaagtgtgagagggggcttgctcccgatggcggtgagtcagttacagatgcatttactgatacaccctcatcgggagcaagccccctcccacagttttaatccggtttgttcaggagttgttgcagggtttcggtgacgcctttgtcgcgcaagcttgcatagcatcgctcaaacgctgccacaaacgccgccgacttgggaatagccgtaccaaaaatctcctccacgcccaacaagcgctgactgatcagtgcgtcatccgtcaccagcccctggcagaattcggcccgtgggtcggggatcttgtagttcacgccattctcatccacgcccttcaaatacaaggcccaggccgcgaccaccagtgcggcgcgttcggtctcgcggccatcggcaatcaggcgattgatggtcggcacggtgaacttgggaaacttcgatgaaccatcggaacacacgcgctccaactggtcggcaatcgcctggttggaaaagcgctccaccaaggtctgcttgtaggcggtcaggtcgatgcctggcaccggcgccaggtttggggtgacgtccaggtccatatacgcacgcatatacgccacgaacagcgggtcgttcatggtctcgtggacaaaccgataacccttgagaaaccccaggtaggtgagcgccaggtggctgccgttgagcaagccgatcttcatctcttcgtaaggcgtgacgtcatcggtgaactgcacgccgaccttttcccaggccgggcggccgctgacaaacttgtcttccagcacccactgcacaaacggctcgcacaccaccggccaggcatcgtcgatgccgtgttcgtcatgcaattgcaggcggtgagcggtactggtcatgggtgtgatgcggtcgaccatggcattcgggaagctgacgttggccttgatccagtcatgcagctcggcattatgcagggcggcgaaggccagcagtgccttgcgggtgacggcgccgttgtggggcaggttatcgcaggacatcacggtgaacgcgggggtgccggcggcgcggcgctgggtcagggcggcgcagatgaaaccgaacacggttttcggcgccgtggggtgcgccaggtcatgctggatctgtggcaggtgggccatgaactcgccgttgctgtcgtcgatgcagtagccgccctcggtgatggttagcgagacgatgcggatcgccgggtcggccagtttatcgatcagcgcctgggcaccgtcttcggcgagcagcatgtcgctgatggcgccgatcacacgtacttcggtgtcgtcggtgtcacccagctcatacagggtgaacaggtagtcctggccggccaggtcatcgcgggccttgcggtcttcggcacgcaggccgacgccgcaaatgctccagtccaggccctcgccggtattcatcagggcgtcggtgtaatatgcctggtgcgcacggtgaaagccgccgacgccgatgtgggcaataccctggcgggtgtcggcaatcgcgtaggccggggttttcacttccggcgccagctgcgtgaggttggctttattcagtttcatcgggaaatactcgggatcaggcggcagcgcgcagtgggcgggccacggctacaccgtttgtgtcgaacagatggcagtgcgccgggtccaggtgcagctgcagggtttcgccgtattggctcgccatgtcgccgcggatgcgcatggtcagcggctcgccattggcagtgatgacgtggcagaaggtgtcactgcccaggcgctcgccgacatcggcggtgacggtcagggtggtttgccccggcgcagcgatttccaggtgctccggacggatccccagggtcacctcactgccgacgctcaaggtggtgccgctcaacggcaggctgatcagggtgccggcgtccagttgaacttcgcagccctggctctcgatgcgggtgaccttgcccttgaggaaacccatcttcggcgtgccgagaaacccggccacgaacaggttggccggctggtgatacagctccagcggcgagccgacctgttcgatacggccactgttgagcaccaccaccttgtcggccagggtcatggcttcaacctggtcgtgggtcacgtagatcatggtggcttgcagttctttatgcagacgcgccagttccaggcgcatctgcacgcgcagcgcggcgtcgaggttggacagcggctcgtcgaacaggaagatcttcgggttacgcacaatcgcccggccgatcgccacgcgctggcgctggccgccggacagttgcttgggcttgcgctccagcagcggaccgagctcgaggatgcgcgccgcttcgctgactttgctgtccaccagcttcttgtcgacgccggccagatccagggcgaacgacatgttcttgcgcacgctcatgtgcgggtacagcgcgtaggtctggaacaccatggccaggtcacgtttggccggggtcacttcggtgatgtcgcggccatcgagttcgatggtgccgtcgctgacttcctcaaggcccgcgatcagccgcagcagggtggatttaccgcagcccgacgggccgacgaacaccacgaattccttgtcgttcacttccaggtcaatgcccttgatgatggaaaagccttcgaagcctttttgcagattcttgattttcaggttggccatgatgggcctccttttcgcaatttttataagaagccgttatttgacggcgccgaaggacaaaccgcgcaccagctgtttctggctgatccagccaaagatcaggatcggcgcgcaggccagggtcgagacggcggacaacttggcccagaacaaaccttcggggcttgagtaggaggcgatcagtgcggtcagcggcgcggcgctcgacgaggtcaggttcagcgaccagaacgcctcgttccagcacaggatcaacgacagcagcaccgtggaggccaggccacccttggcaatcggcagcagcacgcggatcatttcctgccacagggtggcgccgtccaggcgggcggcttcgaggatgtccttgggaatgtccttgaagtaggtgtacaccatccacaccacaatcggcaggttgatcagggtgtagatgatgatcagcgcaatacgcgtatccagcaggccaaagctcttggccagcaggtagatcggcatcagcacgcccaccggcggcagcatcttggtcgacagcatccacagcagcgtgcccttggtgcgctgggtttcgtagaacgccatggaataggcggccggcaccgagatcagcaggcacagggcagtggcgctgaaggaaatcaccaccgagttccaggcgtaggcgaagtagttgctgcgttcgttgatgtgcaggtagttctccagcgtcggcgtgaagatgaactgcggcggggtggcgaacgcgtcgatttcagtcttgaagctggtcagcaccatccagaagatcgggaagaaaatcaggatcgcgatggcccaggccaacgtaccgagcagcaggctttgcaggcggcgggattgttgaagtgtcatggcgcggccctcaaggcttgtcagtcaggtttttgccgatcatccgcaccaggatgatcgccgcgatattggcgatgaccacggcaatcaggccgccggccgaggccatgcccacatcgaactgcaccagcgcctggttgtagatcaggtaggcgaggttggtcgaggcgtaacccgggccaccgttggtggtggtgaagatctccgcgaacaccgagagcaggaagatcgtttcgatcatcaccaccacggcaatcgggcgggccaggtgcggcagggtcaggtgccagaaaatcgcaatggcgccggcaccgtccaggcgggcggcttccttctgttcctggtccagggactgcatcgcggtcatcagcagcaggatcgcgaagggcagccattgccacgagacaatgatgatgatcgacagcagcgggtaatgcgccagccagtccaccggctcggccccgaagaacttccataccgcggcgagaatccccgacaccgggtggaaaatcaggttcttccagatcagcgccccgacggtgggcatgatgaagaacggcgaaatcagcagcacccgcacgatgccgcgcccgaggaattcactggcctccagcagggcactgatcagcacaccaaagaccacgctgatcagcaatacgctgcccaccagcaacagcgtattggtggcgccgggcaggaagcccgaatcggtgatgaagtaggtgaagttctccagccccacgaactggttttcaccggggtagagcaggttgtagcggatcagcgaaaagtacagggtcatgcccaggggcacgatcatccacagcagcaacaaggccaccgaggggctgacaaggaaccagccggggttggccaggcggtttttggcgggtgtattcattagaatcaagaccagtcagatacgaatcggagcgcggtcagtgtgggagggggcttgctcccgatagcggtgtatcagtcacacaatcatcgactggtagattgctatcgggagcaagccccctcccacatttgactgtggtgaaggccggggttacttggggtaaccagcccgcttcatttcacgctcggtggtggtctgcgcggcggtcaatgcggcatctaccgtctgctgcccggtcaacgcaccggagaagaacttgccgacctgggtaccaatcgcctggaactcaggaatggtcaccagctggatgccgatatatggcacgggcttctcggtcggcttggtcgggtcggccactttcagcgattccagggtcaccttggcaaacggcgcggcctgcatgtactcgtcgctgtaggtggatttgcgcgtacctggcggcacattggcaatgccatcggtcttggccacaagctggccgtattccttggacgtggcccaactggtgaataccttggcggcgtccttggccttggaactggtcgggatcgccaggctccaggaatacaaccacgacgtgcccttgtcggtcttctcgtggggcgcgaaggtgaagcccacatgctcggagaccttgctctggctcttgtcggtaacaaacgagccggccacgctggcatccacccagatcgcgcacttgccgctgttgaacagcgccaggttttcgttgaagccgttgctggaggcgcccggtgggccggatttcttcatgttgtcgacgtagaagttcagcgcatccttccactccgggccgttgaattgcggctgccatttctcatcgaaccagcgcgccccgtagccgttggccagggtggtgatcagcgccatgttctcaccccaaccagctttgccgcgcaggcacaggccgtattgctctttggatttgtcggtaagtttggccgcgtattcgccgatctgggtccaggtcgggtgctcaggcatgctcagcccggcgtccttgaacaggtcggtgcggtaataggtgatcgagctttcggcatagaacggcagggcgtacagcgagcccttgaccgacaaaccgtcacgcaccgaagggaacacatcgtcgaggtcgtaggaggccggcaggtccttcatcggctccagccaacccttggcaccccacagtgcggcttcgtacatgccgatggtcaacacatcgaactgcccgccctgggtagcaatgtcggtggtcaggcgttggcgcagtacgttttcttcgagcaccacccaattcaacttgatctccggatgctcggcctcgaaggttttcgagagtttctgcatgcggatcatgtcgctgttattgacggtggcaatggtcagggtttgcgcgccaaagctgacggcgctgagggtcatgcatgctgtcatgcaggtcgaggcaagcagtacttttgctgtgaacttcatcgcgcactccatttccgcgcccaggggcgacggaaggacagttattgttgttgtgtcttcctacaggtagccaggaagagtgtgcgtcgattacagccttgaaatggtgttgtgacaaatccttgggcgcacgctcactgatacttttttgcactcgatgttcgtccccgtgacgcgtggggacgatcgatgccgtatttaacgctcgatatcagccagtacccgctcagccaacaatcgagacacctcgatcaactgggcaatccccagcgcgccttcgcgtcgcgagccgtcgagctcaaaggcgaaatcgcaggtgagggcgtgggcagaggcgagggattcgctgaggttgaccagaaggtcttgagtggagataccgtctttcacggtgaatagcacgctgggtgctggatcgattgggggatttggggtgggtttgatcatggtgaaactcctgatttaaatggagctaccactgatcgccgcgacgcgattgggtggtagctgtacgcaggttcgcggaccggaatcaggaaaccggcatacccgaaggtatcccgcgcacagccaccataaggccgcacagtagacgataaaaaggcgtcaactgaaagcggaaatggcactttgcgcctgattacaccgggccgcgacgcccaaccgctgcgtgtgcagcggtgtacggagactagagattgagtgtcctagggacaacctcaaatccttgtcagacgtttctgcgtttcccaatacctagccgaacggacagttgtttggctgtgtattcgtcagcaacatcttttgggcgtcattgcggtgcgacatcgcgtgcccgttgcacttaaaaaggagcaagcatgaaagacactaatagtcaaagcgagcaatcagctgcaatacgtcaggtaactgacctctcattcaattccgaccaggcagctgataatggcttttgacgcattcatgcatttagatggtgtagaaggtgagtcattggacgctgagcataaaggctgggtcgaattactgtcttaccattacgacgcaattcagtcgatcagccaatcgactcactccaatggtggtgcatctgctggacgggtgatgttgggtgattttcaaataagcaagtacgtggatagagctacgccaaagctattcgagttgtgttgccgaggctcacaaatcaagacagtgaccatccgcatacatcgcgctggaggtgaaaagtttaaatatatggatatcgttcttgaggatgttttggtgtccactgtaagtgggcaaggtgctgatcaaggcggccttcctatggaggtcatcaatctgaattatcgtcgtatcaaattcgagtacacccagcaacgccgatctgaaggcgccagtgcgggaaaaatctccggcggttgggacagggccaccgataagccattcgcatagggccgcgccacatgcctgacgatggagagtttcgtatagcactaagcttcgcgcagatggccgcaatattgactcaagagtcgctttcgcctgtggagataatgtcgaatcgtatagtgggtagcttgcgtcttgtcggcggtgtcgtggagcttgccggggctggcgtactgtgcgcagtgcctgaaccgacgctgcttagcaaggcgggatgtatcgcgatgggtatacatgcctccgatcagctttcagccggcgcgacacagcttctgacaggtaaagagacggattcgtttgcctttaaggcaggttcatctgcaactcaagcgcttggtgcatcgagagccacaggccaggttattggtttagcgacggaatttgcagttccgctgtcgactgcctctttatacaacgccttcagagtttcgtctgtgcggggaggtcggataaccgttattaccagcgaaaaaccgctgcaagctcctaaaaaatttggtggtgggcataccatatccaagcatgttgataaagatatggagtatctgaaatcacgatttgcttcaagaaaagtccacgtctcgtcgactttttataatcttgatgtggcggaatgggctgtgagtcaagcgctccaaaggaataaacttaaaatactcatgtattcgaaagcgagattcgtattgaagcacgggcaatacagtttcgtcacgcagttagaaactgccgttggttggggtgtcactaggcaagatcaatccaagattgtcacgatgtcaaagctcaaggtgacaattaaatatgctgaatacaatcgtatgccatattatataattactgcatttccggctttgtaaggtaaggttatgagcaagtatatgcatttgcacagttttatgtatgaggttggtgaaggggttggcgagtttttatcagatgatgaaaaaaagcattttcaacctttgaccttgcctgaaatagtcaaggattctttcggtgaggggggcgtgctcagtttagtgcatgcagttattcttaaaaaacaaatagcacattacataaaaaatcacatgggggctgaaggtttggagtatgtagatcccccatttgatcaagaaacatctttcgctgaagattattttgaaggggatctatacacgtttctaactagcgtaatggagctgctcgatagtgaaatgaaagcccggcgacggaaattcttttctgggttaattgggaaacgttagtgatggcatctgtcatgaaatgacgtggcgtgatgatatgcaatggtgtgcaggagggatgatgaattacagttacttaagtggttttatctattgttttggtgacggtgttggagagtttttaggcgatgaagaaaaatcccaccattgcgtcttggggttgagggaagtagtgtgcggttatattgataaaagaggtttgttgagtgcagttattcttggtgtgcaaataaggagttgcattaagagaaatatgtctctggatggcttggcctatgtggatccgccttttaatcaagatacctcattccctgaagaatatttcgagggtgatttgtatgattttttaacgagtgtgcttggtttgcttgatgccgagattaaagccagaggacaaaaagtatttcacaggcttattggtagacgttaacttttacgctcaaccgatctgacgattggatcacgctggcaatcggttcaagccaaattctgctcagtcaaccgctgcaccgccaaccgccgatagtgagacggcgtcatccccttaagctgctgaaaccgccgattgaagttggaaatattattgaatcccgactcaaagcacacatccgtaacggccttatcgccatcggccagcaattcgcaggacttgctgattcgcagccgattgacgaactcaataaacgtacgcccggtggcctgtttgaatacccgggaaaaatacgtcggcttcatgcccaggtattccgcgacttcttccaagggcaaatccctcgcgtagtgggcaaagatgtagtccaccgcacggttggtgcggtcgatgctgtgttcatcggcttgctgtggcgtggtcaccccggagagcagttggtagtcgtcacaggcgctcagcacttccagcaaaatgaaaaaatgccccaggcgcgccatgccttgggcctcctcaatgcgctgcatcagggccatggcctgggcgatggtttttttgctgcggaattctatgccgtattgcgcacgctccagcaagggcgccaggctcttgagctcggcaaacgtatggctgccttgctcgaacagctcatcggtgaagttcaccaacatgtcgcgcttgggcactacttcgccttcctccacctggctgatccagttatgcggtaggttggggccggtgaggaacaggctttcggggtagaagttgccgatgtagtcgccgataaacaccttgcccgagctggcgacgatcaggtgcagttcgtattccttgtgaaaatgccagcgcaccagcgggcaggggaaaccgtgctggcgatagatgatggacagaccgttgtgatcgtccatcagctcgtaggaagggtcggtgatacgcgttgctcgggtcatgctgccgtcgctttattgtggttgcgacccgaataatgccccgttgtgcacggccctgccagcttcaagcgtctgagcgtgcgccgctgcatcctgtacgagtaggattacagaagatttttatctgaaacagacacgagcgagggcttattcatgattcgcgatgcacgtcccagcgatgcacatagcatcgccagcgttcacgtcagtagctggcaacaagcttatcttgatctgatgcccgctgattttttggcctcccttactgcgactttgcccaagagggaagcgcattggactcatgcgattgaaagcaaagagtctgacgttttagtttcagaggtggatggaaaagttactggttggatttcagtggggccttgccgggatgaagacgaggcttgcgcagaagcgggagaggtcatggccatctacgtgttggcagaatactggggcaagggtataggcgcccagttatgggcgtcaggtttaaagcgtttggttgatcagggttataaggtgattaccttatgggttctagctgaaaaccaaagagctgtgcgcttctatcaagggctcgggggaagggaagagcttggcagccgtcgcacgctcgtgcgtggcggggtgtccctggaggaggtgaggtacgtttgggagcgttagggctcagggatgtccgattcgacttgccgcgcagcggcgacaagtctgaatcacgcttttcatgctctttgcgtcgattgtctagatgttgcgatttttcgcttcgatccactgggacatgtactgggtacttttatgcgcgtgatggcgcagcatgctgccggtaaagttgtcccggcgatgagctgcgaggttgcggcggcatcgctccaggcattcgaccaaggctggcccgtggaaggcctggtcgtagcgccgagccaggagctgacgcccacgttcctgggcctgggtccaaccttcgcggtcttgataaagagccacggcagcggccgccagggccggggcgttgtgctcgagcgcaccgggccagggttgatcatcgcccatggcctcggcaccgatgggggtggtgacattgggcgtgccgcacagcatcgcgtcgaccagcttgcccttgatccccgcaccaaagcgcaggggcgccaggcagatacgtgccgctgtcatcacttgcagtgcatcttcggcccagttcatcacatgaaagccctgggccgggttgtgcagggcagtggccttgggcggcgtgtaggccccgtagatatgtaactgggcgcccggcagttgctggcggatcagcggccacaggctgttcttcatccatagcaccgcatcccagtttggcgcgtggcggaagttaccgatgctgagaaagtgcgcacggtcttcaaagggcgcaaaagcgcgggtgggcggctgcagcatcagcgggcaccagtgcagcagggctgcgggcaccttgaagtgttcggtgagcaggcggatttccacgtcggagatcatcaggctgatgtcgcagcggtaaatcgcggcgatttcacgcttggccaggtcggtatcggccatgcgctggaactcgtcctccagcgccggcgcgaacagggcggtgaagtcgtcgccgtcgggatgggctttcacatgctccttgaaccgctgatggcgtgcgtcgcgcaggctttgcaggtcagaggtctccagcacgcgcagggcgtcggggcagcattgctccacgcgccagccgaattgctcctccatcatgaaacggtcgaacagtacgatatccggggccagttcgcggataaagtcatcgaaactgctgttattcagttcgatggcgcattcggcgatgccaagtgccggcaagtcggccttgtgttcgccgatggtcgctgggctgctgaaggtaatgtcccaaccttgcgtaagaaaactctcaaggatctgcatcatatgcccgcccgcagccgaggagcggggctctggccagacataaccaatgaccaggactttggtggcaggctgattcatcgacgacggtttccttgaagggcaggtgaaaagcgcgcaattaaaccacaaccggtggcatgacaatttgtgtctggcggtaggtagcgtcggcactttgtggttaacttcggcctctcgaattcgtttaaccaaaacccagcataaggattccgttcatggctcaagtcacccttaaaggcaacccggtccaggttgaaggcgaactgccgaaagtcggcgccaaagccgcagacttcaccctgaccgccggcgacctgtccaacgccaccctggctacctttgccggcaagcgcaaagtgctgaacatcttcccaagcgttgacaccccaacctgcgccacttccgtgcgcaagttcaacgcccaagccaacgatgtggctaacaccgtggtgctgtgcatctcctccgacctgccattcgcccaggcacgcttctgtggttccgaaggcctggaaaacgtgaagaacctgtcggacttccgcaacgccgacttcgccgttgactatggtgtttccatcgccgacggcccgctgcagggcctgaccgctcgtgctgtcgtagtgctggacgaaaacgacaacgttctgcacagcgagttggtcaaggaaattgctgaagagccaaattacgatgcagccctggctgtgttgaagtaactgtttctgcgcgtaactgtcgtttggcagtaacacgtatgatgcatgattgcggcctggcctagtccaggccgtttttatttgagcgtcagcggtttagcgaaatagccagcggactaagctcagacgttaaaagttgtaagcccaaggtaaatagccggtaaaggtgcttttctaaacgcaccccagtgcttatctttcagcctcccgaagaagaagctctcacccccaatggttgaccactccatgcaatcctccccccgcaaatcccgccgctggttgtttggcctgctcgtgctgctggttatcgccggcttgtgctggaaattctggcccggtggcgcagcccataaagacgcgccggccggtcacaccggtaaaaccggtatggcgcgcccgggcttcggcggttccaccggcccggttccggtgcgtgtggcgccggcggtgctgggggagttcccggtttactacaaggccctgggtacggtcactgcgctcaacaccattaatgtgcgcagccgggtgggcggtgagctgatgaagatcgcctttgaagaagggcagatggtcaaggccggcgacctgctggcagaaatcgacccgcgcagctaccagaacgccttgctccaggcccagggcacgctgctgcagaaccaggcccagctgaaaaacgcccaggtcgacgtcgagcgttatcgcggcctgtatgcccaggacagtatcgccaagcagacgctggacaccgccgaagcgctggtcttgcaataccagggcacagtcaagaccaaccagggcgcggtagacgacgccaagctcaacctcgaattcaccaagatccgcgcgccgatcagcggccgcgtcggcttgcgccagcttgacgtcggcaacctggtcgccgccaacgacaccacggccctggcggtgatcacccagacccagccgatcagcgtggccttcaccctgccggaaaataccctggaaactgtgctcgctcgttaccacgctggcaacaagctgccggtggaagcctgggaccgtggcgacacgaaaaagcaggccgtcggcgtgctgcaaagcctggacaaccagatcgatgtcaccaccggcaccctgaaattcaaggcgcgcttcgataacaaggaccaggcgctgttccccaaccagttcgtgaatgtgcacttgctcgccgacaccctgcataacgtggtgctggcaccgtctgcggcgatccagttcggcaataccggcacctttgtctacaagctcgacggcgacaataaggtcaaggtccagcctttggtgctcggtgataccgacggcgacaacaccgtgatcaaggagggcctggtcgccggcgaccgcgtggtgctggaaggcaccgaccgtctcaaggacggcagcgaaatcgaagtggtcaatgacagcagcgaagtgccgaccacgccgaccgaacacctgcaaggcaagcctgcggcaaaaggggagaccggcgctgacgccggcaaggcgcaaaaggtcggttcatgaacctgtcacgcctgttcatcctccgcccggtcgccaccacgctgagcatgctggccattgtgctggccggtatcatttcataccgcttgctgccagtgtcggccttgccccaggtggactacccgacgattcgggtgatgaccctgtaccccggggccagccccgatgtgatgaccagtgcggtcaccgcaccgctggagcgccagttcgggcagatgcccgggctgacccagatggcgtccaccagctccggcggcgcctcggtgctgaccctgcgtttcaatctcgacatcaatatggatgtcgccgagcaacaggtgcaggccgcaatcaacgccgccaccaacctgctgcccaaggatttgccggcgccgccggtgtacaacaaggtcaacccggccgataccccggtgctgaccctggcgattacttccaagaccatgcagctgcccaagctcaatgacctggtcgacacgcgtatggcgcagaaaatcgcgcagatcagcggcgtcggcatggtcagcatcgccggcggccagcgccaggccgtacgcatcaaggtcaaccccgaggccctggcggccaatggcttgaacctgtcggatgtgcgcagcctgatcgccgcttccaacgtcaaccagcccaagggcaactttgacggccccacccgggtgtcgatgctcgatgccaacgaccagttggtctcgcccgagcaatatgccgaactgatcctggcctacaacaatggcgcaccgctgcgcctcaaggatgtggcgcagatcgtcgacggcgccgaaaacgaacgcctcgcggcctgggccaatcagaaccaggcggtgctgttgaatatccagcgccaacccggcgccaacgtgatcgaggtggtcgaccgcatcaaggcgctgctgccgagcatcaccgacaacctgccggccgggctcgatgtgaccgtgctcactgaccgtacccagaccatccgcgcgtcggtcaaggatgtgcagcatgaactgctgatcgccattgccctggtggtgatggtgaccttcctgttcctgcgtcgggtcagcgccacgatcattccgtctatcgccgtgccgctgtccctggtcggcacctttggcgtgatgtacctggcggggttctccatcaataacctgacgctgatggccctgaccattgccactggctttgtggtggatgacgccatcgtcatgctggaaaacatctcccgctatatcgaggagggcgagacgccgatggcggcggcactcaagggcgccaagcagatcggttttaccctggtgtcccttaccctatcgctgattgcggtattgatcccgctgctgttcatggccgacgtggtcgggcggctgttccgtgaattcgccatcaccctggcggtggcgatcctgatttccctggtggtgtccctgaccctgacgccaatgatgtgtgcacgcctgctcaagcgtgaacccaaggaagaggaacaggggcgcttctacaaggccagcggcgcctggatcgattggctgatcgaagcctacgggcgtaagttgcagtgggtgctcaagcaccagccgctgaccctgctggtggccatcgctaccctgggcctcacggtggtgctgtacctggtggtgcccaagggctttttcccggtgcaggacaccggggtgatccaggggatttccgaagcgccgcaatcgatttcgtttgcggcgatgagccagcgccagcaggagctggcgaagatcatcctcgccgatccggcggtggaaagcctgtcttcctatattggcgtggatggcgataacgccaccctcaacagcggccgcttgttgatcaacctcaaggcccacggccagcgcgatttgagcgcagcgcaggtgattacgcgactgcaacctgaaatcgacaagctggtgggcatccgcctgttcatgcagccggtgcaggacctgaccattgaagaccgtgtcagccgtacccagtaccaattcagcatgtcgtccccggatgccgagttgctggcgctgtggagcggcaagctggtgcaagccctcagccagttgccggaactcaccgacgttgccagcgacctgcaggacaagggcctgcaggtgtacctggtgatcgaccgcgacgcggcctcgcgcctgggcgtcaacgttgcgaccatcaccgacgcgctgtatgacgccttcggccagcggcagatttccaccatctacacccaggccagccagtaccgcgtggtgttgcaggcccagtccggcgagaccctcggcccggctgccctcaaccagatccatgtgaagaccaccgacggcggccaggtgcggttgtcgagcctggcccatgtggagcagcgccaggcgcaattggcgatcgcccatatcggccagttcccggcggtgatgatgtcgttcaacctggcccccggtgtcgccctgggcaagggcgtggaactgatcaaccagacccagaaggacatcggcatgccggtgggtgtgcagacccagttccagggcgcggcccaggcgttcgaggcgtcgttgtcgagcaccttgctgctgatcctggcggcggtggtcaccatgtacatcgtgctcggcgtgctctacgagagctatatccacccgatcaccatcctttcgaccttgccgtcggcagcggtaggggccttgctcgcactgctgctcagtggcaatgacctgggcatgatcgcgatcatcggcattatcctgctgatcggtatcgtgaaaaagaacgcgatcatgatgatcgacttcgccctcgacgccgagcgtaaccagggccttgacccgcagaccgcgatctaccaggcggcgctgctgcgctttcgaccgatcctgatgaccaccctggccgccttgttcggcgcagtgccgttgatgctcgccaccggttccggtgcagagctgcgccaaccgctgggcctggtgatggtcggcggcttgctggtgagtcaggtgttgaccctgttcaccacgccggtgatctacctgtactttgatcgtcttggccggcgctggcgcaaagagccgcaacgcctggagccggttgaaccatgaacctgtccggacctttcattcgccggccggtagccaccatgctgctgagcctggcgatcatgttgctcggtggcgtcagcttcaacctgttgccggtatcgccgctgccgcagatcgacttcccggtgatcgtggtgtcggccagtttgcccggcgccagccccgaggtgatggcgtccagcgtagcgacgccgctggagcgttcattcggttcgattgccggcatcaccaccatgagcagttcgtcgagccagggttccacgcgggtgatcctggcgttcgattccgaccgtgatatcaacggcgcggcgcgggaagtgcaggcggccatcaacgcttcgcgcaacctgctgcccagcggcatgcgcagcatgccgacctataagaagatcaacccgtcccaggcaccgatcatggtgttgtcgctgacctctgacgtgttgcagaagggccagctgtacgacctggcctcgaccatcctgtcccagagcctgtcccaagtgcccggcgtaggcgaagtgcagatcggcggcagttcgctgccggcggtgcgcatcgagctggagcccaaggccctcgaccagtacggcgtcgccctggacgatgtgcgcaacaccatcgccaacgccaaccagcgccgccccaagggttccctggaagacgctgagcgtaactggcagatccaggccaacgaccagttggaaaaagccaaggattacgagccgctgttgattcgctatcaggatggcgcggccctgcgcctgcgcgacatagcgaagatcaccgatggcgtggaggaccgctacaacagcggtttcttcaacaatgactcggcggtgctgctggtgatcaaccgccagtccggcgccaacatcatcgagacggtcaggcagatcaaggcccagttgccagcgttgcaggcggtgctgccgtccagcgtcaagctcagcctggccatggaccgctcgccggtgatcgccgccaccctgcacgaagccgagatgaccttgctgattgccgtgggcctggtgatcctggtggtctacctgttcctgggcaacttccgcgcttcgctgatcccgaccctggcggtgccagtgtcgctggtgggcacctttgcggtgatgtacctgtacggtttttcgctgaacaacttttcgctgatggcgctgatcctggccaccgggctggtggtggacgatgccattgtggtgctggagaacatttcccggcatatcgatgaaggtgtgccgccgatgaaggccgcgtacctgggagcccaggaagtcggctttaccttgctgtcgatgaacgtgtcgctggtggcggtgttcctgtccatcctgttcatgggcgggattgtcaccaacctgtttcgcgagttttccatcaccttgtcggcggcgatcattgtctcgctgatcgtctcgttgaccctgacgccgatgctctgcgcccgctggctcaagccccatgacaagcacaaacaaaccggtttgcaacgctggagccagaaggtcaacgaccgtatggtcgccggctacgccaccagcctggactgggtgctgcgccatcggcgcctgaccttgctgagcctgttgctgaccatcggtttgaacgtggcgctgtatgtggtggtgccaaagacctttatgccgcagcaggacaccggccagttgatcggctttgtgcgtggcgacgatggcctgtcgttcagcgtgatgcagccgaagatggagatcttccgccaggcggtgctcaaggacccggcagtgctcagcgtggccggctttatcggcggcaacaacggcaccaacaatgcggtgatgctggtgcgcctcaagccgatcagcgagcgcaagatctccgcccaggccgtaatcgagcgcttgcgcaaggatgtgccgctggtgccgggcgggcgtctgttcctgatggccgaccaggacctgcagtttggtggcagccgcgaccagaccagcgcgcagtactcctacatcctgcaaagtggtgatttggccgcgttgcgcctgtggtacccgaaagtggttgcggccatgcgtgagctgccggagctgaccgccatcgacgcccgcgaggggcgaggcgcggcccaggtcacgctgattgtcgaccgtgaccaggccaagcgtctgggtatcgacatgaacatggtcaccgccgtgctgaacaacgcctacagccagcggcagatttccaccatctacgacagcctcaaccagtaccaggtggtgatggaggtcaaccccaaatatgcgcaggacccgatcaccctcaatcaggtacaggtgatcactgccgatggtgcgcgggtgccgttgtcgaccatcgcccattatgaaaacagcctggcagacgatcgcgtcagccatgaaggccaattcgcttcggagaatatcgccttcgacatggctcccggcgtcacggtagagcagggcacggccgctatcgagcgggcgattgccaaggtcggcttgcccgaagatgtgatcgccaagatggccggcaccgccgatgcctttgcggccacacagaagggtcagccgttcatgatcctgggcgcattggtcgcggtgtacctggtgctgggcatcttgtatgaaagctatatccacccgctgacgatcctgtcgacgctgccttcggccggggtgggcgccatgctggccatctacctgacggggggcgagttcagcctgatctcattgctgggcttgttcctgctgatcggagtggtgaagaagaacgcgatcctgatgatcgacctggcgctgcaactggaacgcaacgacggtatgggcccgctggaatcaatccgcagcgcctgcctgctgcgtctgcgaccgatcctgatgacaacgctcgccgcgatcctcggcgccttgccgttgttgctcggcaccggcgatggtgcggaaatgcgtcgccccctgggcctgaccatcattggcggcctggttttcagccagatcctgaccctctacaccaccccggtggtctacctctatctcgaccgcgcacgccatcgtttcaacgcgtggcgcggcgtgcgtaccgatgctgccctggacactgcgctatgaccgattcaatcaacgcccctgcgatccctgtaggagcgagcttgctcgcgaagaacgcccatacgccgcgttcatccagaaggaacgcgttatcgttaacggccttcgcgagcaagctcgctcctacagtgggcctggccatgttgctcagcgcttgcgccatcggccctgactaccagcgcccggaggtcatcgagccggtgcaattcaaggaggcccagggctggcgccaggccaaccccagtgactccctggcccgtggcgcctggtgggagctgtacggcgaccgccaactgaatgacctggtggtgcgcctcaacacctccaaccagaccgtcgcccaggccgaagcacgttttcgccaggcccaggcactggtgcgcagttcacgcggggcgttctaccccagcgtcgacctgagcgtcggtaaaacccgcgccagccagggcaccggcagcagcagcgcgagcctcagcagctccagcagcggtattcgcgacaccctcaatgcgcagttgggcgtgagttgggaggccgatatctggggcaagttgcgccgtggtctggaggccaatgaagccagcgccgaggccagctcagccgatctggccgcgatgcgcttgagccaacaatcggaactggtgcaaagctacctgcaactgcgggtcatggacgaacagacacgcctgctgcaagccacgctggacacctaccagcgctcattgaagatgaccgaaaaccaataccgcgccggtgtagccggcaaggacgccattgcccaggcgcaaacccagctcaagactacccaggccagtctgatcgacctgatctggcagcgcgcccaactggaaaacgccatcgccgtattgatcggggaagccccggccaacttcaacctggccgtgagcaaggaaatcccggcactgccacagataccggtgagcctgccatcccagttgctcgaacgccgccccgacatcgcttcggcggaacgttcggtgatcgccgccaacgccaatatcggcgtagccaaggcggcgtactacccggacctcagcctgagcctgcagggcggctattccagcagcacctatgaggattggatcagcctgccgaaccgcttctggtcggttgggcccaaattggcgatgaccctctttgatggcggccagcgctcggcggaagtcgaccgcaccgtggccagctatgacgagaccgtggccaagtaccgccagacggtgctggatggtttccgtgaggtggaaaactacatggtgcaactcaaggtactggcggacgaggcggtggtcagcaatgaagcgctggagtcagcgcgagagtcgttgcgcctgaccgagaaccagtacaaggcggggttgattgcctatctggacgtggttaccgtgcaagcgacggccctgagtaacgagcgtacggtgttgaacttgctgcagtcgcgcttggtggcaagtgtgcagctgattgccgcactcgggggcggctgggacggccagacctccctggccgaaaaggagtgacccggcccaaatgtggaagggggcctgcccccgatggcggcctgacagccgaccaggatgttggatcagaccgtgtacatatccattcctgcggtaacggccactattggttccgcttttacagcgggtcacttttgaaaagagcccaaaagtaaccaaaacgctcttgccccaccactcggcacctcgccaaggctcggtgtgcccgtaatccgacatggatttggggggccgccgccacgcgccatccatggcgcggggcggctaaaccggcatccctgccggtttaccccccaaatccctgtcgaattccggccagcgtggtttgacggggcgcctaagatcaaaagcaaaatcaagagcggctcgcttcgcatcgtggttaccgtcggctgctacacagctgtgtagatacccatggccctcgggggcgagtcgaatcgtagcaccgcctctcccacattttgatctccgtggatccagaaactgcctcatgaggccatccgattgacgccaaaaaatcactaatggccttctgataattaatcacctgccccagattcattctcgctacaatcgcgcgctttgccacccggcacgggcttttacaccccggtagcccgcgagaagtcccatgctgatcggtagctattcaacctcccttgtcgtgatttccctgtgcgtcgctgtactggcgtcctataccgcgttggacctggccgggcgtatcgctaccgccaaggggcgcgccgtttatctatggatcagcggcggtgcattggcgatgggcgtcggtgtctggtccatgcactttatcggcatgttggccctgcgcctgccgtttgccctcgggtttgacctgggcatcactgcgctgtcgctgttgatcgcgatgttatccagtggcttcgccttgtggctggtcagtcagccacgcctgccggcctggcagttggcattcggtgcgttgatcatgggcgccggtatcgccagcatgcattacaccggcatggctgcgatgcgcatgacgccgggcattgactacgatcccactttgtttggcgcctcattattgattgcagtggtggcttccggtgcggcactgtggatcgccttcaacctgcggcgcaacacgccttatgtgcgcctggcacggggtggggcggcggtggtgatgggcgtggctatcgtcggcatgcactacaccgggatggccgcggcgcgttttgccgacgacagcttttgcggtgccgcactgacgggcctgagcggcaggggcctggataacctagttttagtgacctctttggcggtgctggtcattgcgctattgacctcgctgctcgacgcacgcctggaagcgcgcactgccgtgctcgccgattccctgaccctggccaaccgggagctgacccacctggcgctgcatgacatgctcaccggcctgcccaatcgcacgctgctggcggatcgcatccagcaaggtatccaggcggtgaatgagcggggcggctgctttgccttgatgtttatcgacctggatggcttcaagccggtcaatgatgcctttggtcatcacatgggcgatcagttgctgcgcgaggtcggcctgcgcttgcgcgaggacttgcgcagccaggacaccctggcccgtatcggtggcgacgaatttgtgttgctggtgcaattgacccagccggacgacgccatgggcttggccgagcgccaggtcggcctgatcaaccgcaccttcaaggtcgccgagcatgagttgaacatctcggccagcattggcatcgccctgttcccgggcaacggcagcagccctcaggagttgttgatgaacgctgatgcggcgatgtaccacgccaagggcatgggcaagaacggctacagcttcttcgatgtatcgatgaacaccaatgcgcgcaagcaattgcaactgttgcaggacctgcgcaatgccctcgaacatgggcagtttcgcttgtactaccagcccaagtttgatgctgtcagcggtattgcggtgggcgccgaggccttgctgcgctgggaacacccgcagcagggcctgttgctgccggcgacttttatcgcactggcagagaaaaccgggctgatcattcccatcggcgagtgggtactcaacgaagcctgccgccagatgagcctgtggtatgcacagggttatgagagttggcgcattgccgtaaatctctcggcgttgcagttctgtcacgccgggttggtcaacagcgtagcggccgccctggagcgtcaccaattgcccgccaacagcctgaccctggaaattaccgagaccaccgccatgagcgatgccgacgcgagcatgaccgtgttgcagcagctctcggacatgggcgtggatctgtccatcgatgactttggcaccggctactccagcctgatgtacctcaagcgcctaccggccaacgagttgaagatcgaccgaggctttgtgcgcgacctggaacacgacagcgatgacgcggcgatcgtctcggccatcgtggcactcggccaggccctgggcttgcgaattgtggccgaaggtgtggaaaccaatgtgcagcaggattttctcacgcgtttggggtgtgattcgttgcaaggctacttgttggggcacccattgcccgccgatagtttcatggcagatatccggagcgccgaacaaacggtagcgcctgacaagagctatgagtgacgggtattcttggatccaaccctagacatcaggttgaatctggagaccgcagccatggataaagtcgttatcatcaccggaggcagccgtgggattggcgccgagacggcattgctggccgctcgcgaggggtatcgtatctgcattaactatcagtctgatgagaaggccgctcatgcaatgcttgagcaagtgcgcggcctgggcgcccaggccattgcggtgcgcgccgatgtcagcagcgaagatgaggtgatcgcgttgttcaatcgcgtggatgccgaactgggccgggtcacggcgctggtcaacaatgctggtaccgttgggcataagtcgcgggtcgatgaaatgtccgaatttcgtctcctgaaaatcatgaagaccaatgtgctgggcccgatcctgtgcgccaagcatgcggtgctgcgcatgtcgcctcggcatggcgggcagggtggcagcattgtcaacgtatcgtcggtggcggcgcgcctgggatcgccgggtgagtatgtcgactatgctgcgtccaagggggccctggacactttcacgcttggcctgtcgaaagaggtcgcgggtgaaggcattcgtgtcaacgcggtacgtcccggttacatctttaccgattttcacgccctcagcggtgatccggaccgggtcagcaagctggagtccggcattcccatggcccgtggtgggcgcccggatgaggtggcggaggcgattatctggctgctgtcggacaaggcttcatacgccaccggaaccttcctggatctgggtggaggacgttaaatttcctggctagcgccccaggctttgcagtacgtcatagccgtcttgcgcgaatgctacgagtaggcgcgcctcggaatttttacgggtggaatagcccgcgttgtaaaagccgttgatcttgccgtcatgccgttcactgttaccgacgcgacgatcatttacgttgtcgaggacattgatcactcgcgccaggttataggccgcgcgcgccctggctttggcatcagggttggcggatgtccagtcgcccagttgtcgcttgagcaagtcggtcaccggatagctgtccctgcgcctgagcaggtgtttcaaccctggattggcattgatgatttgcctggcggagcgacgatccgcgaaaggcggctcttcgggcgctgcaggcaccgcaagccagttgttttctgggcgaccttcgccaagctggtaggcggtcgatgcgggaagcatgttgatgcgcatggcggtctcgaagtgaagatacacatacctgagtgtcttcttggggcgcagggttcctaaggctgtgtatcccagggttaaaacgaccgcacaatccgccccagcgtttccatggccttttccgacgcctcggtccacgggctgccatagttcaggcgaatgcaattgctgaaccgtcgggtcgccgaaaaaatcggccccggagcaatgctgatgccttgggccaaggccatctggaacaatttcagcgagtcggtctgttccggcagttccaaccacaggaaatacccgccggccggctggctgacccgtgtctgggtcgggaagtaacgggcgatggctgccagcatggcgctttgctgttcttccagggcatagcgcagtttgcgcaggtgccggtcataaccgccgtgctgcaggtagtcggcaattgccgcctgggccggcatcgatgggcacaatgaggtcatcagtttcaggcgctcgaccttctgcgcgaagcgcccggccgcgacccaaccgacgcggtaacccggtgccaggctcttggcaaaggaaccgcagtgcatcaccaacccttctgtatcaaaagccttggccggcttgggcgcttgctgcccgtaatacagctctgcatagacatcatcttcgatcaacggcacctgatggctgcgcagcagttccaccagcgcctgttttttcgcctccggcagggtcgcgcccatggggttctggaagctggtcatggtccagcaggccttgatcggatagcgctcaaggcattgggcaagggcgtcgaggtcaatgccgtcgcgtgggtgcaccggtatttccacggccttgagcttcaggcgctccagcacttgcaggcaggcatagaacgccggggcttcgatggcgaccaggtcgccgggttcggtcacggcctgcaggcacaggttcagtgcttcaagggcgccattggtgatcagcagctcctccatgggcagcatcaggccgccgaccatgtagcgcagggcgatctgtcggcgcagttgcgggttgcccggcgacatgtcggtgaccaccaggcgcgggtccatttcgcggctggcactggcaagggatcgagccaggcggggcagtgggaacaacatcgggctggggaacgccgagccgaagggcacggtgttggggtccttgatggagtcaaggaccgaaaacaccagttcgctcacgtctacgttggtggattcatgcacctgctcactcaccaccggttcggaaaacgggctgggcgcatgggtgttgacgaagtagccggaacgcggccgtgcgcgaatcaggccgcggcgctccagcaggtagtaagcctggaacactgtggacgggctgacgccgtaggtctggctggcgtagcgcaccgatggtacgcgctggccagggccgaggacgccggagcggatcagttctgcgatgtcgtcggcgaatttttcgtagcgtttcatgggggccttaaacaggtttttctgtgtgtacgctgggtaaatgtgggagcgggcctgctcgcgaaagcggtgtgtcagtgacgcagatataacctgacccggcgcttttgcgagcaagcctgctcccacatttgcatctctatctatccagatagatttcagcgattcaacggtgcaacaaaacgactgtctgcagcgctgtagatccagggttcatccacatccgtgactttgaagcggatagtctgcgaactgctcaccggtttgtccgccagcaatgccaccgacaccggtacatcgacgatttccccgggtgccaggctgacctgggtcttgccctgcaactggaagctgtcggcgtccaccagttccaggcggtagtcctggcgttgctgggtcttgttgatgaccttgaggctgtagatgttttcgatcaagccctggctgttttcgcggaacataccacggtccttggtcacgtccagcgataccatcggccgttcgaccaaggccaccaccaacgctgcgatcatcaccaacagcacggcactgtagccgatcaggcggggccgcagcaggtgagtcttgccaccttgcaattggtgttcgctggtgtagctcaccaagccgcgggcatagcccattttgtccatgatcgagtcgcaggcgtcgatgcatgccgcgcagccgatgcattccatttgcaggccgtcgcgaatatcgatgccggtggggcatacctgcacgcacagttggcaatcgatgcaatcgccgaggccgacgtccgcgggctgcacctcgcgtttacgcgggccacggcgttcgccacgggcggcgtcgtaggaaatggtcagggtgtctttatcaaacatcacactctggaaccgtgcataggggcacatgtgcatgcacaccgcttctcgcagccagccggcattgatgtaagtggcaccggtaaaaaacagcacccagaacaggcttacgccgcccatctgccaggtcagcaattcggtggcgagcgggcggatcggtgtgaagtagccaacaaacgtcagccccgtcagcacgctgatacccagccacaacgtatgtttggccgagcgccgcgctagtttattcaagctccacggtgcggcttgcaacttgatgcgttggttgcgctcgccctcggtgaccttttcacaccacatgaacagccaagtgaacgagctttgcgggcaggtgtagccgcaccatacgcggccggcaaacaccgtgatggcaaacaggccaaaggcgcagatgatcagcagcgccgagagcaggatgaaatcctgaggccagaaagtagcgccgaagatgtggaacttactctcggccaggtcccatagcacggcttggcggccaccccagttcagccatacggtgccgaagaaggccaggaacagcaggccggcgccgccgacgcgcaaggtgcggaatacgccggtgaagctgcgggtatggatcaggttgtcgctggatttggccttcaccttctttgggtggttgggctcaaaggtttccacggttgggattcgttcgctcatggtcgttcgctcatcagcctccatcaggccggggaactatgggcgacagtctgttcgcataacaggctcaggcatggtgataaaaagcggatcagatgggtttgattcaaccgtctttgccgatctgctgcaccccaggctcactggggtgcaggggtgcttagatgtctattgatacagatcaatcaaatcaccgaacccggtttatcggcctttacgtggttacgaccatccttggcgccttctacggtgagggcgtcggcctcggcttcggtgatgtagatctgctggccggccaattccacataagacatggccttttcattgtcggtaagaatatttacccgagtagccggcaggctctgttcctggccggtctcgtcgagcgtgaagtagcacaaatgattttcgatgcgtacagacatggcgatctcctgttcatgggctatgtcccgttaggcgacggtaacgctgccgggttccaggcaactgactggcggtctgcactgtctatctttcattcacaataagaaaggacagatccatggacgcctggtggcatcaagtgtggcaaaccctgcaggctgaatttgccgacatcggcgacgctcggcagttgacgcaaatcactgtgcgcctgctgatcgccgcgcttttaggcggcatcctggggtttgaacgtgaacaaaagggcaaggcggcaggggtgcgcacccatatgctggtggccttgggcgccgcgttgtttgtgctggtgccgcaagtgtccggcagccaggcggacgccatgagccgcgtggtgcagggggtgattgctgggattggcttccttggcgccggtaccatcctcaagggcaaggaagacgaggagggccagcacgtgaagggcctgaccacggcggccgggttatggatgaccgccgccattggggtggcggcggggatggggcgggaatcgacggcggtactcagtacgctgctggcactgatggtattcagtgtgatgccacgggtcgtcaagctgctggacaagaatgagtgacagggtcaggtgctgaggttgctgtacctgacctcgccgaagacttttaccacgaagggcggctctcccgggttgccggaaatcattaccacgctcgtgttattggccgggttgtagtgaacctgcacttcgccactggcgcctgagaaattttctaccaatttcaacggcttgttgccgagttggtttcgaatggccgttacatcgagcttgtctctgttgtggtcaaaatccatcacctccttaggcgcatcgaagttcgagtcgcgggtactgtggaaggtgaaggtctgaccaatgtcaatcctggaatcgttgctgttgttgttgttgttgttgttgttgttgttgttgttgtcgggtttgaggctgtctgcctcagccgatgaattgtccggttgcggggtcggctcgcctaggtccacttccttgccgatctcgaagagggccgaggcgagtggcgtactctggcgcactcgctgtttggcataggattcctcaacgcgtagctcatcaaagacttgcatggattggctgaaactctcctcggggtcagaactggcagtgcggtcgcggatctcttgagggctcaagcccggtcgctcgatgtgcgaggattggtcatggatcttctgcaggcttgactgacctagacgctccttcacttcggtaatcagcttgcgcgcttcgtctgcatcggggccttgcagcatcgacttgacattttccttgcttaacagactacggatctcggccaacttctgggcggtctcctgcgagtttggctcgcgcagcatctgggtaatactctcccggctggcgagcgcacgaagttgggcgagccggggtgcgtctgcaccgggcgcctgcggctctacgtctgtattaggtgcagtgctgggcgcagttgaggcttgctcctcgggcgcatcggtaccgggcgcctgcggttttaggcttgtcgaggggctagggttgggcggggtaaaagcttgcggtgccctggggaggtccgatggatgcctgtcaggctctttcctgcgcatgattccgctggggccggcccttaataaatcgttcagtttctgtcgataatcgttggcggacggttgttgtatgccctggatagtggacgttggtggcagtagcgaaatggacatagaaggtactcgcgttacggacggaatagtctgcggccagcgacaaggcgggtcagcgcacgagtagtgaatctatcttgaccttgggaggggggagctcggcgccgtctgtaatgcgagtgggaaaaatcagcggcgcttgctcgcgatgtttggttcgcaagcaagcgcttgccggcctgtcaatcagacgataacgggcggcatcgttgcggggggttcctggacgggcggtggctcgttttcagggggttcttgttcaggaacgggtcggggttctgtgggcggcagcgggggctcgtcgatatttggatcttcgggttcagggggtatcgggatattcatgggtatggcctcgtttgtgctttgctctatcggtggacccttgcctgcgggaaatgattcccgcccagtggcggtatatccacctgaacttttgaacagcgcccatgctcggaccttatacggccctgctcagggagagcgtcgccgtttctgaattcggatcaagcaaagggcgtccacggggcgtaaggggaagatgctcgatgactgctgaaacactggctccagaagattccgtattgccgctgtcccaggcgcttttgttacccaggatcgctatcgaaagcaccatgccggtgatcgacaatggcgagttcgccgtcaaggcggtggttggccagcggatcaatgtcaccagcaaagtgttcgccgatggccacgacaaactggcggtgctgatccgctggcgagcgcgggaggatgaaagctggcacagcgtggtcatgaacgatgtgggcaacaatggctgggaaggggcgttcagcgtcgcccagcagggcccgcatcaatactgcattgaagcctggatcgataccttcgccagcttttgttacgaactgcgcaagaaacatgaggccggagtgccggtcagcctcgagctgcaggaaggccgcagcctggtgctgcaggccgccgaacgcagtgacaacgaactgcgcgaccgcttgatgctgttgcaccacgaactgtcgggcctgttggaaaccgagcaggtggcgctgtttctgcatgaaaacagtgcacacttgatgacccaggccgatcaccgcgcctacctgagcgtcagcccggtgtacccgattgatgtggaacgcgaagcggcgcagtttgccagttggtacgaactgtttccccgctcgatcaccgacgatccggcgcgccacggcaccttcaacgatgtgcactcgcgcttgtcgatgattcatgacatgggctttgacgtgctgtacttcccaccgatccatcccatcggccgcagtcatcgcaagggcaagaacaattctctgatggccggccccgatgatcccggcagcccctatgccatcggcagtgaagagggcggtcacgaggcgatccacccgcagttgggtagccgcgatgacttccgccggctggtcaaggccgccgccgaccacggtctggaaatcgccctggacttcgccatccagtgttcccaggaccatccgtggctcaagcagcacccaggctggttcaactggcgcccggacggcacgatcaagtatgcggaaaacccgccaaaaaaatatcaggacatcgttaacgtcgatttctatgcggcggatgcgatccccggcctgtggaccgagctgcgcgacattgtggtgggctgggttgaagagggcgtcaagacctttcgcgtcgacaacccccacaccaagccgctgccattctggcagtggctgatcagcgacgtcagggccaaatatcctgaggtgatcttcctggcggaggctttcaccaccccggccatgatggcgcgcctgggcaaggtcggttactcccagagctatacctactttacctggcgcaacaccaaggccgagttgagcgaatacctgacgcaactgaaccaatcgccgtggcgcgaatgctaccggccgaatttcttcgtcaatacaccggatatcaaccccggcttcttgcaccagtccgggcgcccgggcttcttgatccgtgccgccctggcgaccatgggctcgggcctgtggggtatgtattcgggctttgagctgtgtgaagccgcgccagtgccgggtaaagaggagtacctggattcggagaagtacgaaatccgccctcgggactttaccgcgcccggcaacatcattgccgagatcgcccagctcaaccgtatccgtcggcagaacccggcgttgcagacccatctggggctgaagctctacaacgcctggaacgacaacatcctgtatttcggcaagcgcagcgaagacggcagcaactttatcctggtggcggtcaacctcgaccccttcaatgcccaggaagctcatttcgagttgccgctatgggagatgggcctgcccgacgacgcccagacccagggtgaggaccttatgaacggccatcgctggacctggtacggcaagacccaatggacacggctagaaccgcagatgccatttgggatctggcgtatcactgtttcctaggcaagtggagatcagagtgtgggagggggcaagccccctcccacattgattgcatttgcgtctgcagaatttcaggagtttccaatggcgaagaaacccaaggcagccacctttatcaaagacccgctctggtacaaagatgcggtgatctatcaggttcacgtcaaatcctatttcgactccaacaacgacggcatcggtgactttcccgggctgattgccaagctcgactacattgccgacctcggtgtgaacaccatctggctgttgccgttctacccttcgccacgccgtgatgacggctacgatattgccgagtaccgtggcgtacacagcgactacgggaccatggccgacgccaagcgcttcattgccgaagcccacaagcgtgggctgcgggtgatcaccgagctggtgatcaaccacacctccgaccagcacccctggttccagcgtgcgcgcaaggccaagccgggctcggcggcacgggatttctacgtgtggtcggacgatgaccagaagtacgacggcacgcgcattattttcctcgacaccgaaaagtccaactggacctgggacccagtggcgggccagtacttctggcatcgcttttattcgcaccagcccgacctcaacttcgataacccgcaagtgatgaaagcggtgctgtcggtgatgcgctattggctcgacctgggcatcgacggcttgcgcctggatgcgatcccctacctgatcgaacgcgacggcaccaataacgaaaaccttgcggaaacccacgacgttctcaagcagatccgtgccgaaatcgacgcccattaccctgaccgcatgctgctggccgaggccaaccaatggccggaagacacccagctgtactttggcgaccgcaagggcgatgacggcgatgaatgccacatggccttccactttccgctgatgccgcgcatgtacatggcattggcccaggaagatcgcttccccatcactgatattttgcgtcagaccccggagattcccgccaattgccaatgggcgatcttcctgcgcaaccacgatgaactgaccctggaaatggtcaccgacagggagcgcgactacctgtggaactactacgccgccgaccgccgcgcgcgtatcaacctgggcatccgccggcgcctggcgccgctgatggagcgcgatcgccgccgtgtggagttgctcaatagcctgttgctgtcgatgccgggcacgccgaccttgtattacggcgatgaaattggcatgggtgacaacatctatctgggcgaccgcgacggcgtgcgtacaccgatgcaatggtccatcgaccgcaacggcggtttttcccgcgccgacccggccagcctggtgttgccgccgatcatggacgcgcaatacggttatcagtcggtcaacgtcgaaacccaggcccaggacccgcactcgctgctcaactggacccgacgcatgctcgccgtgcgcaagcagtcaaaggcgtttggccgtggcagcctgaaaatgctttcgccaaccaatcgccgcattcttgcctatacccgtgagtacaccggcgaagatggccgcagcgagatcatcctgtgcgtggccaacgtgtcgcgcagcgcccaggctgcggagctggacctgtctgcgtttgccggcatggtgccggtggaaatgcttggcggtaatgcgttcccacccatcggccagctgaatttcctgttgaccctggcgccctatggcttctactggtttgtgctggcggcggagaaccaaatgcccagctggcatgtggaaccggcgcaaagcatgcctgacttcaccaccttggtactgaaaaaacgcatggaagaattgttggaagaaccttgccgcaccagtcttgagcaaacctcattgccagcctggctgcccaagcgtcgctggtttgccggtaaagacacggccattgacagcgtgcacatcgcttacggtgttcgcttcggcgacccgcagcacccggtgctgctcagtgaaatcgaggtaaccagtggcggccaggtcagccgttatcaattgccgttgggctttctgggcgaagaccagttcaccagtgccttgccccagcaattggccctggctcgcgtgcggcgtacccgccaggtagggttggtgactgatgcgttcagccttgagcagtttatccgtgaggtgatccaggccatgcaggccggtaccgtgctcagttccgttgagggcgatctgcgtttcgagtcgacccaatacttggccgggctgcaactgggcagcgaatcgccggtgcgctacttgtccgccgagcagtccaacagctcggtggtagtgggcgagagcctggtgctcaagttgatccgcaaagtcagcgccggggtgcacccggagctggaaatgagtgcctacctgaccgccgccggctacccgaatatttcgccattgctgggttccatgagtcgccgcgatgggcaaggccaggacaacctgctgatgattgcccaaggctacctcagcaatcagggcgatgcctggagctggacccagaacaacctggagcgggcgatccgcgacgaactggccgaggccatctccgaacaggagcagcactacaacgccctgggagaactggcggatttcgccgggctgcttggccagcgcctgggggaaatgcacctggtgctgggcgcgccgaccgccgacaaggctttcaagcccgaactcaccacggccaaggatacccaggcctgggccaaggatgtcggcgcccagatcgaccgcgccctgcaactgctcaaacttcatcaaagccagttgaaccccgctgatcaggtgttggtcagtgaattactggcgcagaaaaaagccatcgccgggcatgtccaggcgctggcgaaggccacgctaggcgggttgcgtctccgggtgcatggagacttgcatctgggccaggtattggtggtcaagggcgatgcctacctgatcgactttgaaggcgaaccggcgcgacgactgcatgaacggcgtggcaaacacagcccctataaagatgtgagtggtgtgttgcgctccttcgattacgcggcggccatggccctgaatgtgcaaggagtggatcactcgccggaagcggacaacgcgcgtaaacgcgtgaccgatcgctacctgaatgaagcccgccaggcatttacccaggcctaccaggcggcgacggctacactggcgcatgattggcaggatgccaagggccaggacgcagcgctgacgttgttcagcctggagaaggctgcgtacgaagtggcctacgaagcggaaaatcgcccgacctggttgccggtgcccctgcaagggctgcacggtttgctcagcgggctaacacctaaatcgaaacctgtacgcggtggggagacctcatgagttttacacataaagaaccgctgcagcccaagctgacggcattgccggcgtccaaggacgtcgaagcgctggtgcgcgccgagcaccccgatccattctcgatcctggggccccatgacgacgagcagggggggcagtttatccgcgtctttctgccggaggcgttgagcgtccaagtgctcagccgcgatggcagcgagacccttggcagcctggaggccaaccaggtaccgggtttatttgtcgggcagttcggtacgcgtcaaccttacctgttgaaaatccagtgggccggcggtgagcagatcaccgaagacccctacagcttcagccaattgttgctgggggaaatggacctctacctgtttgccgaaggcaatcatcgcgaccttggcagttgcctcggcgcccaggtgaccagcgtcgatggcgtcgcgggcgtgcgctttgcggtatgggcaccgaatgcacggcgggtctcggtggtgggcgacttcaatatctgggacggtcgccgtcatccgatgcgcctgcgccatccgtctggcgtctgggaaatttttatccctcgcctgcaaccgggtgccgcctacaaatatgaaatcctcggagcccatgggatcctgccgctcaaagccgacccgatggccctggccacccaattgccgcccgataccgcctctaaagtcgccgcgcccttgcaagtggactggcaggacaatgactggatgcaggcccgtggcgacaagcagaaatccactgcgccgttgtcgatctatgagctgcatgtgggctcctggcagtgcgaactggacgaggccggcgaagtcgcccgccagtacggctggcgtgaactggccgagcgcctgattccctatgtgcagcaactgggcttcactcatatcgagctgatgccgatcatggagcatccctttggcggttcctggggctatcaagccctgtcgcagttcgcgcccagtgcgcgctttggctcgccggaagacttcgcctggttcgtcaatgcctgccatcaggcggatatcggcgtgatccttgactgggtgccggcgcattttcccaccgacacccacggcctggcgcaattcgacggcacggcgctgtacgaatatgccaacccgctggaaggcttccaccaggattgggacacgttgatctacaacctgggccgcaccgaggtccacggcttcatgttggcgtcggcgttgcactggctcaagcatttccatgtcgacggtctgcgagtggatgcggtggcgtcgatgctgtaccgcgactactcgcgcaaggctggagagtgggtacccaatcgccatggcggccgggaaaacctggaagccatcgacttcctgcggcacttgaacgacgtggtcgccctggaagcgccgggggccttggtgattgccgaggagtccaccgcctggcccggggtgagccagccgacccaacagggtggcctggggttcaactacaagtggaacatggggtggatgcatgattcgctgcattacattcagcaagacccggtgtaccgcgcccatcaccacaacgaactgagttttggcctggtctacgcctggtccgagcgttttatcctgccgatctcccacgacgaggtggtgcacggcaagcactcgctgatcgacaagatgcctggcgaccgctggcagaagttcgccaacctgcgcgcctacctgagtttcatgtggatgcacccgggcaagaagctcttgttcatgggctgtgagtttggccagtggcgcgagtggaaccatgaccagcaactggattggtacttgttgcaataccccgagcaccgcggcgtgcagaagctggtgggtgacttgaaccgcctgtatcgcgaggagccggcgctgcacgaacaggatgatgcaccccagggcttccaatggttgattggcgatgacgcgatcaacagcgtctacgcctggctgcgctggagcaaggacggtaagccggtgctggtggtcgccaacttcaccccggtaccgcgtgaaggctatgcggtgggtgtgcccttcggcgggcgctggagcgaggtgatcaacagtgatgcggatacctacgccgggtcaaactttggcaacggtggagaggtgcttgcccaggatgagccacgccatgggcaaccagcgtcattgtcgttgaacctgccgccgttgggcgtactgattctgcgcccgcaagggctataagggctctacgttgctggatgcagttgtccaggctactggcagggtgccacaatggcgcctttgtcgtagcagtccaaacaggcggtttgcatgaacagctccagtcgtgcgcaggaccaggacgacgtgatcgaggagcaggtgcgaactgatcgtttgcatcagctgtttcgccagtcgttctccgcggtgttcggcagctacctaggcgcggccatgctctgctggctgtgctgggatcgctttgagcaccgggtcatgctggtgtggctggtgttgctggcgggggcgtcgctgctgcggctgaagatgttcatgggctggtttgggtgccccgacagcgagcgcacgcccgctcgctgggagcggcgttactgggtcacactgatgttatcggctggcatctggggtggcggtgcgttagcggtcatgcccaacgacgaccgcgtgtcccaggtactggtcatgctgtttaccgtgggcatgtcggtcagcgcggtgtcctgttactcggcgtatcgctacatgacgctgggggccatggccctggtgctgctgccgtgtacgctgtggctgttgttccagccttcatcgatgcaggtgggcgtggcgattgcggtgctggtgttctcgacttttgtggtcagtgccacgcgcaagctgtctgatgccctggaaaaagcttttcgcctgacccggcaaatggaacaggcccacaacatttcaacccatgccgcacagaccgatgaactcaccggcctgaagaatcgtcgtgctttcttcgagcatgcccagttgttatacacgcagtgtcaacagaacctgcagccgctgtgtgcgctgatgctggacatggaccatttcaaatacatcaacgatacctacggccaccaggccggtgaccaggtgttgcgccaggtcggcggtgtgatcagtgcttcgtttcgtcaggccgacgtgtccggacgcctgggcggtgaagagttcgctgtgctgctgcccaacacgtccctggagactgcgcggactatcggtgagcaattgatcgaagcgattgccggcttgagtgctgaaccggtgcagggcctgaccgcgagcctcggggtggcgacgaccgagggcaacgagcacgatctgcccggcctgatgaacgatgccgaccaggcgctgtaccgcgccaaatccctgggtcgcaatcaggtagtgatcgcgcagtaggttcaatccttggacatggccctggcgagggcgcgtgcgacctgttcggcagagtagggcttggcgaggaattcgaaaccttcgtagccgctgtcggccagttcttcgctgtagcccgaggtgagcaccaccggcaggtcggcacggcgctctcgcagtaacttggccatcgccacgccggtcatcccgggcatcaccacatccgaaaaaatcgcatcgaacgccccggcgtcggggcctgcgagggccagtgcctggcgagcgtcggtggcccaagtggtctggtagcccaggtcctggaggatctgtttggcgaagcgtcccacttccaggttgtcttccacgatcagcacatggcactggatgttgttcggcaatggcaccaattgctcgggcgtgggcggtggcggtgggtcctggctgtccacctgtggcaggtacagggtaaacaccgtgccttggtctggggcgctggatacgtcgatattgccacctgattgcttggcaaagccaaacacctgggatagacccaggcctgtccctttgcccaccgccttggtggtaaagaacggctcgaaaatgcgttcggaggtgtcactgggaatgccggggccggtgtctgccagagaaatcgtcacgtagggcaggtgcgacccggcatccccgcggatgcgcggcaggggctggtgcccggtgactttcaacgtcagtgtgccctggccttccatggcatcgcgagcgttgagtgcgatgttgatcaatgcagtctcgaactggctcgggtcgatgcgtgcgtagcaaggctgatcaggcaattgcaccttcacgtggatacgtgcgccggtgacgctttcaagcatttcaccgatgttctgcacccgctggccgacatcgaacacctgcgggttcaacggctggcgacgggcaaaggcgagcagttgactggtcagcttgctggcccgctccactgtatcggaaacggcgctcatgtagcgctggcgacgttcctgcgccaaccccggctggcgcaggaagtccacggacgagcgaatgatggtcagcaggttgttgaaatcatgggccacgccgccagtaagctggccgatggcttcaagcttttgtgattggcgcagtgcagcctcggcctgggccagggcgagggtacgttcttccacccgctgctccagggtggcgttgagttcggtgtacgccgccagcccctcgcgtacggcggcatcggcgcgcacgcgctcaatgtgcgcccaggagcgctccgtgacttcgcccaacaacgccaggtcgtaggaagaccagtagcggggctgcttgtcatgtatagccatcaacgcggtgaggcgcccatccttgatcagcggcatgcagatggtggcggttacgcccagggcctggaaggtcgccgactcatcggccggcagttcgaccaagttattgcaaatcaccagcggcgcgccggcccgcaggcagctcacggcgcgttcgccgaactgcgccaggctgtaatggccgatgatgcttggcgaaccgttcgacgcccagtcgccgcggatggtgaagccgtcttcatcggcatccatgtcggcgtaagcgcaaatggacacctgcaggtgttgcgccaataaccgggtggtggcggtcatgattgtttcggcgtcggtggcgttggctacagtgctgccgatggcatccagtacttccaggcgccgggcgagaaacacagtggcggtggtctcggtcaccgtgtcgagcatgccgaccaccttgccccgggagtcacggatggggctgtagcagaaggtgaagtaggcttgttccggtgcgtcattgcgttggatcaacagtgggaagttttcgatgtaggtggcatgcccatcgaatgcagcgctggcgatggggctgatatcgctccacacctcatgccacacctcgttgaacgggcggcccaatgcctcaggcttgttacccaggatcggcgcgaacgcatcgttatagagcgtaatcaactcaggcccccagacgatggcctggggaaaccgggaggccaagcacagcgcggcggtggtcttcaatacgtcgggccactgctccagcggccccaggggcgtactggcccaatcatgctggcggacccgctcggccatgtcgctgccgtcttgcagccaattcatcattgggtcaacaccttatttgccacggctcaactattgcctgaaacgtcaggtcgcaagcaacagacctgcatgatcgcaaccagttcagcgcgaccatgcaggtgatagcagttgaacatatctgcatatggatgaataaattcagcgctttccaggcgctcccccaaggcttattgggcggcgaatactccggtccagtagatgcccgcgtcgctcttgggatccatcgcgtaggcggcacccaaatcgcgaaattgcgggttcatgaggttggcgcaatgaccagggctggctagccaaccgtcgacgaccttgcgtggggtatcgaggccggcggcaatgttctcgccgatgttcttggcgatatacccggccagttcggcgcggtcgccaggggtacggccgtcgtggtccaggtggtcgaagaaattgccgttggccatgttacgtgtgtggctgttggcagcgctggcgagtgcatcgctccacgacagcggggcggcggcggtgaacgcctgggtgccgcaagtgcgcggttctgcgcgagcggcgttgaccaggttgagcagttgcctgccctcggtctgccagtcgcccaggccactggtcaccaacgggcgggccaatacgatgcgccagtcctggccgctgttgctcacgccaatgtcgacaaattgcgggtccagcactacccggcagaagctttcgcgtaccgctttcatggcggcgtcggcgtccttgggcccggacaggctgatggcctgcacgttgaccatcgggtacgcggcccgcgccagggactgctgcaagtcgccgacgttggaggccggcagcaccaggcgtgtgtcgctggtcagtggcggcaactcctgggagccttggtcaccgcagcgttgcagctggctgcggtactgattgatctgttgtatcaactgactttcttcattcgccatcgcgctggcgcagaacaccgtactggcggccagcgtcgtaagacccatcatcaatgacagaacgcgcatggacgttacccttgagcttgaaagtgcccatgatgcgcgatccaggtgcatccatgcacccgttggtccgaactttttttcttcagttcttgaatgtcgagtgttttgcgccctgatcgcacagggcaaacaccaccaccaacagcgcagaaaccgcaaggatgatcaccaccccatcggtggaatgggtggccgaggccgccaccatcgacagcgcgcccagcggtgccaggccaccggcaatggccgtgccgatttcacgcccggtgccgaagcccgatgagcgcgtctgggtcgggaactgccggctcaggaacgagccctggggagcgaacatcatcggcgcgaggatgccggtgcctacgccgatggcgaggtagatcatcaggctttcgccactgttgagcagcgccaggaacgggtaggcgaacagcaacgagcacaggccacccagcatcagcacggtcttgctgctccacttgtcgcacagccagccgaagcagggcaccgcgacgatggcaaccaggctggcgatggtcaccgacagggaggtgacatgcacatccacacctttgaattgagtcaggtaggccagggagaaggtcttgaaaatgtagctcagggcgttgtagccaatggcaacaaagaacaccaccgcgaggcccttgagatcgttcttgaacagcgccttgagcggggacggcttggccttgacggcctctttactcagttcctggaactgcggggtttccggaatgctgttacgcacccacaggcccacgcccaccagtacgatgctgcagacaaacggaatgcgccagccgccggccagcaggaactcgttgccgttgatagtcagcaggtaaatggtcagcgaggacagcagcaggcccaggttcaggcccagtgccggccaggcaccctggctgccgcgcttgccctgggctgcgtgttcgtaggacgtcactgcggcgcctgacaactcggcaccggcgcccaggccctggatgatgcggatgaacaccagcaggatcggggcccagatgccgatggaggcgtagctggggatcaggccgatcagcgtggtgcacacgcccatcaggcagaaggtcagcaccagcacctgcttgcgtccgaacttgtcgcccaggtagccaaacaggatgccgccgaacgggcgggcgataaagccgatggcgaaggtggaaaaggccatcagcgtggccgtcttggggtcgctgttatcgaagaagatcttcgagaacacaatggccgccatggttgcgtacaggtaaaagtcgtaccactccagcatcgagccaaaaatggtggcggccgcgactttgcgcaggcgctttcgggtttgcacaggcgtttcggtgccggggatggaggcggttgccgtcatgctggacttccttctgggtctttgtagttattgttgggtgagcgggcagagcgggtattactcgggatggaacaggcggtcggcgatcatcgcgccgatgggcatggctgacgtggcggccggcgagggcgcgttgcacacatggagcattcgcgaggtctgggcgaacaggaaatcgtgcaccaggctgccatcgcgcatgactgcctgggcgcggataccggcctcgtagggcagcaggtcttcgagggtcagggacgggcagtatttgcggcactgctccaggtaaccggacttgaacagcgagttcttcatctcggtggtaccggagccgaggttttgccaaagggttttccagaaacccggaaaactggcgtactgcgccacgtcgcgccagttcaccgagaacttgcggtagttctcgcgccccagcccgagtacggcattcgggccgacggtgacgctgccgtcgatcatgcgggtcaggtggacgccgaggaacggcagctccggatcgggaatagggtagatcaggtggttgacgatgttgttcttcgatgccggcaggcggaagtactcgccgcggaacgggatgatctgatgatcaatgctgatcccggccaggcgggccaggcggtccgattgcaagccggcgcacaccaccaggtggcgggcttgccaggtttcaccatgggtattgacggtgactttatcggtgtcttcgtgaatggcggtcactgtgcgctccaggcagatctgcccgccgccgcgacggatcacctgggccatggtctcgcacacctggcggtagtcgacgatcccggtggcgtcgagaaacaacccgccaaggccgacaatgttcggttcacgctggcgcaattgctcggcatccaggcgctcgacctgcatgccgttgagctgggcgcgggcgtgtaacgcctccatccgttgcatttccagcgggttggacgccaccagcagcttgccgcacacctcgaacttgatcccgtgatcacggcagaactgcttggtggcttcggcaccgcgcttgcacaggtcggccttgaggctgccgggtgcgtagtagatacctgcatggatcacgccgctgttgtgcccggtctggtgcttggccagcaccggctctttttccaggatcaccagcgacgcgcctggctggcgcttgagcaattccatggcggtggccaggccaacgatgccgccaccgatgatgcaaaaatcgtgaatcattgcaggagttcccaagtcacacatttcagtctgcttatcaggttgtcagactaatgtttttgttaaaaaaatggcgtgtcccaggacacgctataaacacagtggatcaattcgtggtcggcaattccagttgcaggcggcgtgctgctgcacgcaaatgcgcctcggcgctggcggctgcgcgttgagcgtcgccgtcggcaatggcttggtagagctgctggtgttcctgagtcgcatcggccgagccggtagcgaagcgcgacgcggagttttcccacgcggtcttgcgggcactggccaactggctcctgaggaagtcatggaaggccacgaagtagtcattcttgctggcgtcggcaatggcgcggtggaactccacatcggcaagggccgccgcctcgaaatcgtcgcgattgtcctgcatggcctgcaaggcgcttttcatgcgttgcaggtcggcagcgtcacgtcgctgggccgcaatcgaggcggcctgggtttcgatccacaggcgcacttcgaacatctgtgccaggtcaggccggcgcccgttcggctgcgggaaacggaacaccgtgccagcgggcgtctgcgaaataaatgagcccaggccgcggcgggcggtgaggacgccgtcggccttgagctgggcaatggcttcgcgcaccacggagcggctgacgttgagctgctcagccagttgctgttcggtaggcaggcgcgactccggggccaactggccggattcgatttctgcgcgaatcgcgctgacaacccgtacgacgagcgaatcggggcgctggagctcaagcatgatgaaaccttggtaatcaggttgtcagacaatagtcgttacgattttaacttgtcaatatttgtctgctccgagccggcccgtgtgcgcgcgcgattccaggcaatcacaccggcgagcaggatcaaccccgctgctgtggcgaaggtggcatgcaggccggcggtcacggtctgtggcgtagcctgggtgacatccgggctgctgcgggcgaagaccgcgcccaggaccgatgcgccgaaaatcaggcccaggttgcgcgacagattcaacaggccggcaacggtgccccggcgtgtcgccgacacatcgctcatgactgcggtattgttggccgcctggaacaggctgtagcccgtcgtcaaccccatcagtgccgcgatgtacgcgacgagccccgagacctgcgacaaccacagggcagcgcacagcatcgtgcctatgcccaccagggtcaggcgccgggtacccaggcggtcggtgaggtagcccgccggtatgccggtaatggccgcgaccgccgggccaaccgccatcgccaggcccatccaggcgggatccaggcccaagccacgggagagatagaacgggcccaccacaaacgtggccatgatcaccgccgacaccaaggcgctcattgccagcccggcgcgcaaccccacatcgcgcaagggcgaccagaatgtatcccggactgacgcgtcagggcggcaagcatccaccggcaaatagcgctaggcgagggcggccgccaacccagccaatggcacaccgaggagggcgaggcggcacagcctgcgcatgccagggcaaacagcaacaacccggccagcaataggcgtcgacgccccaggtagtcgcccaggcgcccggcgctgacgatcactgcagtaatggccaacagataggcaagcaccacccattgcaccgcgtgaaacgatgccgcgaatgcgtgcgccaggcttggcaggccgacattggcgatgctggtgcccaggttgcaggttatagctgcacagaacgcctcatcggggcatggtgttccacaactactggtacgccaccggacctgtgggagggggcttacccccgatggccatgggtatctacacatctttgatgtagcgaccgccgataaccacgatgcgcagcgagtcgctcttgatctggcttttgatcttgatcttaggcgccctgttaaaccacgctggccggaattcgacagggatttggggggtaaaccggcagggatgccggtttagccgccccgcgccatggatggcgcgtggcggcggccccccaaatccatggcggattacgggcacaccgagcctgggcgaggtgccgagtggtggggcaagagcgtttggttactttgcgcttttcaaagtgacccgctgtaaaagcggaacccatagtggccgttgcccaaataacggatatgtactcggtctgatccaacattctgctcggctgtcaggccgccatcgggggcaagccccctcccacaggggatctgcgcttaactgaccggctttagggcaagccgctcccccatttagagcgtcgcgagggtgagcgccttcggcaatacccatactcatcggagcccgcatgaccgacttcaatttgctgatcaccctggatattttgctggccgaaggcagcgtcgcccgtgccgccaagcgcctgcgcctgagcccttcggccatgagccgggccttggcgcgcttgcgtgcggccactggtgatccgttgctggtacgcgccggtcacgttaccgacgttcaccgtggcaatgctttggcacccacgccaggatgccgacctggcccatcgctggctgcgcggttgcctgcgcgaggtatgcgggccatgacggggccgcaacgggtacaatcgccgctgccttgacgcgaaactccaggaatttgcatgttcagccttacccgctacaccacaccgtgcgccgaatcggtcaacagccagatcctgcagatggtggtggacaacctcaccgacatcagcagcgtggcgttggcgccaagcaacctgctgtacaacatctaccagtacgccatcggctttgaggtgcatctgtaccttgaggcgttgaatggcacaaagggcattgccgtcgagttggtcgtggcgatgcaggcagagaccgttattggtttttgcctgtacctgccggtgaaggacgatccagaggcgtgtggcatagccttcatggcggtgcaggctggctttcgtcgccagggtgtggcgcggggcatgctgggcgaggtgctggcgcgctatccccatgctgagctggcctgtgcggtggagaaggtcccggtcttcgaggccatggggttccgagtgcgcggggcgcggggtacgcaagtgttgatgaacacccgcgactacggcaccgacgggctgatgggcgtgctggatgtagcgccgatctatagctcgctggaagtacgccagatccatacctacctgctgcaaaagcacggcaagcgcgccatggtcgacgcggagaagcagcgcgaccggcacctggatcagttggcgcgcaaggtccagctgtttatccagggccgttctcctaccgcctgacgcgattgaccatccccaggatggtcgccagcaattcctgttgcgcctcctcgcggctgatctcgccattggccgccgcatgggacaacgcttctgctgcgccgagcatggcccgcaggccagcctgggaaatactgccacctgaggcgaagggggccagcgcgtcgcggcatttctccaggaagatcgcctcatattcacgcttgagcgcctccagctccggcgaaccgctcagcgctgcaatcacccccgggatttcccggccttgcaacaacacgcaatcgacataggacgaggcgatcacccaggcccggtcctccagggttgcgttgctggtctgaatggcattggtaaacacctggtcctgacgctcgtcgaaatctgcatacaacgcggtcagtaaccctgcacgcgtagtgaagtggtcgtagaccaccggcttggtaacgcccgccagttctgccagacggcccagggtcagggcgtcggtgccctctgcgcggaccagttgccaggccacatcgagtaactggcgcaggcgaccttcacgggataaacgccgacgcggggaaggggattcagtgcttgacatgcttatataccaaaagtaacttattcgacttaacttactaaaagtagattaagccaaaagggagtcaaagtcatgcacgcactgattgttgttgcccatcacgacccgcaatccctcacccacagcgtggccgcccaggtcggtgccggtttgaccgccgccggccacacttttgaaatcgccgaccttgccgcagaaggcttcgaccctcgctacaccgccgctgatcaccaggtgcaccgtaatcacgcaacgccgccagccgacgtggtggccgaacaggcccgcatcgagcgcgccgacgccctggtgctggcgttcccgatctactggtggtcaatgccggccttgctcaagggctgggtggaccgcgtgtttgtcaatggctgggcgatcgactatggccctgacacagcggtggagaaaaaattgcggcacttgcaggtgcacctgctggccctcggtggcgcggatgaaagcgcttttgatcgacacggttatgccaaggccatgcgcacccagatcgactacggcatctttgattactgcggggcgcaggtgctgacatccgagctgctgctggattcggaaagcggtgctgcccaagcgcatctgcacagggccagggcggtagggcagggggtgtttcagcgcgagacggtagccggatgattcaaacgtcgcgaaacaggtcgtgggcatccagcaaacggtaggcaatctccggccgtttctccaggccgcggcggatcgatgccgggatcgcttgccgggtcttgcggcacatgcccggcagttcgtcgatgacgatctggatcccgcgcatgctcttgacctcggtgtgccccggcgcgatatgcacgcggatgccgagttgctcgtacatccgccgttgcatatgttccaggtcttgcaggctcttgaggttttcaaggcgctcgagcaggattttttcctgctgtcgcgtcaattggaggatgcgcaggtcagcgccggcagcctccagcagttgttcacggttgcagacacaggcgccaggtgggcagggttggcgaagggtcataggcgcttccggcgagtcgcaagggtcagtagcttaactgaaccccaaggctacccaaggctttccaatactcagggtaggtcttggccacgcagtccgggtcctggatgcgaatgcccgagactttcagaccggccagggcaaagcacatggctatgcgatggtcggcgtgggtatcgatcagcgccgtgcacgtggtgccggccagggcagggtcgctcgcgaccagcagatcatcaccctcgatggtcgccaggcctgggcggatctcattgaggccatcgtgcagcgcctgtacgcggtcacattccttgacgcgcaggttggccagttcagtgaaacgcaccggggtgttgttgaatgcggcgaggacggccagggtcgggatggcgtcctgcatttgtgagcccactaccgtggcctgcatattcgggaactgggcgatcacggcctgggccttggcgtccggctgggtgaagtcctgtgccgcgacaccgatatcgatacgtccaccggtcaacacttcggcggcccacaggtaggtggcggcggacgcgtcgggttcgatcaggtagtcatgggcggtgtagccggtcggggccacgcgccaggtggtgtcgtccacggtttcgacctgggcgccgaatgcgcgcatgcaatcgagggtcaggtccacgtagccacgggcgccaatgtccttgccggtcagcgccacttcaatcggcgcctcaccacaggctgcgagcatcagcagggctgatacgtactggctggacaggccgccatcgatttcaaagcgctttgcttgcaccttgcccacgccgtgcacggtcaccggtgggcagccggtggggctgtcgacctggataccgttctggcctagggtagccagcaacgggccgatcgggcgtttttgcatgtactcgtcgccgtccagtaccacggtgccttgcacggtggccacggccgcagtgagaaagcgcatggcggtgccggcgttgccgaggaacaacggctgggccggcaattgcagcgaaccttggctggtgacgacgaaggtggtgtcgtccggttcatcgatgcttacgcccatctggcgcagggcgaccgacatgtggcgggtatcgtcgcttttcagcgcaccgctcaagcggctggtgcccttggccaatgccgccagcaacagggcgcggttggtaatggacttggagccggggggcgcaaccttgccattgaggggaaagtcgggcggtgtaacggtcacggttttctgcgaactcaagggacaaggctcctggtcaaggcgaggtggcatggagtggccgacgtgcggacccgaataatcaggcaaacacgccatgtttgtcgagtgagctggtgatcggcatgactttttagtggtcccctcccacaggtctgcggctagcgtttgtagacgaaataagcccgcctcagcgctggctcagccagtagtcatgcagcgcccgcgcagccggttcgattgcactgacccgctgctgatgggcgtctacatccaggtccgccggcaattcgaaattgtcctgctcagcgcaccaggagattttctccaattgcccggcttgttcggcgggcaattgaggccagttggcgatcgtcacgcctcgcacgtagccaaagcaccattcctcggcaagggtcaccgcctggccctgatgctcggtttcgtcgaagcgcgccttgaacgcctgggaatcgctggccaactgcgcagccaaggtattcatatggcgcacgcacagttccagaaaaccctgggcctcgtccatgctttcccattccgggttctgcccaccccagatggctgggaaccattgagccacgtcaacctgggccggtccagacaccagggcggtgaagtagccgtcgagttcggccaggttcagcaccgaatggtcatcgccgtacttgagcagggtttcgtcgatcaggtctaattcggcggatgtgaggggctgggcgtgcatggcatatccttgagcgtcgaacgccgcgggtcaggcggcttaaagcgcgcaggatggcgtgtacgcggcattttatccagcgccttttgcgcggccggtcccgcttttggccgatgcgccgtggcgcacccttgatatagtctggccttcctcaatcgccagtcagggatcactgccatgtccgaataccaagccttcgttgtcgaactcagcggcaacgttgcccatgtgcagatcaatcgcccggaaaagatcaacgccatgaacgcggcgttctggagcgaaatcatcgagatcttccaatgggtcgaagataccgatgccgtgcgcgtcgtggtgctcagcggcaatggcaagcacttttcctcgggtatcgacctgatgctgctggcttcggtggccaatgagctcggcaaagacgtgggacgcaacgcacgcctgctgcggcgcaagatcctcgagctgcaagcttcgttcaatgcggtcgacaactgccgcaagccggtgctggcggcgatccagggttattgcatcggcggcgccatcgacctgatcagcgcctgcgacatgcgttacgccgccgaggacgcgcaattctcgatcaaggaaatcgacatcggcatggccgccgacgtcggcactttgcagcgcctgccacgcatcatcggcgacggcatgctgcgtgagctggcctataccggtcgccagttcggcgccgaacaagcgcgcagcatcggcctggtcaaccgggtgtttgccgatcagcaaagcctgttggccggggtcatgcagatcgccgaggaaatcgccgccaaatcgccgattgccgtgaccggcaccaaggcgatgatcagctacatgcgcgaccacaccatcaatgacggcctggaatacgttgccacctggaactcggctatgttgcaatccaacgacctgcgcgtggccatcgcggcccatatgagcaagcagaaacccgaattcgtggattgactgacatgaccccaggctggattaccacaacgctgctggacaacgacaccccgggcggctgggctgttgcccgcagccgcgagggctttttgcacgacaccaatggcccgctattcccgcgtgaatggcttaagcgccaggacctgtcggtgtttgccgagcacggcattggccacctcgacggcgagccggtgtacctgctggagcttaatgcgccggcagaggttcccgggtgcagttggcaaggcctgcgcggcttcatgctgcaaggcgatcacaccctgtacaaggtgctgggctatgccgcgcagatcggcacctgggcgcgagagcatcggttctgcgggagttgcggccaggccatggtccagatgccgcgggaacgggcgatgtactgccaggcctgtgacctgcgcagctacccacggatttcgccgagcatgatcgtgctggtgacccgtggcgatgagattctgctggcacgctcgccacgctttgtgaccggggtctacagcaccttggccggctttgccgaaccgggtgagtcggccgaagactgcctgatccgcgaagtgcgcgaagaggtgcaggtggaggtcaagaacatcgagtacatggggagccagtgctggccgtttccccattcaatgatgctgggctttcatgccgagtacgccggtggcgatatcgtgccccaggtcgacgagatcgaagacgcgcagtggttcaatatccatgagctgccaccgttgccggcgtcacgttcgattgcgcgatacctgatcgacctctacgtggcccgccgcctaggccacgctgaaccagtgctgccaggctaggcgcaccgtcaggccgaggaccacggtgataaacaccgggcgaatgaatttggcgccaccgctgattgcgctgcgggcgccaaagaatgcgccacccatcaccgacacacccatcgccaggccgacaatccaatccaccgagccattgatgataaacaccgtcagcgccgccgcgttgctgacgaagttcatgctgcgcgctacgccgctggcctttaccaggtcgatggggtgcaggagcatggtgctgacggtccagaacgccccggtgccggggccggccacgccgtcgtagaagcccaggccaaaaccctgggtggcttgccacttcttcttgatcggcgcatccacgtccagtggcgcctttggcgtgccgccgaacaacaggtacacgccgcaggcgaagacgatcaccggcagcatcttgttcaaggcctcggcgggcaggtagtgggcaaccactgcgcccgtcagcgcgccgaccaaggtgccgacgatggcgtgcacccattggcgcgggtggaacagcttgcggcggtaaaaggtgaaactggcggtggccgagccgaaggtggagctgagtttgttggtacccagtaccaggtgaggcggcataccggcggtgagcaacgcgggggtggtcagcaagccgccaccgccggcgatggcgtcgatgaaaccggcgataaaggcgacgacggccaggatggccagcgtagtgaggtcaacactgagttcgaagggcatgggcagggcttattgttgggggtgcgctatgcgaaaggctgccatcttacctgccgaatgcacgcataaccaaatgtgggagggggcttgcccccgatggcggtgtgtcagtaaccaatacgctgactgatccaccgctatcgggggcaagccccccccacatttttaccgtgtccgcttggttatttgtgggttccgatccactccagcgccgtacgccagatgcaaatccccaggaaatacgccgacatcagcgaccataagccaaacgtccacgggttagtgttggggtaatccaccaccatcaggaagctgcacaacagccagatcgtggtcaccgcgatattgatcggcatgaagcgcttgacccggaacgggtgcaggaacttcatcggcgtcacggtcagcaatgccaggccgatcacggtcagcaaggtgacccaggcgtcaggctggatgatgtacacgcacagggcgaccacgttccaggcggcggggaagccgacgaagtagttgtccttgcttttcatgttcacgttgcagaagcagaacagcgacgacaccagaatcaccgacaccgtaaacagatgagtaaattccggcaggtcgatgtagcggtagataaacagtgcagggataaatacgtaggtgaggtaatcgatcaccaggtccaggaccgagccatcaaagctgggcagtaccgtgctgacattgagccggcgggccagggagccgtcgacgccatccactaccagcgccaggcccagccacagcaggcatgccttgggggagttttccagcagcgccagggtggccaggaaggccaagaccacacccgtggcggtaaagccgtgggcgccccaggctttgattctggctacatgcagggtcgatatcacgggcggttctccaaaaggtcaaacggggcagccgacaacgtaacgccgtcgagtctggccagggaatgcaggtatcgaccgggaagggggggataaggttcaccaccccggcgtatccgttagggtagcaagggtaggacatttcggcatcaaccctgacggaaaaccagtgccttcaagccactctgcgggtcaatgtcggggaattccggtgggttttccaggcgctgcacaaagcgcaggcccggcgcttcgcgggttacgccgtcgatcaggaagtcttcgccgaacgccggatcgttcatgcacgccagcactgtaccttgtgccgtgagcagatccggcaagcgccgtagcacacgctggtagtccttggtcagcaggaagctgcctttctggaacgacggcgggtcgatgatcaccaggtcataggggccactgtgggtgacctttgcccacgacttgaacaggtcgtggcccaggaaggtgactttgcccaagtcatgcccattcaggcgatggttgtcgcgaccccggctgagcgcgccacgggccatgtccaggttcaccacatggttagcgccgccctcgatggcagccaccgagaagccacaggtataggcgaacaggttgagcacgcgttggcccttggcctgttcacgcacccagttgcgcccgtagcgcatgtcgaggaacagcccgctgttctgttttctacccaggtcgatcaaatagcgcaggccgccttcggtgatggtcagctcgtcaatggcatcgcccaccagccactcggtggtgccttgcggcaggtaacgatgttgcagggccacggtacgtacaccaacgccggcccagtcgatctgcagcagcatctgcctcaaggcttccagttgctcggtttccttgaacaaggccaccagcaccacgccttgcagccaatccactgtcagttgttccaaccccggccagcagcggccacggccatggaacaggcgccgggtttccaccggcgcgtcggccagggtggtgagcaggtgggcgtgcaaggtagcgagtgcttctggggtcatcgtttagcgtcagtcagcgagcggccggcattttaaacacaatcgtggggtttggggggggcgtgggcacaacgtggcttttttggtctgggtcaggatcgccgtgggcttgctgattgacgtagatccaatgtgggagggggcttgctcccgatagcggtggatcagtcagtttatttgttactgacacatcgctatcgggagcaagcccctcccatattggtccctggtgttagttagaacgtggcgatcagggcgggcccgaatgcgtctttcaggaagaccggggcgatataacgctcgtaatgcgcctccgacagcaggaaaaactcccgatctatcgcatcccgcagctccgccaggtggcgctcgcgaaactccggcagcaatgccaatccataggcatccagcttggaaatcactcgcgcaccccgggcaatcagctggtacgcccagcaatacggcgactggtgcggcataaagcgaatcttgcgcgcttccaactgctggcgcaggcgctgcgggtcgaagacttccagcttgctggccattacctgcaccagcaattgttcgaggcgcagccacaccgcctgtttttcctcggcgttgtagccattccactggatcacttcgtggtgataacgcttgcagcctcgacagaccaaatcaccgtagacggtggagcagagtccgacgcaaggggtcttgatggtttgattgggcataaatgtgatctgttgaatcaatcccagctcaacgcgccgccagtttgatactcgatcacgcgggtttcgaagaagtttttctctttcttcaaatccatgatctcgctcatccacgggaacgggttagtcgtgcctgggtactcttctttcaagccaatctgcgacagacgacggttggcaatgaacttgaggtagtcttccatcatcgcagcattcatgcccaacacaccgcgcggcatggtgtcgcgcgcgtattcaatctccagctgcgtgccctgcagaatcatctgggtcgcttcttccttcatctcggcatcccacaagtgcgggttttcgattttgatctgattgatcacatcgataccgaagttcaggtgcatcgactcgtcgcgcaggatgtactggaactgctcggccacgccggtcattttgttgcggcggcccatggacaaaatctgggtgaaaccgcagtagaagaagatgccttccagcacgcagtagtaggcgaccaggttgcgcagcagttccttgtcggtgtcgacggtgccggtttcgaacttcggatcggagatcgagcgggtgtacttcaagccccaggccgctttcttagcgaccgatggaatctcgtggtacatgttgaagatctcgccttcatccatggccagggattcgatgcagtactggtaggcgtgggtgtggatcgcttcttcgaaggcttggcgcaggatgtactggcggcattccgggttggtgatcaggcggtacacggccagcaccaggttgttggcgaccaacgagtcggcggtggagaagaagccgaggttgcgcatgacgatgcggcgttcgtcgtcggtcaggccttcggggtttttccacagggcgatgtcggcggtcatgttgacctcttgcggcatccaatggttggcgcagccgtcgaggtatttctgccaggcccagtcgtacttgaagggtacgagctggttgaggtcggcgcggcagttgatcatgcgcttttcgtcgacggcgacgcgggcagcggagccttccagctcggcgaggccttcggcgacgtcgagtttgtccagggcagccttggcgcgcacgatggcggccgaatcactggcagtgacggcgcgggcttcgatggcggcggcggcgccggcaccgtcgaggcggtccatgttggcttcgctcgcatggccggcgttggcgcccttgatcaccgctgcaccggtgtcttcgttgtcgacttcatcccaactcagcattgaaatactccttcctgatctgttccgacggtgtgtaaaaccgtgcaaaaaaatgtgcggtttgcaggctactaggcattgaaatactgcgcgtagtgtggtcggtaaataccgatactgcacactatgtagtggtctgttctgtttgtgggcacactatatggggtgtaacaaggttggtcaacgcacaagatgtgcgttgataggtcgctgttcactaccggatcggcgatccccagcatgcggggctggcatgtcctatatatttataaggaatagataaatagttatttattccttttaatattcctgcgtgcagcgcattttgagggcctgcgcattcgtgcggattgacccaacagccaaaaggaaagccgacatgaccattaaagcgatcaacgtgcgcaaccagttcaagggcgtgatcaaggagatcctgctgggggaagtggtgtcggaaatcgacgtgcagaccgcgtccgggattgtgacgtccgtcattaccacgcgctctgtgcgtgacttggaattgaaagtaggcagtgaagtgatcgcttttgtgaagtccaccgaagtgtccatcgccaagttgtaggcgttgccgtaggcggacagcgcaggtagggggcgtagcgctgctcgtcaatcaacccgatcgaaaatctccctgacttgatccacgggaaatacgcccttgccgctgccttcgatcagctcaaacgtgccatcggcattgatggtgatgcccagggaactggcaagtgtcactgagacgcccgctcgcgcttggagcaagtctctgagcggttgcccgccctggaacgattgcccgatagtggtggccatgccttgcagagagtctgaactgatgcctcccaccaggataacgcgcccgccattgttcaaggatgcttgcaattggtccagcagtgcctgggtatcaccccgcaggcccagttccaggttactgccggtgacgtgcatcagcgtgcgggtctggtagcgagcaccgtcccagtcggtaagcacggcaatggccgagcagtcggtgaggctgcgggtggaaagcgcttcgttgccggtgtccaaggtcgtcgattcacccatggggacatgcacggtattggtcggcttgagcgggaagcgggcaatcactggcgtgacggaatccacctgcgagccgtagggctgcttgggctggttgataagcgtgtccagccagtccgggtccaaggggctcatgttgcgcttgataccttctcggattttccagccggccttgtcccatttggccatggttgccttcaattgagccatgtagtcggaggccgggcaggcgatatcagcccatggatcgaccacccaggcgttggcccaggccggttctgaaaagtccacggtgggcttcacaggacctgtcgggcctccgacgacggtgaaggcgtgcgcattgcctgcatgccattcggcggccctggtgccactcgtgttgagaatttccctggccaggatcgccatttcgccgcaattgcctgcgccggtcttcatgatcaggtcgcctgcatggggggccttgagatcagtagtgcgccgcaaccagcccaaggtaaaggttgccgcatcagccctggccacatcagcagctgagcgtacctggttgccaggccccaatccggtggctttgagggcttgattgacggtgtccttggcgtgctcggcgtagaactggttttgacgtttcgctggccattgcacaaagccagggggcgtttgcaagggggcgacacggtgggggcgcaacgccacatccggcttcaggatggcgttggcctgctgcaattggtaagccacttcccgttgctgctcggggctcatgcccttgcattgctgtttaagctcattaatgtcagcttcgcgaaaacctgcgcgcttcagctgcttataaaccttcttgagggggggcagggcaatgaagtccgcatccacgagctgcacagggtggtgagcgctcatgaactggcggtaaccctgggcgaggcccatttccataggcccgcactttttgaaggtgatatcgccggtttgtgcgctgcccagcggtgcgtaataaaactcagcggtgtcagcttccaccaccaggtatcgctggctgccactggtgaccaccacacccctgacttggcgttggtcatcgctggccttgctgatgctgttgagcttgactacccgcgtgtcttcagcgagggcgcccgcgccatggccggcgtaaaaaccgaaacccgggtctacgatgatctggccctgtacctgtgacctgtaggtgatgcgttcgccattggcgactggcaccaacttggcgccggtctcgccttcaacccattcgtgcaggcgtctttcatagaccaccgtgcgtacacgcttgaacagcccgcccttggacggaaacaaccgcacgtgttccaaggcttgcagcgcacgttcggcgtcggccaggtctgcaatgactttggcgaagcattcatcattggcgccgcggcgcacccgcccacccagcgcaggcactgggcaaaacgcttcgaagccttccagcggggcggtgtgtgcagctgactccaggtcggtaagctcgcccggcttgctgtaaaggtagcgatagacacggttgcggtccaccaggtcgtagccgttggtccgtggcagggtataggcagtggcgcgcagcggatgctcgatgaccagcgcctgtttgccatcggcgaacaggtcctggctgacggtaatcgtggtggggcgctcaaaggcaggctccttcgcggtgccgcccccgatggagaacagctcattgagcgctccatcgagtgccgcagcgctaccgttttttcgctcagcttgagtatcgcctgtgatcgatttctctacgcctagttcggtttctacaaaaccggtagcggcagctataccgacgacgatcggttcgccaatcaccgcgaacttggccgccaggcctgcggccaccgtcaaatcgttaagccaggtatcgcgggtgacctcgctgttggacttgatcatgacatcggcatcgcgggacatgcgtttttgcgtggcgtctttgatcacgctgaatacgtcgccctgaatgcgtacgttggcactgtcgatgacggtgccttcgatgctgtcccagtagccgctggccaagtaacgcagggcagtgtcgacgcctttgttcgattggtggtcgccggtgatgaaggctttgacatcgctccagaacccgacctcattgtcttgccggtccctgagggcgaagtggccttccagcgccttgcgcttatcggcgtcccgaccttgtgcggctacccattgatccatcgcggtcagggagtcaaaacgcacgaacgcgggttgatgcccggggatatagaggatctgcacaccgtcacgacggtcacgcagttgccgggcagggccgtcatcgatggcggtaaagcgcaggatatcgttggcgggtaacccgttgatatccaataggtgggtcaataccacgcctttgaccggcgcttgcgcacgcagttgctcgacggtcagggcttggttgtcagccaacggcaggttggaggccgcgcccatgaccaggcggtagtcatcacgggtgaaacgctgttcggctggcatctgcgcgcgctcggccggcgaggcacgttcgtaggccttgagttgttggcgggcctggtagacaaactcgcctttcaagagggtgcggtagtcatcgccatgatcgcgccagaaactctcgagcttttgggtcatgtgcgtttgaaagtcgcttttccagctttcatgcatcagttgcgaaggcgtcagcgcaaactggttatgggcgccatagccgccttttgtgctttgcccactgcctgcctggtacaagccggcttgctggtcaagcacgcccgggagcgagtcgtgttcgttgaagttgcttaacagtgcgtccggcagcgcctgggaaaccgtcggctcttccctgacgtgctcccagccggtgacggtgttggcgctttgtgcttgctggaaacgattcaagaaaatagtgtcggcatctatcttgcgaccggtcaacgtgaacaccatgtcctcggcccattgcttggcctcgtcgcgcacgttgggcagcgcagcgtgtgtggtttgcagcagttgcttgtagtcggctttctgacgggccatcgaggggcggcggctattcgtcacctggggaggcgccggctcgaaaatcgagtaggacggcatcgccgcgggtttttcgccggtgatgggtttgaaatcccagaccggcgagggctgggtgtggggcggcaggatcatgggcggacggctccggggtcttcaacagcacaatgggcggctgctccacatgtgtgttgaaacgccccggtggggttccggccggcgtcagcgcttttgtaagctgatttccatgcgccgcacaccttcctcgagcatcgcccgcgggcagccgaaattcaggcgcacgaattgctggctgtcatcgccaaactcgattcccgcactcaagccgaccttggcctgttccaggaaaaactgctgcgggtcgtccaggcccagggcactgcaatcgagccacgccaggaaggtgccttggggcgcgtgcatcaccacgccgggcaggcgggtctttaccgcatcgagcaggtagtcgcggttggcctgcaggtactgcaccagtgcagcgagccagtcgccgcattggctgtaggcggcgcgggtggcttccaggcccagagggctgacgctgtcgaccatgccgcagcgcgcctggttgaagcgctcgcgcacctcggcgttctgcaccacggcaaagcaagtcttcaagccggcgacgttataggccttgctcgccgacatcagggtgatggtgcgttgggcgatctcggggctgaggctggcggtgggaatgtggcggcggccgtcgaagcacagttcggcgtggatttcgtcactgatgatcagtgcgccgtgtttcaggcaagcgttggccaccgccagcagttcttcgcgggggaagaccttgccgatggggttgtgcgggttgctcagcagcagtgcgccggcaccgctcaatgcctcgcgcatggcgggcattggcgtgatgtattcgccattgatcagtccaaatggcacttcgatgcgcggcaggccccaatggccgggggccaggcgaatcggccgatagttgggggtttgcaacaccaccgcctggccgggttggacaaaggcatgcagggccatgttgaaaccaggttcgacgccgggcaggaacagcagctcttcaggttgcacgcgccaggcgtacttggcccacaggtcggcgacgatagcgtcgcgcacgtcgccgccggccatgctgtagccgaggatctgctggtcgagtcgtgcatgcagggcttgcaatacggcgggtggcgcggcgatgtccatgtcggcgatccacatcggcagaacgtcttgcgagtaacggctccacttggtactgccggtgccgaggcgcgagtggagggtgtcgaaatcaaagctcatggaaggctcatgtcagggcggaggcgaaagaatggcgctgattctagcgccattcaccttataggccagcgctgattgccgcggacaactgccggtgtgcctgctccagggcacggttcacggctgcttcgccgcggaccatggcgcccaggtagatgaactccacggagtgaatgcccacggtggccaggatggcggtcaggtacggcgtaagaaagtcaggctcatgccccttgcgcgcattgccggaactcaccagcacgaaggtgcgccgatcccccagcaggccgactttggcgaactgttcattgagcgtaaagctgcggtgtatacgcaccacgtggtcgatccatgccttcagcgccgccggtacggtgaaattgtgcactggggtacagaggatcaacagctcgcaggcttgcagttcgacgatcaactgttcggacagcgccatcgcatcggcattcaggccgcctggtgtcgtcagtgcagtggcgtactcacgggtcagcgctggcaacgcctggctaccgtagtcgcgttcgctgacctgggcgtcgggcaccaggtcagtgagcagggcgcgggccagcttgaacgtctgcgcggctttgccatgggggctgaaactgagtaacagggcgcgggtcattggctgaggtcctgggaaaagtgcatgcctagcggcagcaagccctggcggaaatagaaacgctgggccagggccatatgcatgccggtgtccagcaccaggtaacgatagcccaaggcgcgggctgccttgcgtacctgctcaagcagctgttcacccaggcgcctgcgttgcagggaggcgtccacgaccaggtcatcgacatagataaagcggccgtagagggtattttccgtgaggcggtaaccggccaggccaatcacccgtccgtgctcgcgggcggccagcaagtggtagccgttttcccgttggcgctggacctgcccggcgaaggcgctggcgtcggtcaggtgcggacgcaattgtcgcatgatgtcgaaactgatcatgcagtcggccacggtttccatcagctggaactcgacgtgctcattcatggttgaggttctccaggtgcgccttgatcgctgccggaaccttgcgaaagctgatggcgacgcggttcagcgcgttcatcaaggaaattgccagggtcaggtcggcgacttccttgtcactgaatacagccgcgacggcggcgtagtcggcatccgggacctggctttgcgcgacctgcgtgactacctcggcccaggccagcgccgcgctttcacggcgtgtgaacagcactggcgcttcgtgccaggtggccagcaacatgatcttttccaggctcaccccctgtttgagcagatcgcgggaatgggagtccaggcaataggcgcagccattgagctgcgagacccgcaagtacacgaggtcgatcagttctttctccaggccgcagcggtggatgtagctgtgcacggagcccagcgctttgtagccatcgggggcggccagggcgtaatcgagacggtgtttcatggtgcgatccttgtaggtttgggggatgcgccattttcgcggccgcagttgcccgtcgacaggggcatgattggacaagtgggttgggacatgatcagactcccatccgtcttgccaacgagctgaatacgatgccgtcactgcccaaataccaggaaatctatcggcgctttcgcctggctatcgaccagggccaactgcgccctggcgagcgtgtcccttcggttcgcgcactggcccaggaactcaaggtggcgcggggtaccgttgaggcggcgtatcagttgctggtcagcgaaggttttttccaggcccgtgggcaggccggtacggtgattgccgcaacgctggcaccggtcaagttaaagccattgcccaggcagccatcgctggtcagcgggccgcgcccactgcaaatgggcttgccagcgctggatgccttcccgcgtaaattgtgggcacgcctggtcacccggcaagtgcggcgcatcgatgccgacagcctggcgatgggcgacgaacagggagcccaggcattgcgggtggcgattgccagctacctggcgttgtaccgcggcgtggaatgcacgcccagccaagtgtttgtgtgtgccggctacgccgggtgcctgacactgctgtgcgatgcattgggcatggcgggacaggcttgctggttcgaagacccgggctacctgcatgcacgacaattgttgcgccatcagggggtgacgctggtgccggtgcctgtggatcacgatgggctggatgtgcagcagggcatccagcgcggcgagcaggcgcgactggcgatcgtcacaccggcgcaccagagcccgctgggggtggctctgagcccgacgcggcgacgggccttgctggggtgggctcgggcgcaggccagttgggtggtcgaggatgattatgacagcgagtttcgctaccagggccagcccttggctgcgctaaagagcaaggacgccgatgaccgggtgatctatgccggcagcttcagcaagatgctgtttcccggtttgcgcttgggttacctggtggtgccggcggcattgatcgacacatttcagcacagtgccaaggtgttgcagcagcgcagtgcacagctactgcaactgacggcggcggactttctggagcaggggcacttcactcggcatttgaagaagatgcgcggcttgtatgcgcagcgcagggccatgctggtgcaagcgctgcaggcgcattgtgcagcgtttctgcaggtggatgagcaggccggcgggatcaatttgcttgcgcgattgcgcgtgcaggtgccggatgtgcaggttgcagaggccgccaacatggccggcctgggcgttcaacccttgtccggctggaccctcgaagccgggggcgagcagggattgctgatggggttcaccaatgtggcaacgccagggcaggccacggacctggccctgaagctgttggagatcttgcaggcgtgtgcggctcaagcgctcaacggttcaccagtttcgctggcagcgcaatcaccagcaaactgctgagcatcaggcagccggcaaaaaaccacagcgcgcccgcactgctgccggttaggtcgatcgccacgcccatcagcgagttgctcaccaggcctgcgatattggcaaccgaacaggccagggcaaacccggtggccgcggcagtgcctttgagaaaggtcgccggcaggctgaaaaacaccggcacggcaccgatgatggcggctgaggcaatcgcgaacaacgccacggtggcagctacgttatgggtgaagaaagtgctggtggccatcgccgctgcgccgatgaaaaacggcacgatgatgtgccagcggcgttcgcggtgcttgtcggaactggcgccgatcagcagcatgccgagcagtgcggccacgctgggcagcgcggtgagcatgccgatatggaaggtgtcggtgaccccggcattgcgaatgaaggtgggcatccagaagcccatggcataggcactgagcagtatcgagaagtcgataccgccgagcatccacaccttgaggttgaagaaaccgtcacggaagctgtgcttgctgccgacgccatcggcgtcgtctttgcgcagctcgttttccagcagggccttttcctcatccgacagccatttggcttgctggtagctgttgggcagcgcccagaacgtcagcaccccaagcaacacgctgggtaccgcttcgatcaggaacagccattgccacccgcgcagcccggccatctggtcgaagtggcccatgatccagccagacagcggaccgccgatcacgctggacagcggcaggccgatcatgaacagcgcgatgatgcgcccacgcctgtgagtgggaaaccaggtggtcaggtaatacagcacccccggcaggaaaccggcttcggcggcaccgagcaaaaaacgcaggatgtagaactgggtggtggaggtgaccagcatggtgcaggccgagagcaagccccaggtgatcatgatgcgcgcgatcccgatcttcgcgccgacccgctccagcaccaggttgctgggcacttcaaagatgatgtagccgacgaaaaacaagccagcgccaaggccgaaggcggtttcgctgaagtgcaactggtcgagcatctgcagcttggcgaagccgatgttgatgcggtccaggtaggcagccagataacagaaacacaggaacgggatcagcttccaggtgatcttgtggtagagcgtggtgacggggtcggcgactgtagtcgcgggcacagcattcgcaatgggcatggggtgtctcctggcggtgacttatggtttttatacagccgcttttgttccagcacttcggcgtgctgttaaagcgacgtccaaaggcagtgtcagaagactgaaagctgcgccgaggttatcaacctcggcggctcacagttttgtgcaggaccgcgctctatggcgcggttccgggtgaaaccttattgctccttgaattggcgcatcgcgtcttgcttgctcaccacatcgccgtacttgctgtcgatatcgaacaggttggcttcgtggggcgccggatggcggtcgccgacgcattcacgcacgacaatggtgcggaacccgtgctgcaccgcgtccaccgccgttgcgcggatgcagccgctggtggagcagccggccagcaccacggtatcgataccttgggcgtgcagcatcggggccaggctgctgccgaaaaatgcgctggcgtactgtttgctgatcaccacttcatcaggctggggcaatacctcggtgcagaacgccgccagtgggttgccttcgatcatgtctttcatcaccggggccttttttacccagataccgccgtcggcgaaatggccgggatggtagcggatattagtgtgcaccaccgcaatcccgtatcggcgtgcgcaggccagcagttcgacgctttcagccacggcgctgaccacgccgggcgcgaacagtggcgcgccttcgcgggtgtagccctgcatgaagtcgatcatcagtagcgcggctttgttgccgaagccgatgcggttgccccacacgccctgatagttggcgtcggcggattgttcactcatttcaatttcctcagtaggcgccggaaagcagggctccggccccgggaacgatgggttccaggtccagggccttgagcatggcgtaggtggtggcgatggcggcggtgagcaccggtttgccggtttgcgcctcgaccttggccaccaccggcagcgactgcatttgcacgcaggccgacagcacgatcacgtcgacgccttccaggttcatgccggcaacgatggccggcaggttggccgggtcgtggcgggccacttcgaggttgtccgggatctccagggcgcgccagtcgacgacttcaaagccttctgcgcggatgtagttcaccaccagctcggtcagcggtttcatatagggcgcaacaatcgcgatacgcttggcgcccatcaccttcaagccttcaatcaaggcgcctgcgctggtgatcaccggggcattggcgtcgttgtcagccgtagcctggcgcaggcgctgttcggagttgcggtggtagcccaggcccatggccatgatcgccaccaggcaggcgtaccccagcacgtcgaccttggcgtctgacaattcgatggcgcaacggtcggactcgccatccatcgccgccagttcttccttgcgcacttgcttcatgcgcatgcggctggagtggaaggtaaaacgttcaggacggatcgcctggcgcgcgttgagcatggccgggatctcggtttccatggtggtgttggaactgggcacgatctggccgatgcggtagggcttgagcatgggggtgtccttattgttgggtgaggaagtcgccaagggcatcgaaaaagccctcaaggtcgtcccacgggatcatgtgcccggcattcggcacgcgcgcgacctggatactcggttgcagggcctggatttcggcgatgtcttgatcgaggatcaccccgccgcgcccggccaccatcagcagggcagggggcttgaggtggggcaggtgctggtggaagtccaccgtgtggaagtcattgaaggcacgcacgatggccggttcgtagcaggtgtgcagccactccgcgcgcagttgcagctgctcatcggtccaggtggcgcagaaggcgcgcatcgcctgggcatccatgccaatcagtgactggcggatcgagtcgacataccagggcagtttgctcgggtattcccgccggccaggaccggacatcggcgggtcgatcaacaccatgcggttgacgccttgcgggtgcttgatcgcactgtgcacggcaaagcgcgcccccatggaatggccaaccaggtggtagctgtccaggcccagtgcgtcggcaaatgcgccaatgtcctcggcgcaggtgtcggcgctgtaatccagttccggcccggtggacgacagcccgcgcccgcgtacatccaacacgtaggtatcgaactgctcacccaggcgctcggcgacgaagccccaggtaatcgccgggctggtgatgcccgggatcaggatcagcgccgggcctgtgccgccgtagcgcagatagtgctggcgaatgccattggcctgcacgttgccgccatggagaaaggtactcatgcggccacccccgacttcagctcctgggcatacaggtcgtagccgtacacccaggccgggtcttcctgggtgcgtagccaggtgttggcattggacaccgcttgtacccgggacgcgcgttccttgcggttggcttcatacagttcgaaggcgttgcggtagtcgctgatcccggtttcctgcaggcagcgggtgagcatggcggcatcttcgatggccatgccggcgccctgggccatgtgtggcttcatcgggtggcaggcgtcgccgagcaagaccaggcgaccgcgactccacagcggcagcgggttgcggttgcgcagcggccacttggtcacgctgtcggtggattcgatcagcgcctgcacggtggggtggtagcccttgaaggcttcgaacatttcctcgcggctgctgtcgacgaaggcgccctggaagtcccattcggcatggggtacgccggtcacgtagtagtactcgtcgcgcttgcctgtggtgtagtagaccatcatgtggcgatcctcggtccaccacttgatgcagtcttcgaacttgaggtcgtacttggccagttgctcgcctcggatcaatgcgcggtgcgccacccagccgctgtacaagggtttctccacccccagcagttcttcgcgaatcttcgaattgatgccgtcggcgccgattacgatgtcggcataggtcacggtgccgtcggcgaaggtcaggcgcacctgggtatcggtttcttcgagggtttccaggcgcttgttgaagtgcagggtgccgggctgcagcgtggacatctgcaacgcatgcaggtcgccacggtgcacggtgatgtaagaggcgccatagccggtgagcgggatacgcgagaggtaatcaccactttcgccgcagcggctgaaccagtgctcagggtgcgaccccatcaggtccagctggttctcgatgcccatgcggcggaagattttcatgatgttgggccccatgtggatccccgcgcccaagcgggagaactccggcgcctgttcgtagacatctacgctgaagccggcttgctgcaacagggtggccgcagcggcaccgcccaggccggcgccgactatggcgattttttgtgtgcttcccatggggcgtgatcctctctttttgaattcaggcggcgtctgtccgcaaggtttttaaagtgtatacgctcattttttaaaatgggaagcctgtgtgaggaaatttattttttggtatttataggctggtgtaaccagctgtggctaatgaatattgaatatgtgtggattggtaacgtttttatctggcacttgcagtccgtctgcaaatcaggtctcatcattcttaaatggtgtatacgctataaaaatgcactaagttgaagcgcgctgcccgaacagggtgcagcccctcaggagacaggaaaatgccggtaagcgactgtgaactgacccagatgtttgaacacgtgttgaagctgtccaaggtcgacccgacccagagcgtcgcggtgctcaagagccattactccgacccgcgtactgtgcgtgccgccatggatgcggcgcagcgcctgggggccaaggtgtatgcggtggaattgccgtcgttcaaccatccccgggcgatgggcaacgacatgaccgcctactgcggcgacaccgcgctcactggcaatattgccgcccagcgtgccctggaggcggcggacttgatcgtcgacaccatgatgctgctgcactcgccggagcaggagcagatcctcaagaccggcacgcgcatcctgcttgccgtcgagccgccggaagtgctggcacgcatgctgccgagcgaagaggacaaggtgcgtgtactggccgccgaacagctgctgaagaaggcgcgctcgatccacgtcaagtcccgcgccggcagcgacttccgcgctgctttgggccaatacccgtcggtgaccgagtacggcttcgccgatgaaccggggcgctgggaccactggcccagcggcttcctgttctcatggcccaatgaagaaaccgccgagggcgtgctggtgctggacatcggcgacatcctgttgccgttcaagacctacacccgtgaaaagatcaccctggaaatcgaaaagggctttattacgcggattcacggtgggttcgaggcgcagtacctgagcgactacatgaagtacttcgacgaccccgaggtgtacggcatctcccatattggctggggcctgcaaccacgggcgcaatggacggccatgggcttgcacgacaagaacgacggcatgtgcatggatgcgcgggcgttctatggcaacttcctgttctccaccgggccgaataccgaggtgggcggcacgcgcaagacgccgtgccatatggatatcccgctgcgcaactgtgatgtatatctggacgatgaggcggtggtgctgggtggcgatgtggtcgcgccagcgcgatcgctggcacgctgagtatccgtgtgggagccgatagatatagagatccaagtgtgggagggggcttgctcccgatgagggcgtgtcagtgtgtgcatcaatacctgacccaccgccatcgggagctagccccctcccacaggttgagcatgattcttcaagggcatcttgagtccgttcactaaccccgccatcatgccacccatccaaaccacccaccgagcccgccgtgcctgattcctacgttttttctgaacaagtcggccacctgctgcgcaaggcctaccagcgccacttggcgatattccagcagaatgtcggcgactcccagctcaccgccgtgcagttcgtgaccttgtgtgcgttgcgcgatcagggtgcaagctccctcactgaactggtcaaggccaccgccgtggaccaggcgaccatccgcggtatcgtcgaacgtctcaaggccaaggcgctgattaccctggaaccggaccctgcagacaagcgcaaggtaatagtcgacttgtctgcctcaggcgccgaactggtcgcgcaaaccgcaccgcgtgcggcccagatcagcgaattgaccatgagcaatctcaaccccgccgagcgtgtggcggtcctgtttctgctgcgcaagatgattgacgatccccaggaataacctgcgctggcatcgtttttgctctgtgttgatgtagtagccacttcaccagtcgagtgtgtcgcgaggccccaggtccgcgacattttttttgactgtttgatgtagtaggcacttcatcaaccggcacaggcgaagcgaatgaccagccaacccatcacggtaacgcttgaggtcaacggccagacaagcgaagtcagcgccatggcggatacaccgctgttactggtactgcgcaacgacctgcaactcaatggccccaagtacggctgtggcctgggagagtgcggtgcctgcaccgtgatcattgatggcgtggccgcacgttcctgcgtgttcccgctgtcgggtgcatcagggcgcaggatcgtcacccttgaaggcctgggtacgcgccatgcgccgcacccggtgcagcaggcgttcatcgacgagcaggccgcgcaatgcggctactgcctcaacggcatgatcatgaccgccaaggccctgctcgaccgcaaccccaagcccagtgaaacccaggtacgcaacgagctgtcgggcaacctttgccgctgcggcactcatatcgagatcctgcgcgcggtattgcgtgcggcacgccttatgaacgtggatggatgatcatgaccgaaacgaccctttcccgtgagcagtggctggccaaggccggtgtattgttgattgtcgatgatgtattgccgccttcggggccggtggccaagggcggcacgcccacggtgaaacccaaggagctggggctgtttatcgccgtgaacgatgatggcctggtgtatgcgttcaatggccatgtggacctgggtaccggcgtgcgtacggcattggcgcagatcgtcgccgaagagctggacctgggcatggaccaggtgaggatggtgctgggcgataccgcgcgtgcgccgaaccagggcgcgaccattgccagtgcgaccttgcagatttccgctgtgcccctgcgcaacgcagcggcagaggcgcgacgctttttgctggcgcgggcggcaggacgctggggcgtcagcaccgccagcctcaaagtcgaggccggtgttatccacgccgccgatgggcgcaccaccacctattccgagttggtcagcggccagcatgaccaagtgcgcatcagcggcaacgcgccgctcaaggccaccgcggactaccgcctggtcggccaggatacggcccgcgtggacatccccggcaaagccaccggcgagctgacctacgtgcacgacatgcgcgtgccgggcatgctccatggccgggtggtgcgcccgccgtatgcggggctcgactgtggggagtttgtcggcaatagcctgttgagtgtggacgaagcctccatcgcccatatccccggcatcgtcgcggtggtggtgatccgggattttgtcggcgtagtagcgttgcgcgaagaacaggcgatcaaggctgccgccgagctgcaggtgcaatggaaaccgtgggctcacgcggcgccggatatgcgcgacgtggcgcaggccattcgcgctaaccagcgcgtgcgccgcaccgtgcttgatcagggcgaggtcgacgccgccctggccactgccagccagcgtatgccgcgcacttacctgtggccctaccagatgcacgcctccatcggcccatcctgcgcggtggcggattatcaggacaacggcagccgcgtatggtccggcagccagaacccgcacctgctgcgtgccgacctggcctggctgctggaatgcgatgaagccctgatcgaggtgatccgcatggaagcctccggctgttacgggcgcaactgtgccgacgatgtgtgcgccgacgccttgttgttgtcccgggcggtgggcaagccagtgcgcgtgcaattgacccgtgaacaggaacatctatgggagcccaagggcaccgcgcaattgatggaggtggacggtggcttgaacgccgatggcagcatcgccgcctatgacttcgaaaccagctacccgtccaacggcgcgccgaccctggcactgctgctgaccggccgcgtcgaaccggtggcggcgatgttcgaaatgggcgaccgcacctcgatcccgccttatgacatcgacaatatgcgcgtaaccatcaatgacatggcgcctatcgtgcgggcctcgtggatgcgtggcgtgtcggctttgcccaacacctttgcccacgaatcctatatcgatgaactggccttcgccgccggcgtcgatccggtggaataccgcctgcgttacctcaaggacccgcgcgccatcgacttggtgaaatctaccgccgaacgcgccgcctggtccccacgcaccgcgccgatgcaaaccgccagcgatgaccacctgttacgtggccgcggctttgcctatgcgcgctacatccacagtaagtttcccggcttcggcgcggcctgggccgcatgggtagcggacgtggccatcgataaacacaccggcgatgtatcggtgacgcgggtggtgatcggccatgacgcagggatgatgatcaacccggcgggagttgagcatcagattcacggcaatgtgatccagtccaccagccgtgtgttgaaggagcgggtgaccttcgaggaatccacagtggtgagcaaggagtggggcggttacccgatcctgaccttccccgaggtgccgaagatcgatgtgctgatgatgccgcgccaggaccagccgcccatgggcgccggtgaatcggcgtcggtacccagtgcggcggcgattgccaatgcgatctatgacgccaccggtattcgttttcgcgagttgccgatcaccccggagcgagtactggcggcattgaatgccggcaccttggctgagccggccaagtcgccacaaaaacgccgcaaatggtggttcggcgcgctgttcgcgactctcggagcactgctggccacggcttggccgttgcacagcgaaatcgcgcctatcgcaccgccaagccccggcacctggtccaaagccaccctggagcgcgggcgcctgcttgcggcggtcggcgactgcgcggtgtgccatacggcgccgggcggagcgcccaatgccggcggcctggcaatgcagacgccgttcggcaccttgtacagcagcaacatcaccccggatgtgaacaccggcattggcgcctggtcgtacccggcattcgaacgggcaatgcgtgacggcatcgggcgcgacgggcgtaacctgtatccggcgtttccctatacggcgtttcgcaatatcaacgaggcggacatgcaggcgctgtatgcctacctgatgtcccaggcgccggtcagccacgcaccaacgccgaacgcgatgaagtttccgttcaatttcagacccttgatggcggggtggaatgcactgaacctgaggcgcggcgaaatcaccccgcagcctgagcgcagtgaacaatggaatcgcggcaattatctggtcaatggcctgggacactgcgccgcgtgtcattcgccgcgcaacctgatgggggcgcaaaagggcggcaaggcattcctcgccggcggtgtggtagatggttgggaagccccggcgctgacggggttgtccaaggccccgacaccatggaccgaagaccagctgtttacctatttgagcactggctattccgacgcccatggtgtggcggcgggcccgatggggccagtggtgagcgaattgtcgaagctgccgaaggcggatattcgtgcaatggcggtgtacctggcttcgctcagtcacgaagcagcagcgcaggcacaggtcgcagcagcggctgtaccgaatccgaacgggcgacgcgtcttcgaaggttcatgcaaagcctgccatgccgatgggctggggccgaaactgtttggggtcagcccgtcattggcgaccaacaccaatgtgttcagcgaccagccggataatttgatcaaggtgattttgcaaggcatcctccagccggcgacccgcgacctggggtatatgccggggttcaaggacagcttgtcgaatacccaggtggcggatctggtggcctacttgcgcgggcgatttgcgccgaacgcgccacagtggcaagggctggaacagaaggtcgcccacttgcgtgccaaccccggcagccattgattgtgcgagggggcggtggcgcagcgattcgacttgccccccgatggcagtagttcagttaataaaaccctcggctgacacactgtcaggcatgacgccgcgcagcaccaggtcggtgataaatgccagccaatcctgctgttggcctttgttcgacaggtcttcacccaggaacgaactgagggtatggcggttggagttgtagaagtagcacagcgaagcaatcatcaagtacacatgcttgaggtcgatgtcctggcgaaacacgccctgggcctggccggcctcgatgatcgggcgcagcacgccgaccgcctcaccggacaaccggcgcatttcgctggactgccgggcatgcttgccctgatgcaggttctcgatactcaggatcgccacgaattcgggatgcttgacgtaatagttccagataaacgccaccagctcgcgcagggcctgggccggtgccgcaaggtccagcttgagcttgctctcggcctggttgaactgctcgtagatatgctccagcacgcaggtgaacagttgttccttgctgccgaagtagtaatagagcatgcggtcgttggagtctgcggccttggaaatgctgtcgacgcgcccgccggaatagccgtcgcgggtgaacaccttgaccgccgcctgcaggatgcgcgcccgcgtctggtcggcctgttgggcgcggataccactcttcttgatcgccatctatagggccttgctagacactcagggcgcgaaatatagcatgggctttttcgggcccgttctaccaccgacaggttctgtaataaaaacgccattgcgctggggaataaatccgcgaggggctattttggtgcatctcaataaccagagtagccatggatgaaatacctacctttgagccgcaccttgattgccacggtgctggtgttgacgctcagcggcgtgcaagccgcgtcacaggccccggtcgccggtgaaaatggcatggtggtgacggcccagcatctggccacgcatgttggcgtggatgtactcaaggccgggggcaacgcggtggacgcggcagtggccgtaggctacgcgctggccgtagtgtacccggcggcgggcaatctcggcggcggcggtttcatgactgtgcaactggccgacgggcgcaagaccttcctcgacttccgcgaaaaagccccgctggcggcgactgccgacatgtacctggacaaggccggcaacgtggtcgagggcctgagtgccaaaggccatctggcggttggcgtaccgggcaccgtttccggcatggaactggccctgagcaaatacggcacgctcaagcgtgaccaggtgatagcccctgcgatcaagttggcggaaaacggctttgaactggagcagggcgatatcgacctgttgcataccgccaccggcgagttcgaaaaagaccaggatttgcgcgggatcttcctgcacaacggccaaccgctgcaggtgggccagaaactggtgcagaaagacctggccaagaccctcagggaaatctccgccaagggcaccgacgggttctataaaggttgggtggccaaggccctggtggactccagccaggccggcaaaggcatcattacccaggccgacctcgacaagtacaagacccgcgagctggcgcccatcgagtgcgattaccgtggctaccacgtggtgtcggcaccgccacccagctcgggcggcgtggtgatctgccagatcatgaacattctcgaaggctacccgatggccgatctgggctatcactcggcccaaggcctgcactaccagatcgaagcgatgcgccatgcctatgtggaccgcaacagctacctgggcgacccggatttcgtgaagaacccgatcgaacacctgctcgacaagaactacgcggcgaaactgcgtgacgccatcgagccgcacaaggccggggattcccaggcgatcaagccgggggtgtcgccacatgaaggcaataacaccacccactattccattgtcgacaagtggggcaacgcggtttcggtgacctacaccctcaacgactggttcggtgccggcgtcatggcgagcaagaccggggtgatcctcaacgatgaaatggacgacttcaccgtcaaggtcggcgtgccgaacatgtacgggctggtccagggtgaggccaacgccatcgcgccgggcaaggcgccgctgtcgtcgatgagcccgaccattgtcaccaaggatggcaaggcggtgatggtggtcggtacgccggggggtagccgcatcattaccgctaccttgctgaccatcctgaatgtcatcgactacaagatgaacatccaggaagccgtggatgcaccgcgctttcaccagcaatggatgcctgacaccaccaacctggagaccttcgccgtcagcccggacacccagaaaatcctcgaaagctggggccacaagtttgccggcccccaggatgccaatcacctggcggcgatcctggtgggggcgccgtccctggacggcaagccggtgggcaacaaccgcttctatggggcgaacgacccacgacgtaatacgggcttgtccttggggtattaaaggaacatccgggtcccttccaggctctaccccaagagccctggaagaggatccaagccgatgaaagcgctgaaaatcgccaccttcaacatcaacggtatccgcgcgcgcctgcctaacctgttgcactggctgcagcgcgagcaaccggacatcgtctgcctgcaggaactcaaggcgccgcaaagcctgttcccctatgccgagtttgaaaccgccggctacggcgcgatctgcctgggccaggcgtcgtggaatggcgtggcgatcctggcgcgggatgcgcagcccttggaaagccggcgtggtttgcccggcgatgacagcgacacccagagccgctatcttgaagcggcagtgcatggcgtgttggtcggctgcctctacctgcccaatggcaacccgcaaccgggtccgaaattcgactacaaactggcctggttcgagcgcctgatcgactatgccaaggccctgcaagccagtgagcatccagtgttgctggcgggggatttcaatgtggtgcccaccgacctggacatctacaacccgcggtcctggctcaaggatgccttgttgcagcccgagagccgtgcctgctaccagcgattgctggagcagggctggaccgattccttgcgccacctgtatcccgaagaacgtgtctacaccttctgggattacttccgccagcactggcagaaaaactccggcctgcgtatcgaccacctgttgctcaaccccgcgctcaagccgtacttgaaagacgccggcgtcgatgcctgggtccgcaatgaagcccacgccagcgaccacgcgccgacctggattcagctgggtacgcgcaaaaagcgctaaccttcgcgaatcaatccaagggcctcggccttgttcagcggatgctgcatacgctgggacaggcgcgccatcgcctgcgggtattcgcaggcgaccacggcttgcacctgatcgtcatggcagagcagggcgatgaagtggtgttgctgcaagtcgccttcgatgtgcaggcggttccagtgctgtccatggccgagtacctcgaaggtcttgccgaagtggtaggtccagaagaagggcacgtcggcgtaggcctgggcggcgccgagcatgttgcgtgccgccagcacccccaactgctgggccaggcgccagtgttcgatgcgtgttggctgatggttccaagggaaggtcaggttatcgccggcagcccataacccaggggcggcttgcaggtggtgatcggccagcagcgactggtcctcggctttactgacaccctcgataaaacccgtggcaggcgttacgccgacaccgatcaccaccaggtcggcagccagtcgtttaccgtttttcagcagtaccgtaccgaccgcgccgtggccgtccaggctcaccggctcggtattgctgtggaagatcacgccattgtcttcatgcaactgtcgcagggcggcgccgatgcgtcggcccaattgcgcggcaagtggaacgtcatggcggctgaccacttgcaccaccaggccgcgctggcgcagggccgatgcggcttccaggccgatgaagctgtcgccgatgatcactgcgcaggctgccgactctgcggccgcgtcgatgcgtgcggcatcttcgcggctgcgtagcacgaatacgttgctcagcacggtgccgggaatatccagtgactgcggctggccgccggtggcaagcagcgcagcgtcgtagtcgaagtggcggccgtcggccagttcgatgcgtttggcagcggcatccagacgctgcacctcaccctggataccgagggtgtcgaagggcgcgtcttccagcaggggtggcgtatcctgcggcgccatttgccctgcgatcacgaatttgctcaaggcggtgcggtcgtaggccggcgccgattcgcggtcgatccacagcaggcgcccagtaaaaccctcgcggcgcaaggtggcgaccgctgcggtaccggccgctcccgcgccgatcaccgcgaagcaacgcgagtcatcggccacggccgagggtgcagggtcaaccggcgcgtcaccgacactgaccacaccatcgcgaacctgcaccggatattgcttgagcgccactaaggctggcggttcgagcaccgccccattggccacggcaaaggttgccttgtgccaggggcagacgatgcggccttggcagataaccccttcttccagtggcgcgccggcatgggggcaatcggcctggaaggcgcgtacctggcctccactgcgtaccagtaacagcgggtgcgccgccgtttcgacgcgaacgccacggttctcgggcaaattgatcaggcgggcaacgatgcgcatattcataggccagtctcctttgaaaggttgactggcggtcacagcgatggactgcgttgacccgacggtcggtgcaggtggcggtgcgttgctatgcgggttgggcgagcagtcgctctactgcagcgaatgccgccgtgcggcggtcttgccagcttccgcgaatcaccagcaccggctgtcgatgctgctgcatccagtccaggctcacctgaaaaaacgcgcggcggtcttcaagctccggctggcagcgctggccgtcggcgcaccattgcacatcctcgggagagagcagcaggtgcaggtcgtaatgccgggccagcagttcgctgtcgagccagccggggtagtcgccgaacagggtctggctccacagtttgttggccagcaggtgcgtgtcgagcaccagcaggccagggcgttcggcgcgggcagcgtcttcccattccagctgcccacgggcaatcgccgggatatccgccaggcaggtgtcacgctgatggtgatcgatgaaatagcgcacgtactcgccgaccatcagcccgccgaagtgtgcgtgcaactcggcagccagccaacttttaccgctggattccgggcctgccagcactaccaccttcatggctgtaacgccgggtcggcgcgccattcacgccagccttgcacagcgatggcggtgaacaacgcgtagagcgcggcggtgaggtagaggcctttgtagaggaagagcccgacgaatattacatccaccacaatccacaacggccagcactgcaggcgtttttgcgccatccacatttgcgccaccaggctgaaaccggtaagggccgcgtcgagccatggctgtgcggcgtcggtccagtgggccatggcggcgccgagcaacaggctgccaacggtgcccacggccaggctggtcatgatcgcaggtacccccaggcgggtgacctggcgaccctgcctgacctcgccggcgcgggtccactgccaccagccatagacttgcaacgcggcgtagaccacctgcagcagcatgtcggagtagagttttacctcgaagaatacccaggtgtagagcagcaccatcaccaggccgatgggccagcaccaggggttctgcttgaccgtcagccagacagcgatcacccccagggcggcggcgaacagttcaagcccggacatggtggatccttgggaagtgggagagggcggtgattgtacctagaggccagcgatcttcaaacttgcgtgcaatgggcatacatcgcacaaaaatgtgggagaaggcttgctcccgattacggtggatcagtcagctcatttgcaactgacccaccgtaatcgggagcaagtcgaatcgtcgcaccgcccctcccacagttgccggcgctagattcggaattggcgcagcaacccatcaagctgctcactcagcccacgcaactgcccactcgccacgctggattgttccgccgccagcgccgtgctgtgggacaaccctgcggcctgggtgacgttctggttgatatcttcgaccacatgggcctgttgcagggtggcgctggcaatcgaggcgttcaaaccgttgaggttgtgcagcgcctggccgatggcggtgaggctggcccccgcctggccggcctgctcgatggtcagttgcgaggcgctgtggctgtcgctgatgaccttgaccgccgcttccgagtgaccttgcaagcgctcgatcattgcctggatttcggcggtggatttctgcgtgcgctgggccagcaggcgcacttcatcggcgaccaccgcaaacccacgaccctgttcgccggcgcgggcggcttcaatggcggcattgagggcgagcaggttggtctggtcggcgatggaacggatcacttcgaggacgccgccgatctgcgtgctttcgctggagagcgtgcgaatcacctctacggcctggctgatagtgctggagagctgatcgatctgttgcaaactgccgtcgatgttgacctggccctgttgcgcctgggcttgggcatcgcgcatttcgctggcggcatgttcggcattcttcgccacgtcctgcacgccgtaggtgacttcattgatagcggtagccaccagctccatctgctgcgattgctgctggctgcggtcgtgggcctggctggcgttgtggcccaactccgtggacgactggcccagggcggtcgcgcatacctgcaattggccgaccacctggcgcaacttggcggtgaagctgttgaaatgccgggccagttgggtgagctcgtcgctgccgtgggtgtcgaggctgcgtgtcaggtcgctttcgccgctggcgatattgcccatggcgttcaccgccgcctgcaacggctgcacgatactgcgggcaatcagtgataccagcagccccatgaccagcacgatgcccagcacgatgaaagaggctttccacacctgagcgttgaattcggcctgcacatcatccacatagacgccggagccgataatccagccccagggttcgaacagctggatatacgaagttttctccaccggtgcttcggccccaggcttcggccagcggtagttgacgataccggcgcccttggccttggccaggctcacgaactcgttgaatacggcaaagccgtccgggtcgcgaatcgccgagaggttctggccatcgagcttggggttggccgcgtgcatgatcatcacgggggtgaggtcgttgatccagaagtaatcatcgtggtcatagcgcagcccgcgcactgcgctgagggcttgctgctgcgcggcatcacgggtcagtacgccggtcttttccaggttctggtaatagctgagcacgccgctggcggtctgcaccacatgctgggtctgttggcgcttggcctggtaaaggtcgccacggatctggttgagcatcagcagccccaaggccaacagcatcaacacggcgactatcaggatcagccaaaggcggcggctgatcgacatgctgcgcaaactgttcatcgtcctgtcactccatgctctttataattgtggtgctgcttcgagatttccggcgtgtctgataggctttcggcccggaatcggaaaacctgagtactgcctgatttttcacggaatttttgcagaccggcgttgagaatcaaccgcgggcgcttgagtgcgctcgtcgtcagtgaactttaaaaaaacttaagaggcatgccccgcgcgtgacctttggagacagcatggatttttggaccgccatacaggcattgattctcggcatcgtcgaggggctgacggagttcctgccgatctccagcaccggccaccagatcatcgtcgccgacctgatcaatttcggcggcgaacgtttcgaagccttcaatatcatcatccagctcggtgcgatcctcgcggtggtctgggagtttcgccgcaagatcctcgacgtggtcatcggcctgccgacccagcccaaggcccggcgcttcaccgtcaacctgatcattgccgtgttgccggcggtggtattgggggtgatttttgccgacctgatcaagcactacctgttcaacccgatcaccgtcgccaccgccctggtggtggggggcgtgatcatgctgtgggccgagcgccgccagcacgcggtgcgcgctgaaaccgtggatgacattacctggaaagacgccctcaaggtcggcctggcccagtgcctggcgatgatcccgggtacttcgcgctccggtgcgacgattatcggcggcctgctgtttggcctgtcgcgcaagaccgccaccgagttttcgttctttctggccatgccgaccatggtcggtgcggcggtgtactcgggctacaagtaccgtgacctgttccaaccggccgacctgccggtgttcgccattggcttcgtcacctcgttcattttcgcgatgatcgcggtcaaggcattgctcaaattcatcgccagccacagctacgcagcgtttgcctggtatcggatcgccttcggcctggtgatcctggcgacctggcagttcggctggatcgactggacagcggtcaagccatgagcatccagcacccacgcctgaaagcatttatttttgtgctgctgtgcgccgcgccgctgttgggctcggctttgctgtggtatcgcggtgagacggtgatcccgttagcggcatatggcgtggtcagcgtggtggcgtttttcctgtactggagcgacaagcgcaaggcgcagaccgaaggctggcgcaccccggaaaacatcctgcatgccgtcgagctggcaggcggttggccgggtgggttgatcgcccagcaggtgttccggcacaagacgcgcaaggtgtcctatcaggtgctgttctgggtcatcgtgctgttgcaccaggtgttctggttggatcagctagtgctgggcggtacgctgttgtcgattttgtagggacctgctcaacgcactggcacgcattggaataataagaatgtcatgctctgattcattgctacgccactcggcgactgagcttgcgacgctgatccggcaacgcaagctcacctccacggctgttgtgtcggcctatctcgcccgcattgaagcgctcaatccaccgattaacgccctggtgcaagtgcgcacgcaggcggcgctggccgatgcctggtcggcggatcgtgcactggctcaaggcaactgccggggcccgctgcatggcgtgccatttaccgttaaggatgtgttcgatacccagggcgtaatatcggcagtgggcctgactgatcgggctgactatttgccgaagcaggacgccgtggtggtcacacgcatgaaggccgccggtggcattctgctgggtaagagtaactgcccgccgggtggtggcggtggggtgaccgacaaccctgtctacggcgcgacgcgcaatccccatgcgctctcccatggccctggcggcagcagcggtggcgaagcggcggcgattgccgcaggcctctcacccttggggctgggcagtgattccgacggcagcctgcgggtgcctgcgcatttttgtggtatctgcacgttgaagcccaccagcggccgagttcctaataccggcgtttttgatcacccaggcggtttgagcgacccgcgcagccagatcggcccgatggcccggcatgtggacgacctggcgctggtgctccgggtgattgctggtgaggatgggcgcgattcaggggtaattccaatgcccctgcacgatgcgcccgttcacggcgtcggcggcttgaagatcgcgtggtacagcgacggcggcattgagcccgttgactcgatcaccgaggccatgctgcaggctgtcgccggtcacctggaaagtgcaggcgcgttggttcacacggcttttccctcggtactgagtagcgctcgcggtataaccgagcgttattggtcgatgagcgcgggaacgggcgcgcagtccgtccagttgttatcagactgggaccggtttcgcagtgccatgctggaattcatggcgagctacgaccttatcctgtgcccggtcgacgccgccgcggcgccacgcctggaagagcttcggccagggctgttcaaccataccttgccctacagcctggtcggctggccctgtgtagtggtgcgtgcgggaacggatgccgggggcctgccgttgggcgtgcagatcgtcgctcggccgtggcacgagcacctggcgttagcagcggcgcgcgtcattgagcgggcgctgccgttcacaccatgtgtcgtcgcccagtcagccatctagcctgagcccgacctgggtgcgcttgggcagcttgctcaccaccaattggtgggagcgctgcaacaggccgcgcagctcgtcggcgcccagcgggtagggcgtgttcatgatgatccactgtgctcgggccagataaggcgccgggtggatgcccgggcggtcgacgtggcccaggaacaggtccttgtccactttgaacgccagcgattcaccacgcaggttctgcagggcgaacatcttgttgccggcaatcgagaacacgcgcacgccgccccatttgtagtcttcccgcgcaccaggcaggcccaggcagaacgcggcgacttgtgcttcgctcaggctcatagcaaacggtctccacagcctttgaagccttcttccaggtagtcgatccaggcgcggatggctggcaacacaccacgtcgatgcgggtacacggcttgcaaccagccgcccggcaatgaccattgcggcagcaattgcaccaggcggccactggccagttcttcctcgcaatacatcatcggcagcaccgtgaagcccagacccatgatggcgctggccttgcgcacgataaagtcttcgatgcccagccgggcctccatcaccaggtcgtaggggttgccctgagggtcgaggatgcgctgatgcaccatgcgatccgcctcaagtgcaccaagtacgggcagttgcctgaggtcgtcgagggtatgtacctgccgctcacgcatcagcgcggggctggcgaccagtacggtctgggcctggcgcaggcgcttggtcaccagcagcgggtcttcatcgcccagttcgcgtacgcgcagggccacgtcaatgccttcggccaccaggtcgacgcggcggttgaccagggtcatatccaactgcaccaacggatgcgcggcaagaaacccggccaccagttccggcaggatgtgttgggccaggcccaccgggcaactgacccgcaggcgcccacggggctcgctggacatgctcgccacggcctcatcggccatctccgcttccagcaacatggcctggcaatggcgcaagtagcgctcgccgacggcggtcagcgtcagttgccgggtagtgcgttgcaacaggcgggcgcccaggcgttcttctaattcggcgatgcgccgtgacagcctggatttgggaatcccgagtagccgcccggccgcagcgaaaccgccggcttcgacgactttggcgaaatagtagaggtcgttgaggtcttgcatgctgggcctattgtcctgtcagtgggacaaactatcgcattttagctggcttatcgaccattggtttcatgcgtagcatcaccaccatctgatcgccactgtcgatcccacctcggagatccaccatgaaactactgcatatcgattccagcatcctcggcgacaactccgcttcccgccagctcagcgccggtgtggtcaaggcgtggcaagcggctgaaccgggcgtggaagtgacttaccgtgacctggccagcgaaggcatcaaccacttctccggtgccaccctgggcgcattgggtacggccgaagaactgcgcgatgcggcgcaaaaacacgaggctgaactgagtgcaacgtcgctggctgaattcctggctgccgatgccgtggtcgtgggtgcgccgatgtacaacttcaccattcctacccagttgaaagcctggatcgatcgtatcgcggtcgccggccagaccttccgctacaccgaagccggcccggaaggcctgtgcggcaacaagaaagtcatcatcgtctccaccactggaggcttgcatgcggaccaggcctcgggcgccgcccatgaaggctacttgaagctgctattcggctttttcggcatcaccaatatcgaaatcgttcgcgccgaaggtctggcctacggtgatgaagctcgcagcaaagcgttgagcgatgccaacgcgcgcatcaaccagcagttgttcgcagctgcgtaaggcttttgtaaatagcatctttcccggtttcattctgaggccgggcgcctaaactctgtattctgatcgcctgaacgcgagcggagtacggagtttttttgtttatggcccaggttatgcaaccattgctccaataccctgggcttttattcgccatgccggtttttgcgcagcaaaggtggacgtccccatgatgcgtctttgtgctgttttggctctctccctgctcggcggcctgttttcagtgcatgccgccccggcaccgcacccccattggagtgtgggctttcatcgcatgagtgtgctcgacccgctggattcgcagccgatgaaagccattgcgttttacccttccaccgaggccgagcacaccacgccactgggcgcgtatcaggtcgccgccagcgaagattccaaggtcgccatcggccgtttcccgatgctgatgctgtcccatggcaataccgggacgcctttggccttgcacgacctggctacttccctggcacgcaaggggtttgtggtggtggcagtgctgcaccctggcgacaactacaaggaccacagccgcctgggcaccgtgagcaacctgtatggccggccgatccagatttcccaggccattaccgccgcgctggccgacccgatgctgtcgcctttcgtcgatattgatcagatcggcgtcatcggctattcagccggtggcgaaacggcgctgatcctcgcgggcgccaagcctgatttcgagcgcctgcgccgctactgccagcaacgccccgaggaccgcgatgcctgcaccaccaacggcgagctggtggtcgaccgcgatgacttgcagccccaggccgacccgcgtatccatgccctgatgctgatggcgccgctgagcctgatgtttggtcgccataccctggcggacgtgcacgtgccggtgctgctctacagtggcgacggcgaccagttggtggcggtggacaagaacgccgccgccctggcgcgtaagctgccgcagccgccggatttcaagctgttggccggggcagggcactttgtgttcatggcgccgtgtgacagtaatcaactggcgacgatgccggcgatctgcaccgatgccgatggggttgaccgggaaggtatccatcgcgacatggtctccgaggccgggcgctttttcagccataccctcggcgaggtgacccgcgccggcttgcagaccgctgatcagtaggcgcggcgcctgagcagtacggtgagggcgagtgcactgaccgacagcaaggccgcgcagaaaaagatccagccgtagccgaggttcaacgccacggcgcccatcagcggtccggcaatcgccagggccaggtcgaaaaataccgcataggcactcaaccccgcaccgcggctgctgtccggcacctgcttgatggcctccacccccagcgccgggtacaccagcgacaagccaaagccagtcaggccggcgccgatcaaggccgcgccggtggacggcgccagccacaacagggtcaggcccagggtttcgatgagcatgcagccgatggcggcggtgaacccgccaaagcggctgatggcggagataaacaccaggcgcgacaggataaaacacacgccaaataccgtcaggcagtacgccgcaccggtccagccacgattgaggtaatacagagtgataaaggttgtcagcgtgccatagccgatcgaggccaggcacaggctggtgccgaacggtgcgattcgcccgaacaccgcccagaacggcagccgctcaccgcgcaccacgggcactgaaggcttattgcggatcagcaccaggcccaacgccgccagcactgacagcgcaataccgaggctgatgtagccatattccgcgaccatcaccacgcctaatggcgcaccaatggcaatggcgccgtaggaggcgataccattccaggaaatcgaacgcgcggtatgttcgacgcctaccgcgcccatgcaccaactgatggtgcccacgccgatcaggccctgggccacgcccaacaacaaacggccgacgatcagaatccccaggctcaagctcggcaggctttccagcagcgtggcgataaaggtcagcacaccactgatcaggatgccggccaaacccagcacaatcgcgcgcttggtgccgacgttatccgacatccgcccggccatcgggcggctgagcagcgtggccaggtattgcgagccaatggcgataccggccactaccgcgctgaaacccagttgttcatgcacatagcctggaatcaccgcaatcggcaggccgatgcagataaaggcgatgaaggtatagaagacgatggagacgatctgcagggtgatcgacagggaggagggggaggcagacatggcactcgttcgctggcgggcggtacggccatgatggcataacccgctatcaaatgcggggggggcttgccccctcccacatttggacctgcttttttcttgcagccaagcgctgttcttagaacaccacgccctggctacgcaggtagtcgtcataggtgccgctgaagtcgatcacgccgctcgggctcaactcgatgatgcgggtggccagggacgatacgaactcacggtcatggctgacgaagatcagcgtgcccgggtagttctccagcgccaggttcagcgcctcgatggattccatgtccaagtggttggtcggttcgtccatgatcagcacgtttggcttttgcaggatcagcttgccgaacagcatgcggccttgctcgccaccggagatcaccttgaccgacttgaggatctcgtcgttggagaacagcatgcgccccagggtgccgcggatcacttgctcgccctgggtccactggcccatccagtcgaacaggctcatgtcgttttcgaagtcactcgcgtgatcctgagcgtagtagcccagttctgcagcgtcggtccacttgatgctgccggcatccggggtcagttcgttgaccagggtacgcagcagggtggtcttgccgatgccgttcgggccgatgatcgccacgcgctcgccggcttcaacctggaagctgaagtccttgaacagcggcttgccgtcaaagcctttagccatacgctcgacgatcaccgcctggcggtgcagcttcttggtctgttcgaaacggatgaacgggctgacgcggcttgaaggcttgacttcggccaactggatcttgtcgatcgccttggcacgggaggtcgcctgcttggctttcgaggcgttggccgagaagcggctgacgaaggattgcagttcggagatctgcgctttcttcttggcgttgtccgacagcagttgctcgcgggactgggtcgccacggtcatgtactcgtcgtagttgcccgggaacaggcgcaactcaccgtagtccaggtcagccatgtgggtgcacacgctgttcaggaagtgacggtcgtgagagatgatgatcatcaggctggagcgctgggtcaggatgttttccagccagcggatggtgttgatgtccaggtggttggtcggttcgtcgagcagcagcacttccgggtcggaaaacaacgcctgggccagcaatacgcgcagtttccagccaggggatacttcgctcatcgggccgaagtgctgttccaggggaatgcccaggcccagcaacagctcgccggcgcgggattcggcggtgtagccgtccatctcggcgaactcggtttccagctcggccacggccatgccgtcgtcttcgctcatttccggcagcgagtagatacggtcgcgctcggccttgaccttccacagctcctcgtggcccatgatcacggtgtcgagcacggtgaattcttcataggcgaactggtcctggcgcagtttacccaggcgcacattcggctccagcatgacctggccgccggacgggtcaaggtcgccgccgaggattttcatgaaggtcgacttgccgcaaccgttggcaccaatcaagccatagcggttgccggcgccgaacttgaccgagacgttctcgaagagcggcttggcgccgaactgcatggtgatgttagctgtggagatcaattactttacctatcaatgggttgcgagcgtgacggcaggtgccttcaggcatgcgtcaacagcgacatcaaggcgcgaaacccggtcgctgagcgaaaaattttggatgtgtgttggaatttggcgcgcattgtcgcatatgtcaggcaacagttgtatggcgagcgaaggatggtttcgacaacgtctccggcacggccagccataacagcagcaacgcaatgcctgccacgccggccagcgtcaggaaagccgcgttgtagccagcctgctgcactacgaaaccggccaggctgttgctcagcgccgcgcccaggccgaacacggtggagagggcgcccaggctgacgttgaagcgcccggtgccttgggtcaggtccttgacgatgacagggaacagcgcgccgaaaataccggcaccgatgccatcgagcatttgcactgctaccagccaataggggtcgctggacagggtatagagcaagccgcgcagcggcaggatcaaaaagccagccagtaacagtggcttgcgcccccatacatcggccttgagccctaccagccaggccatcggcaccatcaccaactgcgcagcgacgatgcaggctgaggtcagcggtgtcgccatctgcaggttgatctgcgccaacttctggctgaccagtggcagcatcgcggcattggcaaggtgaaacagcgcgcagcagacggcgaacagcagcagcgggcggttggccagcaggactttcaggcccgagggctgctcatggtcgttgtgatgggcggggtcgaagccgcgggctacctcatgatcaatcgccttggccggcacgcaactcacggcgatgacactggccactgccataaacgccatcaggtagaacaccaccactggcccatacagatacgccaggcctccggccagcaatgcggccacggcgttgcctgcgtggttaaaggtttcgttgcgcccggtgcgtgatgtaaaggcacgggggccggtgatgccaagggagatggcgcaaatggccggggcaaatacagaggcggctacggcgctggcggcttgggtcagcgccacccagccaaatgaactgacgaagggcagcagcaggcaactggcggtcaccagcagcgcggcgatggcaatcactgcacgcttgctgcgcgttcggtcgatcaacgcccccgccgggccctgggtgatcaacgcggcgatgccagccagggtcatgaccacgccgatactggcggggtcccatttatggaccgccagcaggtaaatcgccaggtacggcccgagaccgtcgcgcacatccgcgaggaagaagttcaggctgtccagggataaggcaatgcgcaggtctgagggaggggccacggtgcgttcttcgagagcggcgtccgggggccgaacacacgttggggtaatgacctgcaagctcgacgataagtttcgccgaagccgagggtttcatcctgcaggtatttgtcttactttcccaagcccgcggtactgactttctggagaagcaatggacatgccctcagcgcaagaggcgattgccagcaacaagaacgcctgggatgagtctgcccggctgcacaaagacaccgcgacctggtcgacgctactgggccaggtcgccaagcctgatttctcctgccttgatcccaccattaccgcggtgctgcaagaggtcggtgtggcgggcaaggatgtggtgcaactgggttgtaacaacgggcgcgaaagcctgtcgttgtatagcctgggcgcgcgttcggtggtggggatcgaccaatccggggcgtttcttgggcaggcgcgggaactggctgcagtctcgccccatagccccgagttcatagagagtgacatccacgctttgccggagcgcttgcacgcgcaattcgatatcgccctggtgaccattggtgtactgggctggatgccggatgtggcgttgttcatgcagcatgtcgcccgtgtgctgagacctggcggcacgctggtgatgtacgaaacccatcccttccttgaggtgttcgacccgcgggcggccaacccgttgctgcctgccagctcttacttccagcgtgagccttttgtgctgcaggaatccattgtctatgaagggcagggcgaactggccggaccgacatcctattggtatgtgcacaccctgggcaacgtggtcagcggggcaatcgctgcgcacatgcagattggtcatttgcgggaatacccgcactccaatcgggaagaactctacgatcaatatgaacatcaggcagcgcaattgcccctgtgctttaccctcacggccaccaagccggtcgaatgacagcgtttggctcacgcaaaaaaaagcccgcgaggagaggcgggccaagtgattcactggagtaggtaggcccgactctaacgggcggaaagtgaaggtctcgtgaaaataccgtgatcgaatcggataaacgcgtcgattaccgccgccgcacgaaggtgcgcatggtttgcccagggccggtgctgaataccgttggcctgggcatgccttcgtccgcggcaataaatacaaaatcgtcgccttcgagccggtaactggcgggtaaccgcttgcctgcatcatcgccgatggcgtcaatccaagtgatgctcttgggcgcggtatcggcgtccagcgcaaaccggccagccagcaatatatcgccggttaccgtaacaacttcgaagcggtctgcgttgatagtcgtgatagcacccggcgcactgtgagcgtcgtcggggttgagtacgccaccgtcttcgagggccgtttgttcccaggcaccttgaagagcgtgaaagtcagcggttgacagaggtgacatgcaaattccttattgatgatccaagacgtattcaattgtaccgagggtgaggccacaaagcggggacgctgatttttttctttataagacaggtatttgacagcattttcatgttgtattgactacgatggtattgaggttagtccgacatggctgtttcatttggactactcatcgatataaaaccgaaataatcctccaagctgtgggatatttcagcggactaagtggtcagatcgccattggtccgccgcagccagggcgttgtccctgatttttgaagtcattcggacttctgagaatgatggccttttagtattattttaaggtgttcttattttgaatcgaacttccccactcccgccttccgcagcgtctgatgaaattgatctgtttgaactgtttcacgccatttggcggcaaaagaagctcgtcatcggttgtacgcttttggcaggtgtattaggtgcggggtatgccttcctggcgcccaagacgtatgaagtcagcagtgtgctgcgacctgcggcaatcaacgaactggatgccttgaaccgttcggaagtttataagttgcctcccgctgatgcgttgctgaaggtaggcgcccagttggattcctacgaggcccgtctaggcttcttcaaggaccatgaagagttgttcaaggcgttcaaaaaaccgggacaaagccttgagcagagctttgaggagttcaaccgcaattccgtcaatctgatcctgcccgacccgaagaaatccgattcgctgagcaactatatccgcctggagctgcaatacccggccgacgtcgatggcgtcgcgatcctcaacggttttgtggactacgccattgccgcggaacgccagcaagtcggtgccgatctcaaggtcatcgtcaataaccgcttgaccgagctcaagggcaagatcgacgccgcccgctccaactacgataccgacaaggagtccaagattgccaagctgcttgaggctgaccgtctcaagcgcgcccagctacaggacgaactcagcgcgctgcgcctgcagatgaagatggagcgcaccaatcgcctggccgagctggcggaagccatcagcattgccaagtccatgggtatccgcacaccgaccacgccgtcctccatggccgacgccacgcgcagttcgggccaggtcatgcgcaccgaggtgaacaatcagaagatcccgctgtatttcatgggcactgaagcattggaggccgaacgcgccgcattgcaacagcgtaccagcgatgatttcaccaacccgcgcattgccgagatcggcaaggagttgcaactgctggaaagcaaccgcgaggtcgaggtgttgcgcaagcggggcaatgaagacatcttcctgcaggacgtagagccgcttcgcgctgaagtcgccaggttgcgcggcttgaacattgacatgagcaatctgaagctggtgacgatcgaccgccgtgcccaggaacctttatcgccggtcaagccgaaaaaaccgctggtgatcgccttgagtctggtcggtggcatgctgcttggcctgatgatcgcgctgatccgctacttcatccgtagccgtagccaggcgttaccttatacggcattgggtgatagcagttttgcccgtcgcgagggtaaagacgagtccttgtaattgtgactgcccagaaacaggcgggcgcaaaggcccgcctgctcatacccccagcacaatcagtggacaggttttcacaattcttagttaacctttggttacaaagtgtggctaaataacggccagtggttccacgccgaggggttgcccgaccggtcgtgccgcctgtatgtgaattgtgatttcaggtgctgcttatcatcctcggccgttgtgggcccgcaggtgcagcctgttctctccctgacttgtgacgaatcccttgaaactcatcattgttgctctctacgttgcctccattgcgtatgtacacctgcgcggccgggtgcggcacaagctggggcgccagcttagcgatcactcgacgttcctggcgccggtcaactgctttctgtacctgttctccaagcagccaagccgcccctatctctcacccagcgactttccggagctgagccctttgcaggaacattgggagcaaatccgccaggaaggccagaacctgatgagggcaggggagatcaagcgttcggaccagtacaacgacgtgggtttcaactcgttcttcaagtcgggctggaaacgcttctatcttaagtggtacggcgacagccacccctcggcgatgaagctatgcccacgcaccaccgagttggtgcaaagcatcggctcgatcaaggccgccatgttcgccgagctgccgccaggctccaagctggtgcgccaccgtgacccgtacgcaggctcctatcgctaccacttggggctggatacgcccaacgacccgggctgctacatcaatgtggatggcgagagttattactggcgcgacggcgagccggtgatgttcgatgagacctacatccactatgcggaaaataccaccgcgcagaaccgcatcatcctgttctgcgatatcgaacgcccgatgaaataccgctgggcggcggcgttcaaccgctggttcagtcgcaacgtgatggcggcggcgggttcgcccaatgacgagggtgacaagaccggtggcctgaaccgtgcctttacccgcctgtacaagatccgcctgcgcggcaaagaactcaagaagcgtaaccgcacacgttactacctggaaaaatgggcgatctttgccggcttggcgctgatcttcattcttatctgaacttggtagggcgcgaatcactgcggtggcttcgcgcccagcctgtcccacatctttttgctgatcttctgtcgattggcgtagccggcccacggatcctccttcagaccctgcagccgctcgtgcaggttcgccaccgtccactgctgggcgccacgcaagtctttcaattcatcccgactgaccggcaccgacaccggcaagcccggccgcgcccgcacggaataagctgccacggtactggcgccgcgggcgttgcgcaggtaatcgataaagatcttgcccacgcggttttttgggccgctggtggcggtgaaacgctccggcagctgctgggtcatgaactgggccattgccttggcgaatgctttcacggtgtcccagccatcgcgccgggccagcggcacaatcaggtgcaggcctttgccgccgctggtcttgacgaaggcttgcaaacccagttcatcgagtaccgacaaggtcaactgtgccgcctccagcatggctttccacggcaaggccggatccgggtcgaggtccagcacgaacaggtcgggggtttcaatcttgtccgtcgtggcgccccaggtatgcaactcgacggtgcccatttgcacagcgccgaccagcgcgtcctggctgtcgatttccatcaggcgcgcgtgaccagggtccagcgcctggtcaagttgcttgatgtggggaatggccatgcgctcggagtgcttctgaaagaactgttcgccctcaatgccttctggtgccctgagcagcgacacgggccggctgcgcaggaatggcaagatccattggctgatgccggcatagaactgtgccagttgctgtttctgcgtgccgctttgtgtgtcgatgacgcgctcggggtgggtgactttcaccccactctcggtggtttttgccttgggcttcttgggcttctccagggattttgccgtgcgtggttgttcatggatgatctgtgcggcgggcttatccgtgcgtaaaccgagaaacgccgcctggcgcaccacaccctcacgggtccattcagtaaattgcacttcgcccaccagcgtcggctcaacccaatgcacgcctcgggcctgagcgctggtcagtggcttttccagtggcgaggttttgcgttcaagggcggtgagtttggcgtagatgctcttcagcgccgcctgatcaaagccggtgcctacacgccccgcgtaaaccagcccgttgtcgtcgttgaccgccagcaacagtgcgccaaacccactgcgcgaaccttgcgggcgggtgtagccgacaatcacgaactcctggcgcaagcggcatttgagcttgatccagtcggcgctgcggcttgatacgtagaggctgccggcgcgcttgccgatcacaccttcgagggccaggtcacaggcactttcgaagatatcgcgctggttggcggcgaaagcttcggagaagcgcagcagcttgctacggctgccggaaagcgccgacttgagggcggcccggcgttcttctaccgccacgttgcgcaggtcttgcccatcaaggaagggcgcatcgaacaggtaatagacgatatccaggctgcggccaatatcgaaggcattctgcagcgcctggaaatccggcagaccgtcggcgttgagactgaccacttcaccgtccagccaactgtccttgagcttgagcgcctccaacgctttcacctggcgcggcaagcgctcggtccaatcgttgccgttgcgggtaaacaggcgcacctcaccgtcgcggatacgtgccagcatgcggtagccgtcgaatttgatctcgtacagccagtcgccagcaggggcgcggtcgaccagggttgccagttgcggggagaactggtctggaagggcggaggttgctttcttgggttttgcagctttcctggttttgctggcggccttgactttgcccaccgaggcgtcgctgagcacactgtcgggctgggcctggacgatatcgtagtcggccgccgggcgggcctgctggtctttttccttgatcagcaaccattgctccttgtcaccgctgcctttgagccgggtgcgcaccagggcccagtcccccgagagtttctcaccaaccagagtgaacttgagtttgccggctgcgtaggccttgtgcggatcgtcatggggttgccataagccacggtcccacacgattacatccccggcgccgtattggccggcgggaatgctgccctcgaaactgccgtagctcaggggatggtcctcgacatgcaccgccaggcgcttctgggtcggatccaggctcgggcccttgggcacggcccagctcaacagcacaccgtcgagctccaagcgaaagtcatagtgcagattgcgcgcatcatgcttctggattacaaaactcagggccgaggttttgcgctttgtggctggtgaactgccggccggttcggcggtgatctcaaaatcgcgtttgcggttgtactcgctcaggggctttgccatgtcattctccaaccgatggcggactcaagaggcttttttactggacttttttgcggcgggcttcttggctgccggtttgcccgccagactacgcttgagcaattccgtcaggtcgattacgtcggcagatttgcgctcttcgctgccctcggccgtttctacatcttcgatcttgccagccttggccttcttcgccaccagcgccatgatcttgtcctggaaactgtcgcggtactcatcgggctgccagtcggcgctcatgtcttccaccaggcgcttggccatgtccagttcgcccttggccaaagtcggcttggtcacatcgctgcccagttccagctcatccaggctgcgcacttcggcaggccagcgcaacatcaccagcaccagggccgactccaacggcatcaacgcggccaggtgctgtttggtgtgcagcacgacattggccagggcgaccttgccggttttcttcagggtttcacgcagcagcgcatagaccttgccgccgcgtttgtccggggccaggaaatacggcgtgtcgatgttttgcagggggatctggtcgctggcgacgaaggcgatgatctcgatagtctgggtcgacttggggtgggccgaacgaatttcatcttcgctgagcaccacgtagcgacctttttcataggcgacgcccttgacgatattctccttggtgacgtccttgccggtggtcttgttgatgcgcttatagcccaccgggtccatgctgcgcttgtccagccagtcgaaatcgacaccctgggatgacgtggccgagaccagcgataccgggatgtgaaccaagccgaaactgatggcgcctttccagattgcccgcggcatagatgcaactccttaacgaagagactgtgttctggtgactcatgggccaggacaaaagtttcgacgagcagatgctcggacagatcgtgttacacctgatgagaaactatttagtgtcacaacgcgaaccctcggggtagcgtgttatcgaacgcaggtagtactcggcatagagaggtttggtcatgaaccgttgtgtacgtcatcttgcagtactcgcgctgggtctggccctggcgccattggcccaggcgcaaaacctgccgggccgttacgacaccaataacagcccgattcatcgcgccaaccccaacagtatgcagggcacccagcccaatgcgccggctgttcgtggaatccagactaccccgaccagcccccgaccgactgtggaaaacggcggcatcggcaaccgttatccgaggcaggaagcggccccgagccgtccggccaccgaacccaaagcgcccacctatgatgccaacggcaatcgccgctaaggaatcgtcttatgttgctacgcaaaaccctgttggccgcattgtgcgccaccgtgcttctgccattgagcgcggtacacgccgccggtagccagcaatttcccagtgagcaaggcagcgtcaccgccacgccgatcgccaagggcctggaccacccgtgggcgctggcgttcctgccagaccagcaaggtttcttggtgaccgagcgtcccgggcacctgcgctttgtcagcccggacggcaagctttccgcgccattgacgggcgtgccgcaggtatgggccaaagggcagggcggcttgctcgatgtggtgctgtcgccggacttcaagcaggaccgtatggtctacctgtcttacgccgaagggggcggtgaaggcggtaaagccggaaccgccgtagggcgcgggcgtctggctgacgacttgagcggcctgaaggatttcaaggtcatcttgcgccaggagcccaagctgtccaccggcaatcattttggttcgcggctggcgtttgaccgtgacggctacctgttcgtgaccctgggagagaacaacgaccgcccgacggcccaggatctggataaattgcagggtaaggtcgtgcgcatctatccggatggccgcgtacccgatgacaatcccttcgtcggccagcccggtgtacgtcccgagatctggtcctacggccagcgcaacccccaaggcctggcgctgaacccgtggagcggcacgatctgggaaaacgaacacggcccccgtggcggtgatgaagtcaatatcatcgagcgtggcaagaattatggctggccgctggcgacccatggcatcaactattccctgctgcctattcccgaagccaagggcaagacggtggagggcacggtagcgccgcaccatgtgtgggagaagtccccgggcatcagcggcatggcgttctatgatgccgaccgcttcaaggcctggcagcacaacgtgtttattggcgcgctggtcagccaggaactgattcggttgcagttcgatggcgacaaagtagttcatgaggaacgcttgctgggcgagttgaaagcgcggattcgcgacgtgcggcaggggccggatggctttctgtatgtgctgaccgatgaagatgatggcgtgctgtatcgggtcgggctcaatcaggactgattacgctcgtgtgggagagggcaagccccctcccacatttgaatctcacctggttgcagaacgggagtgttacacgcccaagtccgacaaccccggatgatcatccgggcgacgacccagcggccagtggaacttgcgttcgctttcctggataggcctgtcgttgatgcaggcaaagcggttggccatcaggccgttctcatcgaactcccagttttcattaccgtaggaacggaaccagttgcccgagtcatcgtgccattcataggcatagcgcacggcaatgcggttgccggtgaacgcccacagttccttgatcaatcggtaatccagctccttggcccatttgcgcgccaggaactgcttggcttcttcgcggctgtgggcaaattcagcgcggttacgccactgcgtgtccagggtgtaggccagggacacgcgctgcgggtcgcgggagttccagccgtcttcggccaagcggactttttcaatggccgactcgcgggtaaacggcggcaggggcggacggacttctgtttgtgctgacattgggcggctcctgaatacaattaagttagatcgaaagttgcctggccagtggggttcaaagttgcaataacgttcgcgccatgcattgcgcattatcggcagctgttgaatcgcccatgaccagggcaacggtaatggcgccatcgatcaggatcagcagttgcgcggcctgccgttccgggtcgggggtgccatgtgcttggcacagctcaagtgcgtactcgaacagtttttgtttatgcgctttggccagcaggcgaaccgggtcttgcgcgttgccggtttcaccactggtattgataaaggcgcagccacggaagtccgccgagccgaaccagcgcctgagggcgtcgaacagcgccagcaggcgctcgccgctgccttcactacgctctacttcgtcgcgcaaccattgcatccagcgctcgtcgcggcgttgcagggcggcaatcaccaactcgtccttgttggcgaagtagcgatagatgctttttctcgacacgccggcggttttcaccagcaagtccatgccggtggcggtaatgccatgccggtagatcaacttctcggtcacgtcgaggataatgtcgcgggtttcactgctggctatatcattcatgccgaacaaagtagaacgatcgttcttcatggtcaagcggagtttttcatttgttgatgacgagacctgagccgccccatggtgtaagctcggggcctcttcggattcgacccattgcgagccctatgccgacgttcttcaaacgttccctgttgcccaagctgcgcggttttccattgtcccccgaggccatcgaggtgctgcccagcgctgacgcgtatcgtcgctgcctgctggagaaaatcgcccaggccacgcggcgtatctacattgttgcgctgtacttgcaacaggacgaagcggggcaggaaatctacgacgccctgcacgctgccaaggctgcaagacccgaattggatatcgtggtgatggttgactggctgcgggcccagcgcgggttgatcggcgccggcaagcaaccgggcaacagcgcctggtaccaggcgatgacgcaaagccacgccagcgaagtgccggtgtatggcgtgccagtgcaaacccgcgagctgttcggcgtgttgcacctcaagggctttgtcattgatgacagcgtggtgtacagcggtgccagcctgaacaatgtgtacctgcacaagttcgacaaataccgcttcgaccgttaccacctgatccacagccaggccctggccgattcgatgcagcacctggtggaacatggcctggtcgcgtccaaggcggtgcatcgcctggacctgccgaacccgcccaccacccgcagcctgcgcaatgacatcggcgacctgcgcagccgcctcaagcatgcggcctatgacaccacggcagggcagttgcccaacggccacctgtcagtcagcccgttgctcggtgtcggcaagaataacccgctgagccgggtgatcctcgagctgatcgccagcgcccagcagcaactgaccatctgcacgccttacttcaacctgccattgccggtgacccgcgagatcaaccgcgccttggcgcgtggggtgaagatcgacatcgtggtcggcgacaagaccgccaacgacttctacattccgcccagcgagccgttcaaggtgattgcggcattgccgtacctgtacgagatcagcctgcggcgttttgccaagcgacaccagccaatgatcgacagcggccagttgaacctgcacctgtggcacgatggcgacaacacttaccacctcaaaggcttgtgggttgaccagcgctacactttgcttaccggcaacaacctcaaccctcgggcgttccgcctcgatctggaaaacggcttgttgatcgacgatcccaaaggccaatggctggcgccgcggcgtaccgagttgacgcagattttccagcacaccacgcgtatccagggttaccagcagttgcagacgctggtggattatccgccagcggtgggcaagttcctgcgccgggtcagccgggtgcgcatcgagcgtttgctgtaccgcatcctgtagccgaataagccacgggtaaaaaaacacccaggcccctcaacgggacctgggtgttttttttgcgcgaagcgcttagttcaagcccaacttgccgcgcagcatcgacaggtcttcagccagggtgttgaccgggccgaccagcgccttgcggtcgttgtccttgaccttgtcgtaggtctcgaagccgccatcctgggtcttgtacttggccaggatcttgttgacggtggcgaagttcttgtcgaccttggccaggaaggcctggtcttgctggccgatctggccacggaacaggtcgacgattttcttcgcgccatcgatgttgccctggaagtcatacaggtcggtatggctgtagcgatcttcctcgccggagatcttggtagcggcgacttcttccagcagcgcggcggcgccgccgacgactttttccggcgggaaggtcaagccgtcgacgcgggtctggagatcattcacatcggtgttgagcttggcggtcagtgcctccaggccctgggtcgagttctgcgcgaacagcgcgtattcaatccggtgaaagccggtgaagtcttcggccgtcacacctttttcatggtcatcgacacgcgaatcgatggacgcgtcgaggtcgctgaacagctcggcgatcggctcgatggcctcatagtgcacgcgggtcggcgcatagagccgcttggcggtggccaggtcacctttattgatggcgttggtaaacgcttgggtctgggtgaccagttcgccgatttcctcggtaacgtagatcttgtagtccgataccgggcctaccagatcgagcggcgcggtagcagcgaaggcagccagcggcgcaaggctcattaacaacgacaacgcgatagacgacttcttcatgggggcattccgctctggtttgttttaggtcttggcagtggtttgggaagacgttgcggcgagcagcgtgcgcccaaggaaatccttgggcccggtgacgcctggcaaggtgaagaaatagccgccacccaccggcttgaggtattcctccaggggctcgccgttgagccgggtttgcacgctgataaaacctttctccaggtcggcctggtagcagatgaacaacaaccccatgtccagctgaccgtttttgttgacgccgttggagtagttgaagggccggcgcaggatcaggttggcctgggtctgcggggtgcgcgggttggccaggcggatatgggcgtcgagcttggtcaacttgccttccgggtctttgctgtagtccggaacctgggtttcatgctggccatccatgggggcgcccgtgggtttgacgcggcctatgatgctttcctgttcttgcagtggggtgcgatcccaacgctcgacaaagttacggatgatgcgcacggcctggtaactgccatgggcggcccaggccggttcgtcgctgccgggttggacccagacgatctggtccatggccttggcatcgttggagtccgggttggccgaaccatcgcgaaaacccaggaaattgcgcgcactctgcgcaggctcgccgggcttggccggtgcctggggcggcacgctgccttcctgtttccagcgcaccagcagcaggtcgggcaggttctttacgatgtcgcgcagagcgtggatattggtgtccggcgtatttgagctgaactgcaggctcaggtcgccgtggcattgcgccggttccagcgcatcgttgggaaagccgaccatgcgactaaggcgcttgggtttgaccgccctgaggccgaagcgctcatcgaacaatgattcgcccaccgacacggtaatggtcaagttattcggcgacaccaccggaccgaggatgccggaatcggtaggtggcaatttcggatcgacttggggcacggtgccaccgctcatcaggaacgcgatgcgctcgttcaaggtacggaacagccgctccagatcttcacggtcgctggccagtacatcgaacgccacgaccatgccgcaggccgggcggggtgtgacgatgccgctttggtgctggccgaaaaacgcctggcggtcatgggtcttgtcactgcgcggtgcgctggtcacctgctcggccgctgcggccatggccgggcaactcaagctgctgccggcaattgccgcgccagtggcggccatgcccagcaggacgcggcggcgttggagatcaaactgtggtgtatcactcatagtgcggtcgtcttcactgcaggccggaaaggccaagggcggggtcgattccatcgagtgcggcggccagtgccttggccttgtcggcgatctgcttgcgctgatcgtcggtgacgctgtcgtaacgggcgtagtggttgtcgaccttcaatccattgagctcggcatcgaaggcggtgagcgcgctgtcgatgtggggcagcaggtcggcggcggacttggtcaacagtggacgcatcaggtcgaccactttgcgggcgacctgcaggttggcggcaaatccattcaggtcaatatggctgtagcgctcctcttcaccgctgatcgcgcgtacatccgccagactgttgaggttgcgcaccacaatgctgaccaattgctccggcggcagggactgggcgagcagctgttgcttgagggtggtgacgtcggcgaccaagcgttgagcgacaggcgccaggccatcgaggctgcgttgctggaacaggctgtattcaaggcggtggaagccgctgaacgcaggatcctgctcgcgtttttcaaagtaatcggcgcgggcgttgatggcgttatccagctcggccaggcgctgggctgccggcgccaggcgctgataggcttcacgggccggcgcatacagcgcctgtgcctgtgccaggtcgccggagtcgatggcctgttgcagggcggctgcggcctcgatcagggcgccgccctggccgctcaggtacacacggaactccgacagcggaccgataaacgccaccatcgacggcttggacttggcctgggcgtcggattcagcggtcggcgtcacgtgcagcgagccacggggattgctcagcaggccacaggtgatcgcgtagtcgccgggctgcagattggcgttgatcacctggctcaggcccggtgcgatattttcccgctcttcgaccaccagcacgccatcgaggatttcccattccacagcacggtcggagcggttgatgatacgaaagctcgcacgtccggccggtacggtaagggcgttgggctcacaggcgtgggcgtggatcgtcaccgcgatttcattgtggttgacctggcgtttggtagcggccagttgcgaggcgtagtagaacaggccaccggcggcgatcatcaccaccaccgagccggccacgccccagcgcaaggctcgggacggaggggccgattgaggggttgggttggacaagggacggtccttactggctggaaacggaagaggtcttggcgacgggcttggcggggggcgagggcatgaagaacatcaccaacgccaccaccaggtaaatcacataggcacccagggtgctgaccgtcggcgcctcctggtagccgaacatgccggccagtactgagcccaacgggctgtccatcggcagcgcagcgctgaaatcgaacagcacggtctgccagtggttccacacgccggcctcgtgcagggcctgcaccgagttggcgagaatgccggcggccaccacgaggatgaacaggccggtccagcggaaaaacgcgccgaggttcaggcgcatgctgccggaatagatcaggaaaccgacgacgatggccaggatcaggccgagcagggcaccgatcggtgcgcccgggccttcgctctgctggaacacggccaacaggaaaaataccgtctccaggccttcgcgggccacggcgaaaaacaccatagcgatcaacgcgatcacttggtgcctggagcctgccagcgcatggtcaagggattcgtgcagggtatgcttgatcgaacgcgccaccttgcgcatccagaacaccatggagctgaggatgcccacggcaaccaggccgacgatgccttcgaacaattcctgctgcttttgcggaaattccgcactgaccaattccagaccgccgcccaccagcaacgccagggccgcggccaggaatacgccgatccacaccgccggcatccactggccacggccggtctgctgcaggtagctggcgatgatgccaacgatcaaggcagcttcaatgccttcgcgcaacatgattaaaaacggaacgagcatcgggcaccggggcgtaactagttaggaagctaagttgtaacataatgatactcattgctaaacaagaaatattgacctttgctgaaccttggctgaacggtggtggcgaagcgcaaccgcctttatgatgcacgccactgaagtagccgtcggattggccaacagctcatgtcggaaaaagacaccatctccatccacctcgtgcgtgaagccctgttgcagagctgtgcgcctggggcggccaccgttgaggcgttaagcaaggtcgggattgatcccgcattactggagcagccaagcgcccgggttgcggccacggcctatgcgcgcctgtggcgcttgctggcgcggcgcacggacgatgagttttttggcatggacccgcgcaaactcaaatccggcagcctggcgttcctgtgtcgcgccgccatgacccaacccaacctggctgcgggcctggagaccggcctggagtttctgtcgctgatgttcgagcgcatgcccgcgcagttggttcgccaacagagcctggcggagatcgtcctgctcgaacccaagccggagcccaagcgtgggttcacctatttcacctactggatgatcgtgcacggcgttgcctgttggctggcagggcgtcgaatcccaatccttgccatcgagttgcgttgtgcgcagccggacttctgtgacgattaccaggtgatgttttccgataacctgcgctttgatcgaccccgtacccgcatgatcttttctgcggactgcctggacctgccgatcaagcgcagcccgcaggagctccaacgtttcctggcccatgcgccggccaatattctggtcaagtaccgcgaccccgagagccttgctacccgcatcaagcataaccttcggcagatgcctcccgacgcctggcctgaaaccgacgggcttgcggctacgttgtgcatttccgcgtccacattgcgtcgacgcctggcggaagaaggccagacctatcagggcctaaaggacagcgtgcgcaaggaactggcgattgtgtggctggcggaaccgcagatcagctttgccgaaatcgccacgcggctggggtttgccgatgcgagttcgttctacaaggcttttcgtaagtggtcagggtccaatcccgggcactatcggagtttgatcttgaacgaaccgagtcggctctaaccgatgtgtagacagtgcgtcaagatcctccttaacgcactgataaaacgccttgggctcaagctcgcgcattgagctttaaattacttctggaagaagatacctcttcagattgataatttttttcatcaagtttgagtgtgccggcggctacggactcctcagtcgccaagagcccatcctcggggttaaaaatgattcgatgcgcccaatcaattctttctttacgtgctgccgacgaccagtgcatgcgtctgcccgacgttagcgatgggcgtcgagtattaagtcgctgggttttgcaaaggatggttgctggcaaggtttgggggcttcttagtaaaggggggataaagggtgcttacaaatttcttgtcttcttctgatattgttttcggcctaaagaccgactctccgtcactgtcagtctcgaaggtgtagtgcattattgaatcgttgtcatagggacttaatgtgagtgagccatcgtcgggaagaggtggcgtgtcttctaaatcaggatcgtccaggtttctatatgggtgctcatgttcatgctttaggccgagcacatgcccccactcatgcatgaccgtatcggctatgtgttccggggaggcgtttgtgccgatggtgacatgagcctttgcgtctggatgaagtttattttctgtgcctatccaggcatacccttcgtcgctataaggatcgacttcaattcttacatctgcgtctttggggtcggcgacgaattcaaagtttagatttacatagggagcccattttttaatgttttctctgatcaattcttcttcttttcgcgtcgtgccaaccatgcctatttttatcgtggcgccctgtggccaaaggtaagcagtgtcagcgacgccacgcttttgcctgctcttggccgaagctgtggtttgatcgtcattttgaatatcaggcgtgtcataggtcggcgggagcgggggagagtgggttgcgttaatattcaatggtaactccttagtgaaccgtcctggtgaagagcctacatgccagcgtcctatgcaagtacgtaataggtggcggtcactttcgaaatggttccgtcgaggcttggctaattcactatcgtgcgcgggcaaacgctatcggtggcgcaggaaatgcccttgtgcctctcagctcgataaggttcggttttacgtgcttcagtcagatttataaggcagcattatcggagtttgattttgaacgagccaattcagttctaacagctgttatgcaggactaggacatttctcacttattccttcatctgggtatgacagagcggtccttctatgttttaggaagcggctggcatctttggcgcttgatttcgtgcaccgtaagcaacgtgttcctacccgcattagtgggtgcttgatatctgctgggttgaaatcgagtgtcgtgtgctggcagccgttgcttaccgtgaggtgcgcttatggggaaataaaagatccgatatttcgagtgagtatttattcattatttactgatttgaggtgagatcatgaaaggtcttattgcgttgccgtgtgtcgcgttaatgcttttttctactcaggtgtcggccttgtgtctgtatataagtgatagctatagcgggcttttgcagcctggtgtggaaacgacagtgcatggcccgtttacaataacctccgcgaacggatgtgcgggtgcgactattgatgtctcagcttccacaagcggtggagggagggcgccacaattgattattcaaaagcagttgggagtttcttggcaatctgctgcgacaagctttgggagcagcgcttcatactctggatcgtttggtacctatcgagtcgctatgttcaattctgaccctgatgtgaaatcctactcaggcacagccaaatacggccgctgaaggcctgcaatggcagtgcgttaagatcctccttagcgcactgcccaaacgacttggaattcaagctcgctcatgaatctttaaatcacttctggaagaattgacgaagtaggtcaatgcacctatcgcgtgattagcatctatcatcccccgccgccaccttaaagtatcttctttcacgtctgcaggattattttcaagaaaatcattgtagtcctcaagccgctcattaaacaaagcgatggcgttgaatttaacgtctgtgtctgtagggcgaccatctgcaccactcgccaagttgccttcggcgaatattacatatgcatgtatatctatcatttcattgtcgaataattgtcgcgctacttttctgagttcattcgagcttatggctgtcatgtcaaagtcctttaaatactctttcaggtcggcgattttttttgtttcactaagattgagtgtgtcagctgctacggtctcctcagtgatcgtgaatgcattcgttatttgctcagggtttttaataacgtaagcattggttgccttggtatacctcatctgctcagcagtcaacatgatagccatgtcgccttcctccattgttaagtgacactgggttgtcgacgcttgtgccaattactttagcgtgggtgtaacgcttgcctacatgaagtgcacagttgtttctgaagtatttaaacctggaagccagatatagcgcggtactaagaaattacctacgaaggacttcttaattgtcttacagaaacagctttcaatattttaggaagttctggcaaaaaaaagccccgtgaccgaatgatccacggggctaaaaattggctggatgcgaccaaccaaaggagctctttacatcacttgctgctggcgactacggtatctggctgccaaccaccacccaatgccttgtagatcgccacgatgccgcgatacagatccacttcggcctgggcctgggaatcttcggcagccaggcgttcgcgctgggcgtcgagcaataccaggaagtccacggtgccttcgcggtagcggatcgccgcgaggtcagcggcggcgcggctggattcgctttgacggatcagcgagaccaggcgttgctggcgcttgccgtaatcgctgaaggcattctcggactcttcaagcgccagcagcacttgctgttcgtaggttgccaaggcgccgtcggcttcggcattcgcaccgcgcaaacgcgcacgcacgctgcccaggtcaaatgcggcccaggtaatgctcgggcccagggaccaggcattcgccgcggccgaaccgatctgcgagccccgcccggcggtgaagccgaggaagccgctgaggctgacccgtgggaacaggtcggccttggccacgccgatccgtgcagtggcggcggccagcttgcgttcggcgctgagaatgtccgggcgacgttgcagcaattgccctgggtcgccaatcggcaacgccttggcaatcgccggcaggtctttggggctcaggtccacgctcagcttgtcggggcgctggccgaggagggtggcgatgcgattgcgttcgcgcacttgttcggcctgcagttgcggcacgctggcttccaccgccgccaggcgcgcatcggcacgctccacgtcgagctgatcaccgacgccggcatcacgcaggctgacggtgatagtgcgcgattcctgctggttcttcaggttgtccagggcgatgcgttcacgcagttgcgcaccgcgcagctggccgtaggcatctaccagctcggcaatcatggtgacttgcagttggtacaggtcggcttcggccacctgctggtcggcgtcgctggcttccaggttacggcggatgcgtccaaacaagtccagttcccaggccatgtccaggcccaggtcgtagcgctcgctgttgacgcgcttggtggtctgcccgggaatctggcccttgcccacatcgctgctggcgcgggaggtaaccaccggcatgatgtcgttggcggcatcatcgcggatcgcccgtgccgctcgcaggcgggcgaaggccacgcgcaggtcgcggttaccgctcagtgactgggtcaccagttggtcgagggtcgggtcgtcgaattgctgccaccagatgccttcgtacttggcatggtcgtagcttttgctgtcggcggcggcggtgatattggccgcctccaactgctgggtcttgtagtccgggcctacggcacaggcggcgagcgccagtaccagcaagctcggcaggaatactttcacactcattgctgtgtctccagcttcaaggccttggccgctttgcgcgcttcctggcgctccacatagcgccggatcagtacgtagaacactggcgtcagcaacagaccgaagaaggtcacaccgatcatcccggagaacaccgccacgcccatggcatggcgcatctcggcaccggcaccgctggacaataccaacggcaccacacccatgatgaacgcgaacgaggtcatcaggatcggccgcagacgcaggcggcaggcttccagtaccgcagccagcgggtcgaggccctccgcttgtttatccttggcgaactcaacgatcagaatcgcgttcttgcacgccaggcccaccagtacgatcaggccgatctgggtgaagatgttgttgtcgccgcccgagatgatcaccccggtaatggccgacagcagcgtcatcgggacaatcaggatcaccgccagcggcaggctccagctttcgtattgggcggccagtaccaggaacgccagcagcacgcagagcgggaacacgaacagcgcggtattgcccgagaggatttgctgataggtcaggtcagtccactcataagtcatgccgttgggcagttcatccttcaacagcttttcaatcgcagcctgggcctggccggagctgtagcccggtgccgcgttgccgttgatttcagcggtgataaagccgttgtagtgcatcacgcggtccgggcccgaggtgtcgctgaccttgatgaaggttgccagcgggatcatctcgcctttgttgttgcgcactttcagctggccgatctggtcggagtcctggcggaactgttgctcggcttgcacgttgacctgataggtacgcccgaagcggttgaagtcgttggcgtacaacgagcccaggtagacctgcagggtgtcgaagatgtcgctgatcgctacgccgtgggtcttggccttttcgcggtcgatggcggcatcgacttgcggcacgttgaccgtgtagctggtgaacaggccgaacagttcaggcaccccgtggctcttggcgatgacgttctgcacttctttatacagctcgtcatagccgaggttgccacggtcttcgatctgcaggcggaacccgccaatggtgcccagcccttgtaccggcggcggcgggaagatcgccatgtaggcttcttcgatattggcgtattggccgttcagcgcaccggcgattgcaccggccgacatgctcgcgtctttacgctcgtcgaaaggcttcaaggtcacgaacacgatgccgctgttcgggctgttggtgaacccgttgatcgacaggccagggaatgcaatcgcggcttccacgccgggctgtttaagggcgatctccgacatgcgcttcatcacgttttcggtgcggtccaggctcgcagcgtcgggcagttgggcgaaggccaccaggtattgcttgtcctgggccggtacgaaacccgtcggggtgtgggcaaacccgaagaatgtcagcaccatcaggccggcgtatacgaagagggcaatgccactgccgcgaatcactcggcgcacggtgcccacgtagccatggctggccttttcgaaaaagcggttgaatggacggaacagccagccaccgaagagcttgtcgaggaacctggagaaacgatccttcggcgcgtcgtgagcgcgcagcaacacggcagccagggcaggggacagcgtcagcgagttgaacgccgaaatcacggtcgagatcgcaatggtcaaggcgaactgcttgtagaactgcccggtcaagccactgataaaggcggccgggataaacaccgcacacagcaccagcgcggtggcgatgatcggaccggtgacctcactcatggctttttcggtagccgggaacggttccaggcccagctcgatattacgttcgacgttctccaccaccacgatggcgtcgtccaccacgataccgatggccagtaccaggccgaacaatgacagggcattgagcgagaacccgaacaggtgcatcaccgcaaatgtaccgatcaaggacaccggcaccgccaccaatggaatgatcgaggcgcgccaggtctgcaggaacaggatcaccaccagcaccacgaggatcagtgcttcgaacagggtgtgtaccaccgcttcgatagagccgcgtacaaagatggtcgggtcataggcgatgcggtaatccatccccgccggaaagctctttttaagctcggccatcttgctgcgcacatcattggagatgtcgatggcattggagccgggacgctggaaaatcggaatcgcaacggcgggctggttatcgatcagcgagcgcagtgcatattggctggaacccagctcgacccgggcgatgtctttgaggcgcgtgatttcaccgttggcgccggcacgaatcacgatgttctcgaactcttcctcggtgaccaggcggccttgggtattgaccgacaactggaagctggtgtcactcggcgcaggctgggcgcccagggcaccggcagccacctggcggttctgctcgcggatcgccgtgaccacatcggtggcggtcaggttgcgcgaggcggtcttgttcggatccagccaaacacgcagggagtagtcacccatgccgaacagctgcacatcgccgacgccacccaaacgggccagttcgtccttgatgttgaggatcgcgtagttggacaggtacagcatgtcgtaacgctgatccggggaggtcaagtgcaccaccatggtcaggtcgggagaagccttgtccacggtgataccgatgcgtgtcacttcctccggcagctttggctgagtccgcgtcacacggttttgcacttgcacctgcgcgttgtccaggtcggtgcccagggcgaaggtgatagtcagggtcagtttgccgtcggcggtggattgcgaggacatgtacagcatgttctcgacacccgtgatggcctgctccagcggtgcggccacggtttcgccgatgactttggggttggcacccgggaagttggcgcgtaccaccacagtcggcggcaccacttctgggtattcgctgatcggcagttggaacagcgagatcgcacctgcgatcaggatcaacagcgacagcaccgctgcgaagatcggccgcgaaatgaagaacttggaaaaattcatcttgagtcgtatcccttaaccgcgtggagtcgcagtgctggcgagcttgggcgcagtcgtttccggcgccacttgctccaggttgctggcttcaagcgcttgtcgttgttgggccaaggcggcgagggtttccttgctggccatcggaatggtttccggcgcgaccggtgagccggggcgcacacgctgcaggcccttgacgatcacggtgtcgtccttggtcaggccgctgcgtacgatgcgcaagccttcgatcttcggccccaattccactgcgcggtaagccggcttgtcgccttccatcaccaacacgaatttcttgcccaggtcggtaccgacggcttcatcgttgatcagcacggcggaataggtgccgctgccgaccagcttcaagcgcgcatacaggccaggggtgtattcgcccttgctgttgtcaaacaccgcacggccacggatggtgccggtggacgggttgacctggttgtcgacgaagttcatctggcccaggtgcgggttgccggtttcgttggacaggcccagatacaccggggtagtggcgccgcgacggccttcacgggccagttcggtgtacttgaggaacacacgctcgtcggcgtcgaagtaggcgtagaccttgtcggtggagaccacgctggtcagcgcagtggtgtcggcggtcaccaggttgccggccgtgatttcggcacggctgacgcggccgctgatcggcgaagtgacgcgggtaaagctcaggttcagcctggccaggtccaactgcgcctggatcccggccatggcagcgcgggcttcctgggcggcggtggtgcgcgagtcggccagttcggcggaaatcgcattgctctggcgcaggcgttcgccgcgctgcgcttcgttttcactgcgggtggcggccgccttggtttgtgcgagctgggcttcgagacgacgcacttcagcctggaaggggcgagggtcgatctggaacaacaggtcgcctttcttgaccaaagcgccttctgtaaaagcgacttggtcaatctggcccgagacccgaggacggatctgcacggtttccggcgcttcgaggcgcccagtgaactcgtcccattcgttgaccggttgttccagtaccttggctacgctgaccttggctgggggcatggcggccgcttgatccggggtcttgccgcaggcgctcatcaccaccacggccaggatcgccaaggggaagcgcaaatgtttgagtgactgttccatgaggtgcatccgccaatgtatttgagatgggcggatcatgcgcggcgaggtggtatgtcacgaatcgaatgaagcaaaggtaactatcattcggaatgatataagcgcgtacttagctctctagcatgggggtttcgttagggtgctatcaataggcgtgatgacaaaagactattgccgagcgtgcaaggaacctttgcggcttttggtcttcggctttttctgcacgtcaaccttgagagcggagcgggtgcggttgtgagcgtcaggagccggacttgactgaatctcgtgcatcgaacgcctcgcccaggaagtcgatcaaggaccgcaccgatggcatcagcccacgcctggatgcaaagacgacggtaatcacaccttcggcaggctgccactcaggcagcaacgcaatcaggcgtccatcggcgatctcatcggccacgacggcgatcggcagattggcgatgccgacaccacgcagtgcagcgtttttcagggtcgacatgtcgtcgctgaccagccgcggagtgtgctggacctgcgccgtcgcgccttgcggaccgttcaactcccacaggtactgcgccgtcgggttgccccagttgatagtgggcagcccggcgatgtcggcaggttgcaagggcaggggatgggcctgcagaaacggtgcgcttgccaccagtgcctgtgggcttttgcccagtaccttcatgaccagctcgctgctttccagtggcggaaaacacaggctcagtgccaggtcatagccctcgctgatcacatcgaccttgcggttgaagctttttacattgagttcgacgctagggcactgtgccatgaattctgccagcatcggcgctacccagtggttgagcagtgcagtggtgcaactcaagcgaatgaccccacgcggctctgacttgttgaacgcaatcacgtcctcggccgactccgcctcggcaatcatcgcaacacaatgccggtaataagcctggccgatatcggtgacctggaattgccgggtggagcgctgtatcaggcgggcccccagccttgcttcgagttgaccgaccctgcggctcaaggtcgacttcggcaggtcgagggcacgaccggccgcggcaaagccgccatgttcgacaaccttggcatagaggaagagttcgttcaggtcgaacatcggcagcgttccagttttgagatggtgaagcttaattgagccactaccgaacggccagtgtggtgactaaggtggcccctccacgtaagaggacatgccaatgagcgcatcaggtaacacagcaaactttaatgggcaaaagccgaccattgacgctgccgatacagccatgctgctgatcgaccatcagagcggtctgttccagatcgtcaaggacatcgaagtgcctcaactgcgtgccaatgccatcgcgttggccaaggcggcgaccttgctgaacattccggtcatcaccaccgcttctgtgccccaaggccccaacggcccgctgattccggaaatccacgaagcagcgccgcacgcccaatacgtcgcccgccgtagtgaaatcaatgcctgggataatcctgagttccacgccgccgtcaaagccaccggcaagaaaaccctggtgatcgccggcaccttgaccagcgtttgcctggcttttccgtccattgcagcggtgcatgaaggctacaaggtattcgccgtagtggacgcttcgggcaaccactcacgattggccaccgacctgaccgtggcgcgcctggcacaagccggggtggtgccgattgacatcatgggcacgctgtcagagctgcaaggttcgtggaaccgcccggatgcccaggcgtgggcgaatgtctatacccaggccatgccgcactaccagcttttgatcgagagctacatcaaggcccaggaagtggcaaacaaccatgaagcactagactcagagcgcaagtaaacacgctgggttctttgcggtgcgcacatttcgatgggcaccctttctatcaggagcatcatgatgtctacaccttacgttcgcttggacaaagacaacgccgctgtgctgttggtcgaccaccaggctggcttgctgtcgctggtccgcgacatcgacccggacaaattcaagaacaacgtgctggccctggctgacttggccaagtacttcaagctgccgaccatcctcaccaccagtttcgagaccggccccaacggcccgctggtgcctgagctcaaggcattgttcccggatgcgccctacatcgcccggcccggccagatcaacgcctgggacaacgaagacttcgtcaaggccatcaaggccaccggcaagaagcaactgatcatcgctggcgtggtgaccgaagtgtgcgtggcgttcccggccctgtcagccctggcggaaggcttcgaggtatttgtggtcaccgacgcctccggtaccttcaatgaactgacccagcaatcggcctgggcccgcatgtcggccaatggcgcgcaacttatgacctggttcggcctggcctgtgagctgcaccgcgactggcgcaatgatattgaaggcctggggacgttgttctccaaccacatcccggactaccgcaacctgttcaccagctacaacgcgctgaccacgggcaaataagcctggcaggggctgtgctggcgcccaagccacgcagccccgccgtctccagggcctccttctcaggaatgctctatcaccatcaccgccgtggtatccgcctcgaatgcttcgaacacatgcggcacatttgccaggtagctgatgtagtcgccagcgttcagcaacacaggcccgcttgccgggcctataagggcgctgccactgcacaacactacgtgctctacggtgcccgaagggtgaggctgagacagccgcacttcgccgggctgcaccttcagccggtagatgtcgcgttgtacccccgcagggcaatcggcaagcagtgtcgctgcgtaattggccgtctcggcataggcggtcatgccctcgttggcgcggatcacccgcagcgtctgctggggttgctcgaagaaccgggtgacttgcaaacccattgccatcgccagcgcccataaggtctcgatgctggggttaccaatgcccgactccaattgagacaaggtcgacttggctactccggcgcgtttcgccaattcggtcaaggaaagcccggcggccaggcgctcgcgtttgatggagagtgcgagcaggtcgattcggctcggagtgtttatggtgttcggtatgtcggtcatttgttttataaatcatcctttaatgagttgacgcttttaatcgccttgttcagtatagcgttcgatagttcattataaagttcgaatttgcggctgtactgcctatggcggctcaggttacggcaatgtcgagagcaaggaagcagtgagtgatgaaggcgcaaacccgcggaaccctcgaaatgatctcggccatggtgatctccggcacagtgggctggttcgtcgtcatgtcggggcagagcccggaggccgtggtgttctggcgttgcgtgttcggtgccatggcgatgctggtgacgtgcctggtgcttggggtactgcgccgctctgtgatcagcctccggcagttcatgctggtgtgcctgggcgggctggcgctgatcctcaattgggtgctgctgttcagtgcctacaaacactcctccatcgccattgccacggtggtctaccacgtccagccgttcatgctggtgggcctgggcgtgctgttttttgccgaacgcctcagcaccgccaaggtcggctggctgctgttggccttcgccggcctgatgctgatcgtatccgccaagggcagtggccaggccacgggtgccgactacgtgctgggcgtctgcctggccctggcttcagccttcttctatgcggtggcggcagcgatcaccaaacgcctcaaggacctgcccgcgcacctgatcgtgctgatccagatggtggtcggtgcgctggtcctggccccgttcgtggatgtgggcagggtcgatacggtggaaggcgcctggacgtacctgatcattatcggcgtggttcataccgggctcatgtccaccttgctgtacagcgccatccagaaagtccccacggcgctggtgggggctctatcattcatctatccgatcgtggccatcctggtcgactgggttgcctttgcgcatccgctcagcgtcctgcaagtgatcggagcgagcgccatcctgctggcggctgcgggcatgaacttcggttggtcgctgggtcgcgccccgcgtcaggaagtgacgtaggggcgcactgagaccctcacggcatcagctgagtgttggacagcccgtattcccccaacgaatacagcaaggttccataccctaactgatcgtagccaccgctgttcggcccgtaatcaccgccaccaccttccacctggaccttctgcgcgaaggctttcacgtacggcgccttgaggcctttaagcacgacgtagtggttgtagagcagttcccagatcggacggatgtcgccgcgatgttctggcgagataacggtttgcttgaaaccgttgttgataaagggggtgaatggcacgtcgtggcccaggttgtacttggccacgtactcggcgccttgtagcacgcggttgttctggtaaccgaacaagtcctcaccctgactccaggccatttggcagaaactgccgagcaaggcgatatcgagcaatgtatgcgcctggtcacgcccgctttcctgggtttggcccaagccattgccgtagagcttccaaaccacgtgctcaatggcaccgttgccagcgccatgtttgaaatagttgaccgcttcatcatagatatcgcggcggtcggtcagtacgccaatcgccagcatcgagttcatgttcgccaggtcccagttcgcccaatagtggtcgaccagcgcgttattgtgacgtaccaggaaatcatgattcatcgggtagaagaccgtgagcatcatgcgctggaattgatgaaagtccgcagccgtccaccttgaataaccgcgcagtaactctgcggcattggcgagttgataaccatacaaaccggatgccaggaaacgatccgatgtgccttcaatcgccgtcagggtggtggaccattggttcaacatcgctacggctttgtcggcatacgcggtatcgcccgaaagctgccagcgcagggccaaggcgtacgcggcggcagcgtcgttgaataacctggcgtagttttccggatgtcggccatctgcgccccgatacaccaccgcgaccgggttcgggttccaggccagggaggcgtgccggttggcgatcagcttctgccagccggccagccacggctggttatggttggccagtttttcgcggatgcgtatgaagtcctcctcggtctgcaacaggcctgggtggacgaacgcggaggcttggacaccgatactcagcggcagcgcggcgagcatcaggagacggccccaagcacggaacaattgagcaaaacccggcatgcctggcgcctcgttatcagaaggtgtagttgatggcgaacatgcccaggccggcgctctcacgtcggaccagcgggctgttacgggcctggtcggcgtactgggtcagcgtcaggctgaccagcgtcgaccagtgtgcgtccaggctgtgctgccagttcatggcggcggagtaggcgtagatcccggcatcggcgctgtattttccatagagcgaacgctggctctgtgcctggctgacgccgaagaaggtctggttgtagcggccatcgccggcatgggcgtcaatgtccagggccagggtgtcgctgtcggtatgcatcaggatgccttccaggccaaagcggtaacggttgccacggtgctcgccggccatgcgcagttcggcttcgccgctgaccgacagccagtcaagcagttgctggctgagggtgaagtcggccacggtggcgccgttgacatcgcccatgccgttcagctcgcggtcacccgggcggctggcgctgtccttctccttgcgacccaggtcgtagttgatcgccgcgctggcgccaaagccgctgtcggattgaaattgcaggcccagcccacgggtggtgtcggcgaacagcacgccacgctggatgctgaacatcggcagcacaagcgcgcggtagcggtcggcgcccatgtagcgcggcgtgatccccatgccaaggcccagggtagtggtggttttgtcggctgccgggctggcgtcggccgcctgtgccggggccgcgagcgtgcaggccatcaatgcggcggcgccccatagcgcggtacgggtaggaggagtggtcaagttcatggtgaaaccctttcagcggaggaaaatagcggtgcgccggacagcgtggcgaccaacagcaaaaccgcgccaagacgttcaggcagctggataggcttggacagcgatgcagtggtcggcataggatcggctcgcgaaagccgggcgtagggcaatactgcccgcggactttcaataaaccgttcgtgaattatcaaggtttcatcaagaggcttctttgtgtcaggaaaacgtatcctcatcgtcgaagacgacgccgacagcgccaacattctcgaagcctatctgcgtcgggacggttttgaggtcgccctggccgaagatggccagcgcggtctggacctgcacaaaagttggcggcccgacctgatattgctcgacgtaatgctgccgcgcttgagtggcaccgaggtgttgtctgcggtgcggcgcagcagtgatacggcggtgatcatggtcacggcaatgggcgacgagccggaaaaactcggcgccttgcgctatggcgcggacgactatgtggtcaagccctacagcccacgcgaggtggtggcgcgggtgcacgcggtgttgcggcgtaccacgggcagccaaccggtggaacagttactgcgtcatgaaaacctgcgagtggacctcatcgcctttaccgcggccattgaataccgcgatgcgccgtcgcagttgctggacctgacgccgacggagttcaaactgttggtcaccttgctgaagaccccctccaaggccttcacccgtaatgagctgctggaaatctgcttgccggaaagcgaagccctggcccgcgttgtcgacgcccatgtgcacaacctgcggcgcaagctcgaaacccatggcatcgtcggggtactggtgacggtgcgttccatcggctatcgattcaggtgagcaccatgcttgagaactcacgggtcaacgacaaacccctgtggcgctgggtcggcatgcgcatgagcctgttggcgatcggcgcggtggtggtgatcgcaatctgcatgtggatcaacttcagactgtcggaccagtactttttgcagcacctgccgccagcggcgcgcgaggagttgctgcagctgcgcgtcgagccgcagctcaatgagacacgcttgcgccaactggttgctgaatattatccggtggaattcttcctgccggacatggccaaccgcgactggctgattctggcttgcctggtgctggcagctattccgatcatcatcgcctgtggcttgtggttttcgcggcccttgtccagccagttctcggcgattgcccagggcgcgcgacgggttgccggcggtgatttcctgacgcgcctgccggttcatcgcgacgcacccgatgagctgcagcgactgattggcgacttcaacagcatgacgacgcaactggagcgctatgagcgcgatgtacgcgagtccagcgcggtcatcgcccacgaactgcgcacgccgttgaacgccgccatgggccgggtgcagggcatgctcgatgaggtgttccccagcgatgccgcgcagttgggcatggtcaagcgccagctcgatcaactgcgaaaactggtggatgacctgcacctgttgtcgatggcccgggccggccggttggtgctggagcgcagcgatttttccttggcggccctggtcgccgaacgactggcctggttccagccgcaactgaatgaggcccgcgtgcgtgcgcaggtcagcattgccgatgggtttcgtctgcatgccgatcgcgatcgcctgggccaggtgatcaatatcctggtggataacctgctgcgttacgcggctagcgggggcgaattgagcgtcacggcgcataaagtcgaagaccgggtggtgttagagatcggtgaccgcggcccaggtatcgaggttcagcacctggacagcgtatttgaccgcttctggcgggcggagcgctccagggcgcgttattcaggcggcagcgggctgggcttgtccatcgcccgcgcaatctgccatgcccatggcggagccattaccgccagcaaccgcgccgaagggggcacgctgatccgggcggagtttgcgctgtagttttttcgggctatatgtctatggctggataactattaaataaaggtaaatatgccgtcgacggcggtcattcgagcgcctgagaaaggaggggaagcagtgggcaaaacaacgaggagttgctaaggcgtaagccttcctattgaaaggcttacccatcaggcggcgttcttagccgacagacttcaagggaataggccctttgatcctttccatcatagtggcgcaataccaatcatcgaattggcagacaccggtctcggcggtttcggagtacgggcctggctcataagagggtgaggtcacaccgcgctgcgtgccttctacgagggtacggtcctgatcgttggtagcgatccataccttggtcaatcgatcaatgtcgtagtccacgccttctacggcggttttaagcaccagccatttcgtggtcaccaaggtttccgtcgcgctgatggggagcacgcggaagctcagagcgtggtcccccaggaagtggttccacgtcgacggatagttgaagtacagcagtgcgccgatatccgcttcgccggtggtatccaggcggctggtgaccgcgggcttaccgtccatggtatagctcaccgcgcccttggacaatgggatgcgggtcatgcggaactggccgttgatgtccatcaccaagcgacttggcaagccgactttttcgcatttgttccagtaagcggaaagctccgggtcgtcgccgccgctggtaccgcccacagaaaggttgtccacgaacgattgcagcaactcggggtgggagccgtcgcagtgatagcactcacggttattttcgaagaccagtttccaattgcccttctcgacgatattggactcgaaggccactttgcaatcatcgagattgtgcggggcgacaaagggtgtcacggcggtacggaagctctcgaaatccggtgctttgttcgcgacacacacataaataaaggtgttcacgatttcgcaatgaacgctttttaggttgtattcggatttgtcaaaatcctggcccatgttcccggcgaacagcagattgccgtccaactcgtaggtccacttgtggtaagggcacaccatcttggcgactttgccatggtcggcttcacagatttttgccccgcggtggcggcaagcattgtgaaatgcacgcacttcgccgtccttgccacgcactacagccacaggatagtcccccacttgcagcgtgaagtattgaccaggcttttccaattcaaatgtgtgccccgcgaagatccagtctttgtgccaaatctgctctaggtcctggcgatagacgccttcgctgctgtagagctttcccgggagtgagtgccaaggtttacgttgggcaatcaggtcaaacacagtttctttattatccatcttatcctcccaggataaataacgtgagcgctcacctttaacggtgacttttatagtgctctaaaagattggtatcggttggcagcttaataaaggtgcaacaacttcatgttctttttagatagaggacagcctagggggctgtcgcgacgcccgcaaacgacatttcgtaggggcaatcaataatttcaggttatcgatgagccccttcctcggaatgcgtaacccttgaaaatataggctccagcgtcgtaatggctgagtgcgcctgactcaatgaatgaatcgcgtgcttcaccgcaaggcttcgttcaactccaagatggctactgaataggtcgaattttccatccagttcagcggccgtcatcgcggtatgcggatcaccttttgccgcagtaacagggctgacgatgatcgtaccgtcttgcaaggtaagggtaagtctggaaagaatttcatccgggaaacgcgcggaaatatccgccgcttcgacaatctcgatgcgtgaactcagcgagagaatatcgggtgcggtgattgagttccccgtgacctcatcaggccccactttgcctctgacaatcagcgctgcaagcggaaacgccaacgcgtattgggcttcatctgcgttgcgtggggtatgaccctgcaggcacatcgattcgaagaacgtctctacacggattgtttcaatggtgtcagcgctcaactcgggatgctggcgctgtatttcaagcatcgccgtcaaggcgggttgcgcccatctgcacacgggccagggcttgaagtactggctatcaatttcccagtgttcccccatggcggcccaatgtgccgcgacgcttgggtcctccacggtttcagcgggtgcgccggtcatacccgcctgcgccatcaacaatgcattcaagccaacgtaaacacctgctccatgtgcatcgcgcaacatggtcggtgccagcaccacacgcatcattgggcagcgtgcgctgaaatactcggcaatgcccaaagcgtgccgaaaggttggctcatcaaactcaagcaatcgtgctccagcacacaccacccccatggcggtaaaaccaccagaggcgtggtaggtgggcgaggttgccatcagtgcagtgccagcgcgcagcgcggtttcatagccaatgcacagcgccgacagaaattcgtgcccgctgatgtcctgtccgttgtggtgcaatgcatcggtcaaggccagcaacgccggaaccaccgttgcgccggcgtgccctttggatttgaagtgcccttcgtgagcgtccaggctgtctgcggaaaatccgccagcccaggcggctccaagcatactcacgcgctggccatcgaacatcagccggctggtgtacacaccaccggggtagtggaggcgcgcatagctgcgcattatctcgctggtgtcattggatgccgcaccggccatcacaccgacgatatccagcaggctatttctgagtatggcttgcgtgtgggcgggtgcttgctggagatcgaaatcgcgacaaaattcgaacagtgacatcccgggcattccttacgaaaattattatggtgtcgctgcacgatggcccagcgagggctcaccgttccagcaacattttcgtagggcaatcgataacaaaaatgacgactatgcttctaaggcaggcggcgtcagcgggggaacttggccaggagccactcacgaaaccggcgcagctcatcttcgttctcggcgttttctcggcagctcaagtagtgcgaactgttgcgcagctgaacttgctgctggatcggtcgcaccaacaccccacgctctaccagccgggtaaccaggtgattccaacccagggcaataccttggtgggtcagcaccatgctgatcagcaagttgtagtcgttggcattgaaaatctgggggctttcttgcgggcgatcatcaatgtcaatcgactgaaaagcaaaccagacaccccagtcaacgtgctcggctacctgggatcgtccgtaggggctcaggttcagcagggctgagtctctcagaccttcgatcgtcgagatttccgggtgttgctccaaaaatttcgggctgcaaacgggatagatcacgtcatggcacaacgggtagcttttatagtcgtcccggacacgggccattttggtaatgaagacgtccggctgtaccccgggctccatggtcaggaagttctgcgtcgtgaccaggttcaactcaatgccggggttttgtctgatgaattcgggcaggtggtctgacagccatagggcggaaaaggcgggggagcagcagacggtcagcatttttttggaggactggctgctgcggattcgctcggctgcctgggcgatgtttacaaatgacagctgcgcggcatcaaagaacactgccccggcagaagtcagttcgacagcacgccctacgcggttgaaaagctgcgcacccaggtactcctccagctcgcgaatctgccggctgatagccgcctgcgaaacacaaagcgcctcggcgccaagggtgaagctctcgtactttgcagccgctacaaatgctttcacggccctcaacgacggcattttcagcagaatgctgtcagggtcgacatgctttgacatccttacgttctcctcatgcagccgctccccaacgaagcgacgcgagagtaactgaagccagacggtaaaaacggcgtgcaggtcgtttttgagacataacgggtcgcgcctgggtgccgcagccagaaaactgtccgcttgagacgacctataacccgacgttatccaattgtccccctaaatgtagttggaattgacggtgtgttaatactaaatttgaaacatccctctttcctaggggccgaaaaataataaaaggaaacccgtcgtgaaactccctattcattaccgctgccgtttaaaactattttcgatcgtttacgtatcgcttaaagcgaatagtgctgaacacgaaggggcaaggtatgactaattccgacgaaataatttccgtcaaaaatgtctataaggtattcggcactcagccggacctcgcaatgaagttgttggctgatggggcctctaaagaagaggtctttaaaaaaaccgggcaagctattggcgtcttcgatgcgaacttctccgtccgccgcggcgagatctttgtcatcatggggctgtcgggctccggcaagtcaaccatggtccgcttgttcaaccgcttgattgaaccgaccagtggctcgatctttctgaatggtaaggaaatcactggtctggcggataaagatcttctgcaagtgcgcaggaaagacatgggtatggtctttcaatcctttgcactgatgccgcacatgagcgtcatcgacaacgtcagctttggtttggagatcagcggcgtcgccgagaaagaacgctactgccgcgccatgggtgcgctgacccaggttggccttgctggtcaggaattcagctttccccatcagctctccggcggcatgcaacagcgcgtcggcctcgcccgagccctggccaatgacccggcgatcctgttgatggacgaagcgttttcggcccttgacccaatgattcgcagcgagatgcagggcgaattgatcaagctgcaggccgagcagaaccgcaccatcatctttatttcccacgacattgaagaggccgtacggatcggccaccgcatcgcaatcatggaaggcggtcgggtggtgcaaattggcaccccgcgtgagttgttgtgcaaccccatcaataaatacgtgcgcgatttctttaatggattcgacaccagtcgaattctgaaagcgggcgatatcgctcaacaggacaccagcattacctatgagcctggtcgtcacacccctttaagagcagaagcttcgctcagagagattctgcatatcgtcgcggcctgcgcaacgcctatgccggtggtggatgaagttggcctgtataagggctcgatttcccaaggccatcttctgagctgcctgaataatagttaatttgaataatcagagcagtctcaagttctgagggcgaggaagtatcatgtcggactttaattatttggacccgttccaaagtttcactgttccattgggcgcttgggttgaagcggcactgacttacctggtgcataattttcgggaagtcttccgctcgattcgctggccggttgaccaagtgcttgatggtgttcagtggggcctgctttccgtgccccccacagtattcattcttatcgccggattggtcagttggcagatcggcggtaaacgaatcgcaattttcagtatcgctacattgaccggactaggcttgatcggtgtatgggccgatgccatggtgactctcgctttggtcctgacttcattactcttctgtgcggttattggtattcccctgggcatcctctgtgcccgcagcgaccgaatggaagtgatcgtgcgtccggtgttggacgcgatgcagacattgcctgctttcgtttacctggtgcctgtggtgatgttgtttggcatcggtaacgttccaggcgtcatagtgacgattattttctcggttgcgcccttggtgcgcctgaccaacttgggcatccgccaggtacccgccgataaagtcgaagccgcacgtgcgtttggctgcaccgccacccagatgctgttgaaggtccaactgccccttgccgcgccgaccatgatggccgggttgaaccagacacttatgctttcactttcgatggtcgtcgttgcttcgatgatatccgttggcgggcttgggctgatggtattgagcggcatcggccgcctggacatggggctggccagcgtcggcggtgccggcctggtactcctggcagtcttcctcgatcgtttgacccaagcgatgggcgagcgcagcagtgatctggcaaccggccagcgttggtacgaaaccgggccggttggcctagtgatgaaactcaagaagaaaaagaacgtagcacgcccagtgactaactaagcacatctgctcacctactataaattcaagcgtggtgaaatatgaaacttgcaaaccttaagcaaaccgtcgtcgcgacgctgatggcctccatgttgggtgcaactatatgttcggtagcgtatgccgctgatgcaaacaaaccgggtgacggtgtttccatcacgcctattttcccgaccattgctgaagaacgttttcgcggtgaggtggccattgcaggcttgaaagaccttggctatgacgtaaaagcccccaaggaagttgactatcccgcgatgttcctggcgctctcctatggcgatgcggatttcactgtccatgagtgggagaacctgcacgcgggcttttacaagaaagccggcggcgacgacaccatggtgaaagttggccaggtcatgaagggcgtgctgcagggctacatgatcgacaagaaaacagccgaagcctacaacatcaaggatctctcggatttgaagaaaccggagatcgcgaagttgttcgacgccaatggcgatggcaaggcggacatgaccggttgcaaccccggctggggctgcgaagtgatggttgaacaccacatgaaagcctatggcctgggcccaactgtcgtggacaaccggggttcctacttcgcgctgatggctgacactatcgccaggttccaacagggcaaacctgtgttgtatttcacctgggtgccgcaatggatctccagcgtgctggtggaagggcgcgacgtcgtatggctgccagttccattcacctcgttgcctgatggcaaagacaataaagacaccttttatcagggtaaaaatctcggtttcccagtggataccgtgaatgctgtaatgaacaaagagtttgccgagaagaatccggtggctcgcaagtttctgtcagaagtcagcattaccacggacgacgaaagtgcccagaacctgcgcatgcaaaagggtgagaaatcactcgctgacatcaagcgccatgccgccgaatggatcaaggctcaccaagcgcaatacgatggctggttgagtgacgcgcgcgcagaagccaagcaatagaaaacagcaaggaaagtacggccagctcgattgagctggccgtaggcgggaccggctgcgtttgttttacgtaataaaatgatcaggtggcgaagataatggataccttccaaagcgcgttgaagttacagaatattggatttcagcaaactaccgagtcggtcggtcatgaaagagttgtgcgggtggcatttattttgctcgaccacttttcattaacctcactctcaacagcgatggacgcgctggcgaccggcaacctgatcaacagtaagaccgtctacaaagtatcgacgtattcgctcttgggcggtttggttggaagtgatatcggcataccgctgtcttcggaaactttgagcgttgaaaaaatcaatcacgatgcgctgtttgttatcggtggtcagcgagtaaggctgtccagcaaccccaccattcgccgcgtattgaaaaagacggccgggggaaggggagtcgtcgctggtgtatggaatgctgcgttttacctggccgatgcgggcctgctcgatgaccagtattgcgcctgtcatgccgatagctgtgcgttgatcaacgagtattacccccaagtgaaaacgggggaggccgaatacacctttgcccagcggcgcgcgacgtgcgccggtgcctcatctgctttggatatgaccctggcaatcatgcaggacctcagctcacagcacgatgctgacctcgtggacgaaatcaaacgtgtacatcaacccaaaaagccgccattcaacgatgtaacccttggtgctgtcagcctggttaaaccggttcctcggccgctgaacgttgcggtctcactgatggaaaaccacattgaggaacccatggagatcgatgagatcgccagtcacgtgggggtttcgcgtcggcagcttgaacgcaggtttgcgcgctatttaaacgcggcgcccaaccgctactatctggagctgcgactcacccgcgcccgccaactgattattcaaagtaatcgctcgttgacggatgtggcactcgctaccggttttgtcagctatccgcacttttataagcgcttcaaggatttgttcggcctgccgccaatgacgttcagggataactattattccagcgactttagcaattcggaacgctatgcaattgcggcaggtttttgaaacgcatttggccgttgtgtagtcggttagttatttagtttatttcgtcctgcgcattgtgttgtgttggacccggtaatgcatccaactttacggtcctactattatgaaagttacctccctacccgccgacgataatagctgtggctggtttcatttaagccgaccgcgcaagccgaaacccgcccacgaggggcacagcactgcccgttgggtgattgttggtgcgggctttaccgggctggcggcagcacggcaactggcgttgaactttcccaatgtcgaggtcgtgctggttgaggctcaggaggtgggccttgggccatccggcaggaacgccggattcgctatcgatctgccccatgatatcggcgctgaggattacatcggcgacatcgcccttgccaagtctagtctgaagctcaatctggcggggcaatccattctgcgcgacttggtcgatcaacacggcatcgattgtcagatgaaagcctgcggcaagtaccaggcagccgtggaggaccgcgggatcgcggtactcgaagcctatcggcgtgggctggataagttggagcaaccctatcaaatgattgagcaagatgagttgcctaatcatctgggtacgcacttctaccgtaaggcgttatacacaccgggtgccgtgttgcttcagccgtcggcactggtcaaagggctcgctgaccatttgccagccaacgtgacattgtatgagcgtacgccgattctcgaagttgagtacggtgcgaaaaccgtactgaaacatgccaatggaagtatcaccgccgacaatctgatcctggcgaacaactcttttggcatgcgctttggtttcctcaagggccggatgttgcccatctatacctacggcagtatcacgcggcaattgacgtcagaagagcaggcacaactcggtggaaaaccgtattggggcgcgatcccagctgatccatttgggaccaccgtcaggcgtacaccggataaccgcttgctgatcagaaacagctttagtttcaatcccgacggccgcagtgacagtcgatataacgagcgattcatacgccggcataaagcctcgtttgataaacgctttcccatgttgcccaacgtcaattttgaatacacctggggcggtgcattggccatgactcgtaaccataacggtttcttcggtgagttggctcccaacgtttatggcgcgttgggttgcaatggcctgggtgtgacccgcggcacagtgacagggcaattgcttgcagattggctcgctggccaacgtgatgaacggatcgactttctattgaacgcaccagggccgaacagtaacccgccgcagccgtttctctcgttgggcgtcaacgcaaacctcaaatgggggcagtaccgcgccggtcgagaaagctgaggtcactttagctggctattgcaagcactaaggataaggacaagaaatgaagagcgctgttgtttcaattgaagacgtcccgctgaatgggtttcatcggctactgactgttcgttcaggcggcggttcctttgttgacggatacgttctgagtattatcggcgtcgcgctgatacatatgtcaaagtccctggcgctggatgatttctgggagggcatgattgccgcctccgcactgatcggaatttttttcggtggcttcctgggcggttggttgaccgatgtcatggggcgaaagcgtctcttgtttgcgggccctaccttattcatcgtcgcgtccttggcacaatattgggccgagtcggccgtcgttatatttttcctccggttgttgttgggtattgccgttggtatcgaatacccagtggcgacatcgttactcgtcgaattccttcccaagaaataccgtggcccacgattggcgatgctgaccatcctctggttcgccggtgccgcgaccgcctacatcgtcggcgaagtcatgttcaacgcattgggtccggatgcctggcgactggtactggccagcgccgcagtgatcggcgccctgttgtttaccgtgcgtctgggcacgccggaatcaccgcgttggctgatcaagcaggggcgaacagctgaggccgaggcgattatcaagcaggtgtatggcgagcatttctcgctggctaatctgcccgaggaacctgccggcgaaaagatcacgatcttaaaccttgtgcattccggttacggtaaacgcatgttgtttgtggtggtgttctggacctgctccgtcgtgccgctgttcgctgtttatgcattcgcccccaaagtgttggcggcgctgaaaataagcggtgattcagcctcgctgggctcggttgcgatcacattgttcttcgtcatcggctgcattatctccacccggataatcaattcgatcggtcggcgaaatctgcttatttacagttttctgtgttcaggtttggcgttgttgggtctggccatcggccatgcgggcccgagccttttggtgctgttctttttcgttgtgtacgccctgtttatcggcggcgcacaagtgctcacactggtgtatcccaatgaactgtttcccacagaaattcgcgcatttgcggtcggcgtaggcacgtcgctctcacgcatcggtgccgccgcgggcacctacttggtgcctatctcattgagcaagttagggatcgccgagaccctgtatgtcgccgccgccatttcgttggtggggctcgtattgtcttgggtgctggcgcctgaaacacggtcactcaacctgcaacaagccgcctcgttgaattagcaatccctggatcaaccttggaattactggagaaaacagcatgaactttgacggcatttttacccccgcgataactccgctctcttcggatggtcaagttgattattcggcctttgatgaagtgcttgaatacctggtcgagtccaaggttcacggcatcattatcggcggctccacgggtgagtattacgctcatacgcctgctgaacgtctggcggtggctgaacgtgcaaagagtgtcctgcaaggtcgtctgccgctggttgtcggcaccggcgggatcagaaccgaggattcggtgtacttcgctgaacaagccaaggcgatcaaggcagatgcgatcctggtgggttctccgccttatgccttgcccacccaaaaagaaatcgccgcccatgtgctggcggtagacaaggcagcaggcctgcccatcatgctctacaactacccggcgcgtatgggggtggccatgggggatgagttcttcgaagcgattgcgcagtgcaagaacattgaagcaatcaaagaaagctccggggaaatgaatcgcctgcatcgcttggcctgcgcccatccttcgatccagatctcgtgcggttgggatgatcaagccctggagttcttcgcctggggcgctcgcagctgggtatgcgccggctccaatttcattcctcgcgaacacgttgcgatgtatgaggcctgcgtgattgaaaaagacttcgacaaaggccgccgcatcatgtcggccctgctgccgttgatggacctccttgaaggcggcaagtttgtgcaatcgatcaagcatggcagtgaactgagcggcttgcgtgccggtggtgtccgtgcgccattgcaggcgctggaagagtccgagaagcaggcgctcaaagcggtgatccaaacgcttaagcaaaacgtcgcgcacattgtgggaggtgcttgaaatggctggtctgctgagtaaagaagcctaccgcgaactggccggcaagcttgagtttcgcactcaggcgtttatcgacggccagtttcgcagcgcgaaatcgggccgcacgttcaccaccaccaatccggccaccggtgacgtactggccgagatttcggcctgtgatgcccaagacgtaaacgtggcggtggcggctgccaaggcagcgtttgaagatgcacgctggcagggtctttcacctgctgcacgtaaaagcgtgctgctgcgttttgcccagttgttggaggacaactcgcacgaactggcggtacttgaaagcctggacagcggcaaacccatccgcgagtgccagaacgttgatgtaccggagacgatccacacgctgcgttggcacgccgaactgatcgacaaaatctacgacgctactgcgccggtgggttcgggcgctgtgactatggtggtacgcgagcctatcggcgtggtgggcctggtgctgccgtggaatttcccgctgctgatgctcgcctggaaaatcggcccgtcgttggctgcaggttgctctatcgtggtcaagccggcaaaggaaaccaccctgagcgcgctacgagttgctgagctggcttaccaagctggcgttcccgccggcgtgttcaacgtggtgcctggtggtggcaaggaggcaggtgaaccgttgggccggcatggtgacgtggccatggtcagctttaccggctcgaccgaaacggggcggattttcctcaagtactccagtgaatccaacctcaagcgcatcgtgctggaatgtggcggaaaaaacccagcggtggtgatgaatgacgccgaggacatcgaccaggttgcgcaacacgtcgtgaacggcgccttttggaacatgggcgaaaactgctcggcatcttcgcgcttgctcgttcataccgacatcaaggacgtgttgcttgagcgtattcaggtgcacctcaaagactggaaaatgggcgacccccttgacccggacaaccgtttgggttctatggtcagcaaagcgcattttgagaaagtgcagtcctacatcgaccatgccaaggacgaaaagctgactgttctggcgggcggaaataccgttgataatatcttcgtagagccgactatcctggacggagtagggcgtagcagtcgcctgttccaagaggaaattttcggccctgtgctgagtgtcaccaccttcaataccctcgatgaagccatcgaactggccaacgatacggcctacggtttggctgcgtcggcgtataccggcaacctgcgcaatgcattgaagctgtcacgcggcattcgcgccggcattgtgaccgtcaactgttttggagagggggatgcgtctacgcccttcggtggttacaaggagtcggggttcggtgggcgggacaaatccatctgggcgcacgaccaatacaccgagataaaaaccatctggatcgacgcctcctgagtgctgcagagggcgtgacggccttatcgccccagtcgcgggactggggcaatttcgaggcagtaaagggctggggcgagctgggaagcaaccgacggagttgtcgtgaagcgcgagcagggtctctacgaacggctgaagcaacagatcctgacattgcaactgccgcccgatcagttgctcgatgaagtggcgctaagcgctcagcatggcgtttctcttacgtctatcagggatatccatctgccggtcaggtgaaggatacggggttatccgatctcatcatggcgccagagtcagctcattggggcaggcaaatacgccgcgactttttgattgggcattatgctggggcattcttttcaaaccatccaaagcatgccctcagatcggccattatcgccagaggcgcaccatccgacgtcttttattcctccgatcagcatacctcgccagagcggttacaaggcaagacctcatgagcccgccattccttaataagttggcgccgggtacgactgtagcgctcggcaagcacttccagttttgcgatgtcgtccatagcaatcacgcgaaaccggttgtctgcttcacaccacgccgacaggaagcgctttgcgtcaataaagcccagcatgatcggccagacaatttgtttatctgcaggtgcgtggggaattgacaaggtcataagcagtttgcgctgttcgcgcaatgcaaaccgaatttcactcaggtcgattgaagtgggaaggtgggagtgggcgcccacgtagaacgtttcgtcgtcaaaggtatgacgcatatccgcaggcaacacggcgtcaattttggccagcgcgttcttcaccgcgaaggcaaatttatcgtcagtctgacgactgacccactgggcaccgactacaagtgcctgaatttcttcttctgtaaatgcaagcgggggtaacagaaagccaggtttcaaaatataacctaagccgggctcaccctcgatgtcggcgcccatcccctgcaaggtcaccacatcgcgacgtatggtgcgtaatgaaacgcccaactccagcgcaagtgtctgacccgacaccgttctacgatgtcggcgcagcacttgcattagctcaaacaaacggtgactcctagccatgcctactccatcgcgatgacacctttaccgccgagcttacggcctttctcaagctcagtgataagtcgaatcgcctcggacatcgaaacggtttccgctactcggacgttgtagtgcctctcgctggcagccttggcaagcttatccaatatctcggcgcgcggtgagcctatgatcattttgagtctgcgatcaaaaaaagcgcggacaaacttgccagggccggggttcagatcaagaaatacgcctcctgattttagcgtcgcaacgcctctagataccggcagcgttgccgcagtgtcgtaaaccacgtcgaatcgattagcaacactcgatagctgcatgttccgataatcataaacattctgcacacccagcgactttgctcgctgcatgtccctgtcgctgcagctgcccgagacgacggccccctgcatcagagctatttgtacagccgcttcgcctactgctccggcacatccattgatgaagacatgctggccggctcgcagcttggccttgtctataagcccgttccaggcagttatacctggggtgcccaggcaggcagcgtgctcgaatgacacgtcatccggcttatgggctaaaaacgcctcttttgtgataacggcgtggccgaacgctccgctttctttaaatcgggcgagtccaaacacggggtcaccgactttaaaccgcgtcacgcctgcgccgagggatataaccgtgccagagaagtccattcccatcgcgcgagggaacttcctgccagtaacgatcttcatttgtccaatccgcagcttccagtcaattggattgatcgctgaatacttgacgctgacaccgacttcaccttcgcgagggggaggcagctcaaagttctggacctgcatgacctctggcccgccatagctgctgtactcaatgcgtttcatgatgcgtctccaaactccggcatacgattggggtagtcacggggcggaatctacagcccaaggcggtcagtttttgtcaccatccgatcagcattcgatttagttttatgcacgcattgctgagccacgctcatcgttacatcaaccgaggaacgggtagttgaattaacccccgtgcattagtttggttagagggattggtcgtcacgatgggggccggttgggttcagcagaaggggctgagaaacagatgatcaagcctggcgatgtgatttggacgccccctggggtcaagcattggcatgggataaacagcacgaccggcatgacccacatggctattcaagagtcatttgacggcaaaaatgtcgagtggctggagcctgttatcgaagcccaacatgaggcttcattatgagtgtacggaccgtttcaatagcggccatcgcgatatgtttaactgcctgcgccagccacgaagcggcgctgaccaaggagatttccaacgtgccaacatcagctgacatacgcgccacttcaccgataatggcgcacaataccgactcgttactcctcggcgacgtctggaaacgccccgagttgtcgccccgcgaccgaagcttggcaacggtggctgtactggttgcgcgaggtcaaacagcagagatggccgcgcatttcgacctggcgttgaacaatggcgtgacgcctttggagctgtccgaagcaatcaaccaccttgcgttctactcgggctggggcaatgccgcaggcgcagcgccagcggccagggaagtgttcaaccggcacggcataggcgctgatcaactggcgccggtgtcgcccgtgctgctacccattgatcaggttgccgaaaactcacgtgcagcgaatgtcgacaactccgtgggggccatttccccggggttagtgcagtacaccaccagcgcgctattcaacgacctttggttacggccggggctcgcgcccagggaccgtagcctgatcaccgtcactaccttggtggcaaacggtcaggttgcccagatcggttaccacctcaatcgcgcgatggacaatggcctgacacaaaccgaggctagcgaactgctgacgcatctggcgttctatgccggctggcccaacgcgttttcggcggtaccggtgtttggcgacgtgtttactaaacgacaagagagctgacgccgctaggggagtggccccatgggttccagttcgcgaatcagctcaatcagcaggcgaaggccgacaggtacttgcctggagcttgagtagtagatgtgaaagcctgggtcgtagtgagtccagtcctccagcacgcgcttcaacgaaccttgttcgacatgaggttcgacaatggatgctggaacatacatcagccctgcgccgcgcgctgccagagccacaccgacgcgcgtctcatccagcgtaatagcacccggcgcgttaatctcaatctgctggccatctttcgcaaattgccagtgatagagacgcgaattccccagtcgtatccgcagacaacggtgcccgtgcaaatcttttgggtgcgtcggggtgccgaatcgttcaaggtaacccggcgcgcccacgacggcccatgccacgtcgggcgatagccgctgagcgatcatgtcttctggaaccgtcccgccaaaacgaatgcctgcatcatggccatcgccaataatatcgaccattttattggtcacggtgaggtcgacctcaatatccgggtagcgctcaacaaacaccgggaggacgggccccagtagcagtttggcaccgtcgctcaagacgtttagacggatacgcccggcgggctcatcgcgcagtcgattcagggtctccaacgcctgcccgatagcgttgacaggagaactgatcagttcttgcaactcctcgccagcggccgtaagcgtcacactccgggtggtacgattgagcaatcgcacgccaagtcgcgtctcaaggcctttcatggcgtgactaagtgctgatgcactgatccctacctccaggccggcctttctgcagctttgatgccgggcgatggccagaaagtaaatgatatctgccaggttcgtgcggcttagctgcatggatgactccgaacttttatttgtaggggcacctcagacgggcgcgggcaaatctacttcatccaggaagatgacgttctggtggggtatgtcggcatgcaccggcgcttcgtagcccgccagatcgtgaatcacaaagaatcccaagcggtgatctcctgagcgtgcagggtaggcctcttcacacttttcaatcctaggttgggctcaggctgcccgcgaagcgttttgggctcataacagttatctggtctgctcatgaatgcttttggcgcgtgcgctgtagcatgacttcgcgaataaccatcagagaactatgaatgcggatttcagccctgcacgccactgttgttgtgagttgtctttggatgggatcggtgctcgccgcaccgccggcagaaaaagtcgtgcgtattgcgcaactggtgattgatccggcgcaactggcggcatatcacgctgcagtcaaagaggaaatggctgactccgttcgtcttgagcctggcgtgttggcgatttattcggtcgcggaaaaggatcatccgaatcggctgcacttcttcgagatatacgccgatgaggcggcatatcgaagccatattgcgtccgcgcattttcagaagtatgtgacaacgacccagccgatgatcctgtccagagtgctgattgaaaccgatccgattcaactcagcgcccagccgcctcgatgatcgattttccggagggggttggtcggtctcgttcagccaagacagatgtctatttgatcgagggggtatcagcgccatagtcaaggagtagcaaaatgttgcgtgagaacgccaacgacctactggtcttcattgcggttgcgcgagaaagaagtttcaccaaggcagcttcacaactacgcgtgtctcaatctgcgatgagccataccatcaaggcattcgaagaacggttagggatgaggcttctaacccgcaccacacgcagtgtcacattgaccgatgccgggcaggcgctctacgacggcatgaaccctcactttgaggccatggaagccaatttccagaagctgctggggcttcgagaaaagccggctggcaccctacggatcactgccgcagacttcagctttcatacggtgttatggccagtgctggaaacctttctggctcggtacccagacatcaacgttgaggtgaactgtgattaccgactggtcgacattgttgccaaccgttatgacgcaggcgttcggtatggcgacacggtgggagaggggatgattgctacacggattgcccctgacatgcgcatggccgtggtagcaacgccagattacttcgcggtgcatgtgccccctggagaacccgacgaacttgtcggccataactgcatcaacatgcggtttcccacccatggcggtatctatacctgggagttcgagaaagaaggtgtcaccaagaacgttcaggtcagcgggcaactcgtcgtcaatggtgtttatcagacacttgatgcctgccggagcggggcaggagtagggtatctgccggaaacacttgttcaccagcatatcgccaagggcgacttgattcgggtgttgcacgactggtgcccgccgttcgccggatttcacctgtattaccccagtcgccttcaagcctctccggcgttcagccttttggttgaagcactgcgctatccccgacgcgcccaagagggagatgattgaataccgacgtgtcatcactgttatgggagtagcagcgttggctggttcgcccactttgcagatgctcacgggctgccagtctgtcggtatctactgatgcagctccgtcacggacatggtgaacaccaacttggatctgccagggttggaataggagtgaggcacatcggttttcgccactgccgagcttcccgaagggatgaccaactctgtttctcctaccacgcatctcagcgtgcctttttccacatgaaacagttcaagcgtgccctgaggatgcccctgtgaagcgaaagattcgcctgggtgcatttcccaacgccacagctcgatcatatttggtccggaggttcccgccagaaggcgcgctgtgcctccctgatccccggtccagagggtgggaatatctttactgtcgatgatatgggcggatggggcttcggtcacattgacgaagtctgcaacggacaggcccaacgctgcggcgattttgcaaaggatgccgatactggggttcgccgtacatttctctatttcgacaaccatccctttgctcacgccagcgcggcgggaaagctcatccaacgtgatcttctgggctttgcgcgcctgtttgagcgtgcgcgcaacggctaggctgacagcttgagcatcagcacctggggtagtcgacaagctggtattcgcggtcattgatgagggttatgggaaaaatgtgctgggattctcgacctttatcagcagttccgtcaatcggctcagccgttatagtagatgatactggtcattatattgactttgctggtcgtcgctgactagcatgaaatgacatttaggttcctggaggtttttgatgctgtccgtactgccgttaatcgatcaagccgttgccgagctggcgccggagttcagggccctgagtatcgtggtggaagctgcaccactggctcatcctgaggtggcccaggctgcgctggaccgtgcttgcaaggctgtgcaggaaggtgggccaagctggggagaaggccatctggctgcatgggctgagacctttcgaaagtttggggccaagccgcagcgcacaccttgttcagctgaagcgctgcgcaaacgagttttacgtgacggcagcttgcctagcctggatcccatcgtcgatctctacaacgcaatcagcattgagtacgccatcccggttggcggggaaaacattgaagcctatgtgggctccccacgactggtagtcgccgatggcaccgaaccttttgacactatgaaagagggtgctcctgctttcgagtatccagatgccggcgaggttgtctggcgcgatgaccaaggcgtgacctgccgtcgctggaattggcggcaaggtgtcaggacccgtctcggtgctgacgcgaagagcatgtggttcattctggagagtctgccagcgatgccgcttgaagctttgacggaagcgggggacaggctgatcgaaggactgcagcaaatgatgccaggtgttcagatcgaaagctcactgattggtcctggggccaaatagtcaatagacaaccgtatgagtgatgccgatgttaaccggacttagtgcatttcctctgacacctatgcagtggctgaccttgtggaatccactggaagtgaacggagctccatggtttgtcgaaaggcaaaattgatcagataaacagcccgtcagacggctcctatagactctcaggatcgccaaaaaacattttgactaggctctaggacggtggttgcagcctgaaaaaatcgacttgtgcccccagttttgcccccattcgagccgagtgtgcgagcgatcgcgagtgacgatttctgccgctgaggccctgagtaacccgatcgtattgcgcctgaagcctctgacaatgattgacaccacgcaaaccagacccagctaccgactgcggagactgctaaggaaagagcaactgacacaagctcattgcatgatcaatcaagacggcgtcagcagggataacgtttaactccggtctcggtcaaccctatttcctattccaaactcccgagatagttatataagttcattgcttccggtgacagacgcgaggcgtcagccacgccgacatataacgtacgcgtcgcccaggccccctccagcggtatcgctcgtagcttcgattcgagcagttcgggatggaccgacccgagcggcaggatgccaatgcccagtccagcctcgatcatgcggcagataccgtcaaagctgctgacttgaatccgtactttcagcagcctcccagtacttgcagcggcgtcgttgatgcggcgcagcagtgagctcccctggttcaaagccacgtaatcaaaatccagcgtgtcagccagggtcacggcggcacgctgcgccaactcgtgggcttggggcaccagcaccacgaggcggtcgcgtcgatagggctgcatttgcagcccgggagcaggcgcattgtcggcaaagattcctatctcggcctggccgctttccaccgcatggatggtgctgtcgctgagcgcttccgcaagctcgatacgtacgtgggggttggccgccagaaatatcgccaggtcatgcggcaggaattggatcactgcggaggtattcgcaaacaaccgcacatggccgcgaacaccattcgcgtagtcggtggcgtcgtgggccatttgctgtgcgacgtcgaggatggtccgcgcatgttccgccaggccgcgcccagcgggagtgagctgcagtcctcggggcacacgggtgaacaaggtgcagtgggtcaccctttcaagttcagctaaccgcttgctcgctgcggacacggtcatgtgcgcactgtttgcggcctgcgttaggttttccgtcttggcggtcaataccaacaggcgtagcgacaccaaatcgagctgcaacaaattgaacatatccacctctgtgtttccagtttggaaagggtagtggaaatctttgaaattctcacgccgtgcgtttgagtggattatccgaccatcgcctccaacaagaacggaaaacgtcatgagcctaccgctagaaggcatcaaggtggtcgaaatgggccaactgattgctgggcctttcgccgccaagatcctcgccgagttcggcgctgaagttatcaagatcgaaccgccggtcaccggcgaccccctgcgcaaatggcgcttgctgcacaacggtacctcagtttggtgggcggcccagtcacgtaacaagcaatcggtcaccctcgatcttcgtcaggccgaagcccgggaagtggtcaagcggctggtcaagaacgccgacatcctgatcgagaacttccgtcctggaacactggaaaaatgggggttgggctgggatgagctgttcgctatcaaccctggactggtgatgctgcgggtgtccggctacggccagaccgggccttatcgcgacttgccgggcttcggcgttatcggagaagccatgggcggtttgcgtcatctatccggcgagccagggcgcacaccggtgcgggtgggggtgtcgctaggcgactcgttgtccgcactccatggtgtgatcggagtgctgcttgcactacgccatcgcgaacaaaatcacggtgtcggccagcaggtagatgtggctttgtatgagtcggttttcaacatgatggaaagcctgattcccgagtattcggtgtttggcacggtgcgcgagccggccggtagcagccttccgggcattgcgccgaccaatgcctaccgttgcaaggatggaaagtacgcattgatcgcgggcaacggcgacagcatctaccgccgcctgatggaaaagatcgaacgcccggacttggccgaggacccggaactggcgcagaacgatggccgtgtgcgccatgtggcgcgcattgatgcggcaatttccacgtggacggccgagcggaaccttgaggatgtgctcgccgtgttgaaggacgccaacattccctccggcaagatctatgacgccgccgacattgcctgcgactcccattaccaggcacgcgacatgctactcgccagccagttggacgacggcactgccgtcaccttgcccggcatcgttcccaagttgacggccacacccggccgtgtgcgttcgcgtgcgccgagccttgggcaacacaccgatgcggtgcttgagagcatcggtatcgatgcatcgacccgtacagcctggcgcgctcgcggcctcatctgaaatcaggagtacctcaatgaaacgcttatacctgcaggaagtcgcgacccgtgacggcttccagaacgaaaagacctttatcgacaccgaaaagaaaatcgccttgatcgatgcgctgagccagtgcggctacgccaagatcgaagtgacttccttcacttcgcccaaggccattcccgcgttgcgtgacgccgaggccgtgatggccgcgattcagcggcataaagatgtggaatacacggtgctagtgcccaacattcggggggcagaaagagcgctggggtgtggaatcgacgaagccaacctggtgatgtcggtgagcgaaccgcataaccgctccaacctgcgcatgactcgtgaacagtcgttcgcccagctcagagatgtagtgggggtcattgggcgcgggccggtggcggtcaacgtgtcgctgtccacggtatttggctgcccgatgcagggcgacgtgtcgtccgacgaggtattgggttgggtcgggcgtttcgccgaattgggcgtgcgtggcgtcaccctgtgtgacaccaccggcatggcctatccctcgcaagtggatgcgttgtcgcgccaggtccgcgagcgctttcctgagttgcaactgactctgcattttcataacacgcgtggcatggccttggccaataccctggcggctctgcaggccggtatcgaccgctttgatgcgtccctgggcggcttgggcggttgcccgtacgcccctggcgccagcggtaatgtgtgcatggaggacctggtgcacatgctggacctgatgggctacgaaaccggcatgaacctggaccgcgtactggcggcgtccgcccagttgcccggactgattggtcacgacatccccagccagatcctcaaagccggcaaacgcctggacctgcaccccatccccgatcacgtacacagcctaagcaagcaagtagccaacgctgaactggagcgcaccccatgattgatcatctagaccatctggttcttaccaccatcgacgtagcggcctgcaaagacttttacattcgcgtcatgggcatgcgcctggagagctttggcaacggccgactcgcgttccgcttcggcaaccagaaaatcaatgtgcatgagcgtggacaagagttcgagcccaaggcccatctgccggtgcccggtgcgctggacctgtgttttatcaccagcacctcgctggaggaagtgatcgcccatttgcaagcccaggcctggccgatcatcgaaggcccggtgccgcgtacaggcgccactgggccgattcgttcggtgtatgtgcgcgacccggacctgaacctcatcgaaatttctgaacaggtgcccgtatgaatatcgtgtttctcgacggtgcaagcgtgccgtcgccattggcgcgcccggcccaggccagcacgtggactgaacgagaaaaaaccactcccgacgaggttgtgcaggcgttggccgaagccgatgtggccatcactaacaaggtatgcatcgaccgggctaccctgaggcaactgccacgcttgaagctgatctgtgtggctgcgactggctacgactgcatcgatattgccgcttgccgtgatcaaggcgtgacggtgtgcaacgtgccggcgtacagcgcggtcagcgtggccgaagcggtgatcggttcgctgtttgcgctacggcgtcacctcatggcgtattgtgcggcgtcgaccacgtcgtggccacagtcatcccaattctgcgtgcatgcggcgccggtccaagacctgcaaggctcgaccctgggtatcgtcggccgaggtgatatcggcagccgcgtggcgcgactggccaaggccttggacatcaccgtgctgtttgccgaacaccgtggcgcgtcacgggtgagggaaggctacacggcgttcgacacagtattggccaaggccgatgcgctgaccttgcattgtccattgacgccgcagacccgtaacttgatcggttccgccgagatcgcacggatgaagtccggtgccttgctcatcaacaccgcacgcggtgcattggtagatgaaaacgccgtgctcgacgggctcgcccgcggccgattgggcggggcagcactggacgtacttcaggtggaaccgccccaatccgaccatcccttgctgcactgcgaacatcccaatttgctggtcacgccccacgtcgcttgggccagccaaagcagtgtcgagcggctcaaagccgtgctggcagccaatatagcggcgttcgccgcccatcaaccgatcaacgtggtgacttgaaccctcagcctcccccaatcacaaccccataaggcagagccatgacaaaaataatcagctcgtcagtcgaatccgtggatgaaccgcttccacggcgcaaagcattttaccagcacctctacgtgcaagtcctcgcagcgatcgtactgggggtgatcctcggtcacttcagccccggtctcggtgagcagatgaaacccttgggcgatacgttcatcaagctgatcaagatgctgatagcaccgatcatattttgcacggtggtcagcggtatcgccggcatgcaggaccttaagcgcatcgggcgtatcggtttcaagtctctgatttactttgaggtgctgactaccatagccctggtgatcggcttgatcggggtgaacctgctcaagccaggtgtcggcatgcacatcgacccggccagcctcgacgcttcggctatcgcgggctacaccaaggccgcccatgatcaaagcgtggtcgggttcctcacgcacattgtgccgaccacggtgtttggcgcgtttactgagggcgatatccttcaagtgctattcatttcagtgctgttcgccttcggcctgcaattgttgggcgagactggcaagccgctgctcaataccattgatctggtggccaaggcgttctttcgcatgctcaagatcgtcatgtacttggctcccctgggagctttcggcggcatggctttcactgtgggcaagtacggcgtgcaatcgctcggggcctatgtgaacctgctggtgtgttactaccttaccgcgctggtattcgtatttgtggtgctgaatctggtggcgcggctggctggtttcagcctgtggaaattcctcaagtacatccgcgaagaactggtactggtgctcggcacttcctcgtcggagtcggcattaccgcgcctgatgggcaagctggaaaagctcggctgcgagaagtccactgtcggcctcgtggtgccttccggctattgcttcaatctggacggcagttgcatcaacatgacggtgctggcgatcttcattgcccaggccttggacattgacgtgtctctttatcatcaagtaacgctgttactgatcctgttgctgacgtccaagggggccgcgagtgtgaccggaggcgcgttcatcaccctggcggcaaccctcggttcgatcgatgtaataccggcggcaggcctggtactggtgctaggcgtctaccggtttatctccgaaggcggcgcgctgatcaatgtgatcggtaacggcgtcgccacgctgttcattgcccgctgggatggggctctggatcgtgagcaactcagccgtgaactaggttaggtttaacgcagagactctttgttgttggccaccacgcctggctgatgccctggaggctctgcgttttttctgagattgagtcatatggcggcaatataaaaagccctcacactgcactgtcgtgggcaggccatgagggcaaaagggaagacgtgcgggcagggtcaggatttgcgctgcaaggtgtggtaattcagtgctgttctggcgtccttaagagatttgccttcagcgagcaaggcacgaatacgcgattccacttcttcgatcgagcgggcgcaggcggccacttcacgggccctttctcgaggaacgatcaccacgccgttggcatcggcgactacgatgtccctggcgcagacccgggcctggccgatggagaccggctgattgaccgaggcgacttcgacccgatccttgccggtgcgcatgaaccggcctttgctgaagaccggatacccgtcgcccaacgcgttgctgacgtcccggcacacaccatcgatcaccgtcgcggcgatgcgtttgctgccggcatattgggtcatgatgtcgccccagactgtgcagtcggtgcgcccgtcgttgtcgatgaccacgacatcgccttcggcgacatcctcgataaagtcgccgaccgttcccggcgggctactggcgctgacgtagcgcacggtgaatgccgggccgatcactacctgacggtagttatccagcggcatgaccccgaggcattgtccgggcagatcgagtttatccagggcgtcggacacaccgggcgtatccaggccttcaaacagggcaaccagttcctggtcttcgggagacataaataattcctcttgttcttcaaatcagcgcaactcaaggcgctgcgcacgggtggttggatgcgtcaatcggcacgggcggcggcgggccttggctcggcgatggtcagcaggatgatgaagctgatgaacgagccgatcgccaaccaggcgaacacataattccaaccatagttgtccagcaataggccggtaatgaacggcgtcgcggccgcgcccagttgcccgatcatgttcaccacggcgttggaaatggggaacgttttcttggtggtaagccccatcgggtaaaccatgtaggaggaaaacccgaggctgaggaccacgccggtcagcatcagcagcagcccatagggcaggggctcggcgggggagttgatcagcaggtacatcatcaccgaggtgcccagcgctgacaggagcatgccgggtttgcgccgaccgcccatcaaccggtccgagcagaggcctccgagcaggttgcctagaacggcgcccacccacggtgcggccgacaccagtcccatgttcatgatcgagaactgtttgacggtcatcaagtaggtcggaatccaggccagcaacacgctcgagacaccgagttggaaacaatagctggtggcgcagccccagatattccacgacttgaacacctgccggttggtttcaagggcaaccacatcacgggtgcgaatgaaccgatcgagtttcttgacccacgccggctgttccggtggccgcacggcctcggcgacctgggcaacgggtttgtcgtcggcgatgtagttgagttcggcttcgttgacgaagcgactgcgggacggatggtccgccaccatgaaataccagaccacggcgaggacgatgccgggtatggcgaagaagtagaaaatctctcgccagccccagaccgaaatgatcaccgcgcagagtggcggcacgatcaccgggccgaatttgacggcagacaggaagatgcccgacgccgtgcctttttcccgtggtgggaaccagttgttgatggtggtggtcatgctgatcggcaatggaccttcggccaggccgaggcccaggcgatacagtttcaacgccagcaacgagccggcggtgccgaccagtccggtcatcgcggaggtcaggatcatcgcgcctgggagaatcttgctgacgccaaaccgtccaaaggcaaaaccggagggaatctgcgccatggcataagccagcaggaacaggctcatcaggccgcccgcttcggcgttgctcatctcgaattctttacggatgaaaggcagcgccacgccaaggttggcgcggtcggcggcggcaatggtgtagatcaggaaaatcagcgtggcaacgacccagcggtatctgctgcgcaccgcaggcttcaagacttcgggcatggacatggaagcggaccttgtttttatcggttgtctggtcaagcggttcttggtgcggcaggggtcatcgccagcgcaccggtacaccgggcgtcagttcgccagcccggctttttccagcaccctgtccaaccaggactgatcgatcgccccggtggcaatttcggctttgacttcctgttcatgggcgtcgtgttcatgggccttgcgcaggagctcctcggcgacgtctggagaaaacgccaccaggccgtcttcgtcgccgaccaggatgtcgccggggttgacgatcatccccccgatcgagaccggcatattgatctcgccggggccgcttttgtaagggccgcaatgcaccacgctgcgcgcatagcaaggggtgtcctggaagctggcgacgtcgcgaatggcgccatcgacgacgaagccgacacagccgcgctgctgcgcgtagagcttgatcagctcaccgatcacggcgttggtgtcgtctccctgggcgtcgatcaccagcacatggcccggttcgatcagggtcaatgccttgtagatgtacaggttgtcgccagggcgggttttcaccgtgagcgcggtgcccaccagcttgccggtgaggttgtagcgcgtcaggccccgggcgccgatgtgacgtcccaggttgtcgctgatatggggcgtgacaacggagcggaatgcgtccagcaagaagcccggagcctgaggtggagaagggtggatgcgtgaaccgggcaatgacatggcgacctcaattacgaataaccctggcgggcgataagcgcatcttaagaaaggtcgttgatcaggattagcgatatttatctatgcaatcccatcactttttttcgtctttcccgcgcggcattaccagaccatcttgctgaaatcacagagctcggcggccaagcgcgctacctcgacgctcaagccctgaagccggtcggcacggtgtgcggcgatgtagtggatcggcggcaatgcgggctcggtttcgatcacctgcagccgtccctggtcgaccagcggtgagaggcattggcgcggcaaatagctgatcccgacgccggagagggtcaagcccaactgggcgatcaggtagttgctcttgagagtacggttcaggcgcacgtcgttctgggcgagccagcgatcgtaaatcaatcccgtgccggaactgccgccctgggtgagcacggtgtacgacgacagggtctgcatgttcacgctggcgtcgccctgatgcagcgagggcgcgcacatccaggcgttctccaccgagctgagggcggtgctgacaaaacgtgcgtcggcgaaaatgtcaggcacgataatcaggtcgagctgatcgttctccagcttggccaccagttcagtgctgagctccaccgaaggttccagcaccactttcgggtaggtgctgcgaatggcttcgatcagcgccggcaaccaggtgatggcggtcagttcggtcacgccgatacgaaagcgcctgaccagcacttccttggcgctgatgcgctcaagcagaaagtcgcgttggcgcaggatctgcgacgcttcctcgaacagctcggcgcctttctcggtgagccgggcgttgcgcctggaacggtcgaagatgggcatgtcgaacacctcttccagctcctggatacgcttggagatggccgactgggacatgttcagcttcatggccgccgactcgaaattgcccagttcgacgatccaataaatggcttccagttgtttgaaggtaatcatgcgcagtcagacccggtgggaagtgattcgatgccaatccgccgagtctgttcgtccggcccggtcagcgcaaggcctcgcaaaaacgccggattgcctcgcaggcctgacgcaaggaagcatcatccagggcgtaggcgatacgaaggtaagggccgaggccgaacgcgctgccatgcaccaccgccacgttcgcttcatcgagcaaagcgtgggcgacgtcctcatcggtgagcaaccgccgccctgcaggtgaggtgcgacccatcaggccggcgcaggaggcgaacgcataaaacgcgccgccagggctggcgcattccaggcccggcgtggcatcgagcagcgcgaccatcatgtcgcgacgtccctggaacgcggcgcggcttaggtgaatgaaatccttcgggccgctcagcgcggccagtgccgcttgctgggaaatggagcaggcccccgaggtttgctggccctgaaacttctccatggcttgcagcagccagcgcggcccggtggcaaaaccgatgcgccagcccgtcatggcgtaggctttggaaacgccgttcatggtcagggttcgcggggccagtcgcggttccaccgctgccagcgtatggaaaacctgatcgtcgaagatcaggtgctcatagatgtcatccgctagtatcagcacgtggggatgggccagtagcacttgcgccaaggcgagcaactcgtcgcggctgtacacggccccggtcgggttggacggtgaattgaggagcagccatcgcgtcttcggcgtgatcgcctcggccaatgccgcaggcgtcagcttgaagccgctgtcggcatggcacgtcacgatccgcggctcgccaccgcacaactggaccatttcgggataactgacccaatagggcgccggcacgatgacttgatcgccctcgtccagcgttgcggccagcgcgttgtagatcacctgcttgccgccgttgcagaccagggtgtcttgccagtcaacgtccaggccattttcgcggcgaaacttggcggccaccgcttcacgcaatgcgcgcacgccggccacctgggtgtagcgagtgtggccttgctcaattgctttgatcgccgcttggcgaatgtgctctggcgtatcgaaatccggctcgccggcgcacagggagataatgttcgcgccttgcgcccggcgttccgccacccgatccatgatgcggtaggtcgctgaaggctgggcactcgccagacgtggattcaagcgttggatatcgatgttaacgtcgactgcctcgtttgtgacattcatcgtacgtgctccacctggatggcttcgaactggcggtcatgcatgacctcggcgaccgagcggccgccgcggacggcctcgaccataccgtcctgccggcgggcgatgcgttcgcccaggtcgagcactttttcgatatgggcctggggcacaaagacggtcccgcaattgtcggcgatgacaaagtcgtcctcgctcacaggcacgccggcgatgtcgagggtcacggccgaatcgatctgaataacccgattgcgcgcgctgaccatggtcacgccccggccatacaccggatacccaatcgtcgcgctgccgtcgatgtcacggctgtagccatcgatcaccgtgccgcgtatctgcttgcccaccgccgcgttggcgaggatgtcgccccagcaggacacgccgtcgagcccgccggcgatcaccagcacccgatcatcgctgtcgatccgttcgataaccggagtgatcaggtgcaccgtcggggcgttgtcggtctttgccgccagcagcacggtactggcgcggccaacgatcttcgggcaactccagagtgggcgcagcccgacggtggcgccgggcagaccgaggaagtcgagtgcatcggagaccgtattggtgtccagcgatcccaggcggtggagtaaatgagcttgattcatggaggagccccttgatagcggaggagcccagtgtcagcgagagtgtttgataggtatattacgaatcacggatgtattacatacgtttaacctatggaatcccatgatcaattttcgcctgattcgtcatctgtggttgtttctggcggtggccgaggaacagaatttcggccgcgccgccaaacgccttggcatgtcgcagccaccgttgagcgagcaaatccagatccttgaacaggcactcaaagtcacgctgttcgaacgttcgcgccgtggtgccaggttgaccccggtcggcgctgcgattctgccagccgtgcgcaaatttgccgaacaactgcagcgtttggagctcgcggtggacgaggcggtggcagggcagtccggaatgctgaccatcggcgcgatttccacggcgatgttcgatgttctgcctggcgtgatcgagcaactgaaaacccagtatccgcagctcaccgtatccgttcgggaaatcgacagcgtcgaggcgattccggcgctggaagcaggagacatcgatctggcctttgctcgcctcgacggtgactttggtgcttcgatccgatcacttccgttaacggaggatcgcctgatggtcgcgctgcccgtcgatcatccattggcatcacgcaagcgaatcagcctggccagcctggctaccgaaccgttagtgatgttttctcgcaacgtcagcccggtgtatttcgacagtctgattgccacctgccgcgccagcggattttctccgcgggtcctgcacgaagtccgttcggtggcatcgcaaatcgcgttcgtcagttgtggccagggtattgcgttggtaccggcgtcgctgaagaaactggcgcccagcaacgtggtattgcgcccgctgagccagaaactaaatatcgtcacgactgccgtggcctggaatacgctgcgtccgaatccgctcgtggaagcgttggtcaaccagctgaaagccagggggtgatacgttggcgtatggaagctctcctggataaggaaatccaagcgggctgctaactctggcgctgcgcgcttgctagtagccatgcctacttgttcgccagcctttcgttcaaaggaacgtcagcgcgctccatcggacgcattcacacctgcgattgtccatgataggggccgcaatggtgccacgcccattgagccaaaaacgtcagtcggcggtgcattgatttaggtgagactcaacctcaggcttgggggcatctttttcaaaccatccaaagcatgccctcagatatgcccccaatgtagccatccactggaagtgaatggagctccatggtttgtcgaaaggcaaaaatcatcagataaacagcctgcccgacgactcctaaagactctcagggtcgccaaaaaacatctgaatccgcgacctcaaccaccgctcacccgggtcattgtcctgcgacccacgccaggccatgtgcagctcaaacgaacgcactggcagcggcgggtcttcggcgcgtaatccgcccgccgaggtcagcgcctcagcggcgtaatccggcacagtggccagaatgtccgtacccgccagcaacgtgcccaacccgttgaactgaggtacagccaacaccacatggcgtttgcggccgagcttctccagctcttcatcaataaacccgctcaggtcgccggcgaaggacaccagggcatgggggcgtgagcagaagtcgtccaggctcaatgagcctggcacgctgtcggcacgcagcagcttcggcaggctgcggcgcagcaccttgcgcttggcgttggccggcagatcggcggtgtagctgacgccgatggagatttcacccgaggcgagcaagccgggcatcaggatgtagttgacgcggcgcaccaccagcacgatgcccggggcttcggcgcgcagacgctttagcaattgcggcagcagggcgaattccacgtcgtcggacaggccgatacgaaacactgcagtgctggtggctgggtcaaattcggcagcgcggctgacggcggtggaaatcgagtccagggccggggagagcagggcgaagatctctacggcgcgggccgagggttccatgctgcgtccggtacgtacaaacagcgggtcatcgaacagcccgcgcaggcgcgacaaagccgcgctgatggccggctggccgaggaacaatttctcggcggcgcgggtcacactgcgctcatgcatcaaggtttcgaatacgatcaagaggttaaggtcgacacgacgcaggtcgttacggttcatcttgtgtcctggaagagtctgtaaacttgacgtgagcggccatatcgcacgattcagcagcatgaccggcatgaatcttacggggaaaggctggtactctgcaccggctaattgatttttcctacgatagttgaggtctgctcctccttcgcgaaatcaatgacaggcatgtcgactattaatggcgaccggtggccttacctggaaagcccagataaagttcatggcattagaggttactttgacgaggtttgcgatgtcccgcacgatccgttttcacaagtttggtccggccgaggtgctcaaatgcgaagagcatgcagccgcgcagcccgcaccgggcgaagtgcaggtgcgtgtcgaggcgattggcatcagctggtacgacatcctatggcgccagaacctggcgtcttcccatgctcgcctgccttcgggcctggggcatgaaatggcgggtgtggtagtcgccttgggtgacggcgttgatgacttggccgtgggcgacaaggtggccagttttccggctgaaagtcccaacgattacccggtgtatggcgagcagatcatcttgccgcgttctgccctgacccgttacccggatgtcttgagcccgattgaagccagcgtgcactacacgccgttgctgattgcgtatttcgcttatatggacctggcgcgggtcaagcctgggcagtttgccctggtgaccgatgccagccactgttccggcccttcgtttgtgcaactgggcaaggccctgggtgtgcgggtgattgccgcgacgaaaaacagcgccgaacgcgaatacctgctctccctcggggcggaaaaagtcattgtcaccgaagaacaagacctgctgatgcagatcaacaagttcactgacaaccgtggtgtcgacgtcgtattcgatggcctgggcggcccgcagatgtcgttgctgggggacgtcctggcgccccgtggcagcctggtgttgtatggcttgcaaggtggcaaccagacgccatttccggcctgtgcagcgttccagaagaatattcagttcttcgttcactgtatcggcaacttcaccggcaagccggagctgggcatcgtccaggatcaggtggcactgcagcgggccttgcgtgatatcaaccagttgacggccgaccgtgtgcttgtcccactgaaaaccacggtatttgcgttcgatcaatttgttgaagcccaccgctatatggacgaatgcccatgtcgcgagcgtgtcgccttgcaggttgaagctgtttgagctgtaggagtattcgcaaatgaatacgctggcgtctgagccgatgaggcaaatgcgccatttgacagggcttaacccactctcgggttgagcctgaccaggggggctccaccccgcaaacaatacctttttccccttacgccgccctgaaacccagtgcggcgctgtcgtgtgggcgccattaacgtctcgggcctggcgaatctgaacgggttttcggcgatcgtctgtatctgttaatcattacttgagcgccgataattgtgcctaccctgtcatctcaaggactgagcaatgattgattacctgatattcccgccgcgtacttcaggaactaagcaaggcgtctctgtgcatcctgaaagtgtactgaaggcgcccggttgttttgcaaggagcagattaaaatgggtgattaatattcgtcagatgtgtccctcgttttttagttaaaacagtgtaggaagttgtcggagtgttcctaggatcggtaattcgacgcgtctatattcgagctggagcgcgattttcccggggttcggccacagtaggaaggcatgaggttgccgatgcttttattgcaaagtgctaatgtacaactgtctttgcgccgtgtggcacccgacacacctacagtcgtaatgggtcgagcaattcatattgatagttgcttgaaactgacacttcaactcaggtagtagaataatgagcgcaattcatgagcaagccatgaactatgtttaccaacaagttctgcagcgtatgatcgggcatttcacgcggtccgagcggactgtacttcaattgttggtccagcgaattgtggtggcagccggtggcatggagcaagtgggccactacaaagtgctgatcacccacggcggcggtgaggtcagcagttacacgctggcaatgctgcgagccgcgcaactgaccatcgcgggccgcgcgcccaagacgtttcacctgcgggttgctaccctgcgctatgccggcatgacccaggccaccctcgacaacttgaaccaaggctatagcgcgctgttttttcatgacgacccgcgtgtggagctgttgatggtcgagaaccgcgacgtccagcccttcaatccgcaacgcccggcttccagcgccgggcgtgaggtcagtcagcgcaatatgctactgctgggccacctgacgtccggcgatatccgcgccacgctgtgcaacgacacctacctggccttcggtgagttctaccagtgcgtcgccacctggaacggcggtgtgcatgccatggtcagcggtgactcgccacgcaagcaaagccaatatctggcgtggctgaaaaaaaccgcgctggcaaccggccttgatttcgcgcgtggcaaaccgatgtcgctcaaccggctgtttgcacgcatggaggagtggagtatcgcttgctaccgtgatctctatggcgagcattatgtgggtacagaggagctgggccggggcgggtaccgtcatctggcctatatcggcattgccgacttgctcgatgatgtggatgtatcccgatccacgctgctgactgacttcctggcgcacaagcaggatccgtttgattttcacttcagccatcctgccgcccccaatccattactcatggctcacttgcacggcttgcaggcccagtgcctgcgtgagctttcttatgagcatggcgtcgagagttttattcgccaggcgatggactatatgcgccgtaggaaaatcccaaatgcattgatcgccgaggcgtcaagcgaggatgggcgcatcctgtccaccacctatgcccaagaattcttcggcttggacgagggtcagttgacctgcctgctgttcgcacccttcattgagcacggcgagcggctggagggcttcttgcgtcaatgccatcccggcatgctggtggcgctccccgagctgcacaaggcgctccaaggcaagcccgcagcagacatgctgcaacagtggctggtggataccagcgggttgccgctgccgatattgcagcacgtgtaccgcaagcgcccgctgcaggtcgagcgtggcatcctggcacgcaagccgcgattcacgcagtccgaagcaccgactgcacggttatcggtgcgttaacgtgtattcgtctgtacaggccggtgagcggccatgaacctgcggggagagcgacaggcagactttgcctatcaggcggtgtaccgctacatgatcaacctgatcaacgaagtcagcctggaaacaccggtcaagttgccatccttgcggcagctgtcgacacgcttgaacgtgtcaatctcgacgatccaatacgcctactcgctgctggagaaggaagggcgggtgtactcggtggccaagtcgggatacttcgcctggccggtagctgccaacccacagctgatggcgggcgctgacctgctcgaaaggctctacgcggcggcgcggcggccggccatggtcgtgctcagtggggatgagcccgcgctgctgggctcgctggatggtgacttgctgacgctggagcgtaaattggtgcgccgctacgcgaaccaactgcagccctggtcgcaaccctgtggcgtgtgggagctgcgcgcagcgttggcggcacgttatacctcgtcgcctacacgctgctggcaggccgacgaggtgtatatcggtgccgatctacagggtgtcctggagatactgattgacgccctgggtctcaagggcaccgtattggtgaccgaatcaccctgtgattatcgggtcttgcgcctgttgcaggctgctggtgtacgggtgatcgaattgccctggctcgccgatggccggttcgacctcgcgatgttcgagcacttgttgcttcacgaacccgtgcacctggtgctgttgtcatcggtagtgagcatgccatcaggtacggcgttatcggttccggagcggctgcagattgcgcatttgcttgaccaatacggttgctggctactggagaacgatacctttggtgaactgagctatacgccatcccaggcagccctgcgtcatctggtcaacccggagcggctgctggtgttctcctcgttcgagaaggtgttgggtccggaagcgccctttggctatttactgtcgcatcaaatgagcagtgaattgcagcgccagtttttactgcgctcatttcgtttgtcgtcaatccgtcagcgggccattgcccggctttatcagagcgggcgctttgatcagcacctgcaggcattgcgccaacttctacaggagcaagcgcaggccatgagcctgcggttggacgcacgcatgcaagggcgcgtgagctaccggatacccatcgccggggcgagcttctggttgcagtcggtggcgccagtggatatgcgcttgatctttcaacggatgctcacgcaacaggtcgtgatagcgccgggtgagttattcagcctcagcggcttgcaccatcagcatatgcgcttgagccatacgtttacggggcagcccaatctggatgtcaccctggatgcgctggctcaggcgttgctcgaggcgcagactgtctagcgtatgaaatttctctgcgcgctgtaggatcgataccgtcgcacagtagtccaagtcccagtaaactgacacttttccgaatccttcttttcgaggtttatgcatgactatcagtccttttgcgggcaaaccggcgccggcccagttgctggtggatatcccgcgactggtcacggcctattacaccggccagcctgatgcagcaatctctacccagcgtgtggcctttggcacctccgggcaccggggcagctcgttcgagctgagcttcaacgaatggcatgtactcgcgatcagccaggccatctgcctctaccgcgaagcccaaggcatcaacgggccgttgttcgtgggcctggatacccatgcgctgtccacacctgccggtgccagtgccctggaggtattggccgccaatggggtacacgtcatgctggccgaaggcgacgagtacacgccgaccccggcgatttcccacgcgatcatctgctacaaccgtggccgcaccagcggcctggcggacggtatcgtgattacaccgtcccacaacccgccgcagagtggcggctacaaatacaacccgcctaatgggggcccggccgatactcacgtcaccaagtggatcgaagccaaggccaatgaactgcttgccaacaagctggccggggtcaagcgcatcacccacgcccaggcgctcaaggcggacaccacccatcgtcatgactacctcaacagctatgtggctgacctggtcaatgtgatcgacatggatacgatccgcagcgccgacctgcgcctgggcgtggacccattgggcggagccggggtgcgctactggtcggcgattgccgagcactaccgtctgaacctggaggtagtgaacaccgaagtcgatgcgactttccgcttcatgagcgtcgactgggatggccagattcgcatggacccgtcgtccagctacgccatgcagggcctgatcggcctcaaggaacgattcgacgtcgcgttcgcctgtgaccctgaccatgaccgccacggcatcgtcaccccgtccggcggcctgttggcgccgaacaactacctggcggtgtccatcgattacctgttccagaaccgccctgactggcgcgccgatgctgccgtgggcaagaccgtggtcagcagcggcttgattgatcgcgtcgctgcgcgtatcggtcgccgtttgtacgaagtgccagtgggcttcaaatggttcgccgatggcttgttcgaaggttcgttgggctttggtggtgaagaaagcgccggtgcctcgttcctgcgcaaggacggcacggtttggagcactgacaaggacggcttgatcccggctttgctggcggcggaaatgacctcgcgcaaaggccaggacccgagccagatctaccgcggcctgaccgacgcgctgggcgagccgtttgccattcgcgtcgatgccaaggcgaccccggcgcagaaagcgttgctgggcaagctctcgccggagcaggtgacgtccacgcaattggccggggagagcatccagcagattctcagccatgcgccgggcaataaccaggcaattggcggcttgaaggtcatgaccgaaaacggttggtttgccgcacggccatcgggcaccgaggacatctacaagatctatgccgagagctttatcggcgaagatcacctcaagcggctggtggaagaggcgcaggtacttgtagacggtgcaatcgcacagtagtcacaccgaacccaatgtgggaaggtccgtgccccgatggcggtgagtcagtcacagttgcattgactgacaccgcctcaccggggcatgggtttccacacctttgggtgcgccgcaggaccctgtggggggggcttgctcccgatggcgatggggcagccacagatgcatttactgatacgccctcgtcggggcatgggtatcaacgcaactttttagcagtcaacagtaaccctggatggggcgtatatgtactcggtctaatccaacatcctggtcggctgccaggccgccatcgggagcaagccccctcccacattggatcagggcgtcagtcagatagcgttctgctgtaaggccagcatcgggcgcaagctcaggccaggtcgaccaacacgatctcgctgtcctcgatcgccgtcacccgtaatacctgctcgtcttcaaccgccacgccatctcgcgcctgtgcccgcaaaccattgacgtcaatcacacccgtggccggcaccagatacgcccggcggccgctgtccagtcggtactcagcgctttccccggctttcaggttcgctgccaccaagcgtgcatcggcacgaatgctcaggctttcactgtcgccagccttaccactggcaagcgtcacaaatccttcacggttaccttgtggaaacggtttggcgccccaggacggcggtagcccagcctgattcgggataatccagatctggaaaatcttggtcggcgtagcctccaggttgtattcgctatgggcgatcccggtgcccgcactcatcacctgcacatcacccgcctcggtgcggcctttgttgcccaggttatcggcatgactgatcgcgccttcacgcacgtaggtgatgatttccatgtcgcggtgcgggtgctggggaaaaccactgcctggggcgatgatgtcgtcgttccatacccgcaggttgccccagtgcatgcgctcggggtcgtggtattcggcgaaggaaaagtggtgatgggcgtcaagccagccgtgatgggcgccgcccagcgtgtggaaaggtcgaagttcaagcatgatcgtctcctgttgatgggcctatcatccggcagcgcaacatcgataaaaagcgtaaaaactgcctgattcctatccatatattcgatagatgtcgtctgtaacaactttcacttcatcgcctaactgcatgacagcaaagcaattggctggaactgagcgccgattccggcgaccatgacgccctcatcaaagccaatctcatcgcaggagtccgcgtgccgcaacacaagcctgatctgccccctgaactgcgccccttggccgagatgccgctattgaaacgactggccgctcgcctgttcggccatggccttactcgtttacgcgcgcagcaccggttctcctggttgcatggccaagccgacggctttcgcagtgggcacgaggcgggtgtggaatatggttatcgcgagggcaaggccgatggcattgaggagggccgacaggtcctgttgatccgcgacttccgccccgacgaacaccctgcgccgggggtggatgacagcctgttcgatgactggcggttgccgctcacggcggatgtgaaaaaacgcatgaaggcggatgtggcgcggctgctgccgccccatgcgcaaccaagtgcggcgcagtggaagatgattttcagcgatacgccctcgacttcggtgatcgccggggccggcgcgggtaaatccacatccctggtgctgcgcatcctgctgctgacccattacctgggctttgagctgagctcgatgacggtggtgacctttactcgcgagtcgcgtaaagactttattcacaagctcatggatattctcagcttgtggggccaaccccttggcatgaaggaagcccaggctgtggtgcgtaccttccactcgcgcatcctgccaatggtgcgcagcctgccgggcttcgagcgtctgcaggcctttgaaaacctcagcgacggttttgcggacgccgacagcaatcccttcgacctgcgcatcggcgacgcccagcgtcaacagatgaatgcctgctatcaccgcctgtatggccgccaccagcgttttcgcgagctgattgcgccgttggcccgccaaggcctgcaactcaaggagctggagcgtgatcatccggacgtgcaaaaacgcatcgcagtgacagacctggcagccaaacgtgatgacgaactttgcgatgtgatcgaagacctgtggtttcgcgccggggcgtggccgatcaagggcatagagcccagccgccagacctttgaaatcaacggtgcgcaatttcattgccacggttatatcccggcgctggatgcgtgggtggtgctaggttttgatgcgcgggaaaacccccagctcagccggccgaactcgaaactatccgtgcgtgcagagtgggcggtcaagcgcaccttgtttcaagctttctgtcgtaagcctatgatatggatggacaattatgaggcttcaaagcgcttgatcagcagccttgccggcgatgcaatggccgggcctggctttgattacaaggtcaagggcgaactggcctcggcgccgctgttggatggttttgtgatggctgccgggtttatcgagaacctcggtttggacgtaccgacggccgtgggccagatgcgctttgccaaggacgatccggatcggttgttcttcgaggccctgagcattttctggaaggccctggaagaccacctgctggatcaatcgccgccgattatgacctacaatcggatgttctccctgttcggtgaaaacaccgcggaaaacctcaagctgctcagcgatccattgctgcggcctatgtcgcacctgatgatcgacgaattccaggatgtttcgccacaaattgtctcgtggatacgtgcaagcctcagggagatccgcagtcgcgggccggcgatgcatgtggggcgcggcgcacagcgttcttctttgctatgcgtaggggacgactggcaatcgatctatggttggcgtggcagttcgcccaagttcttcatgcacttcaataacgaattttcctcgccaagtaccacccgcgtgatgctggcggagaactaccgtagccaccagcacatcatcgatgcggccgaacacgtggtacgcagtgctccggcgattcccggcaagaaggccaaggccagtggtgcgcccaaggcactcgtgcccgtgatggtactcgagcgcgacgatgcggcgctgggccagcgattgctggagcactatcaacggggccagagcgtattgatgctgtatcgaaaaagtagcgataagctactgattcaagagcgtattcaggctgtagttaatgtggattctagcttgccgctccacgagcgcaggttgaaacagctgacctatcacagcgccaagggcctgcaggcggatgtggtatttttactgggggactgtcagcatctcaccagctcgccgtacaagaatcaggtctaccgcatggcgggcctgggcaaggacggtgatagcgaaccttatgacactgcgcaaaaagaagaaatattgcgcctggcctatgttggcattacccgagcggtcagccattgctattggtatgtggaaaagcccgaaggccagggcgtgaatgtgcccagggcctcagagcgggtggatggcaagaaagcctttttcgatgatcagcgctgaccttacagctgatacacagctgaatgtgggagagggctgacaaatagtgttcaggccctcaaagacaacggcggcacaaaacactccagctcatcctctaccgcctcgatgatgcgctccacatctgcagcgttcattacggtggcgcaagggataccggcgatggcgatcaatgtctcgccgctggcccggtcaaacaggcgcgcgaccatgctaccgggggcgtccatgctgccctcgaagcccattggatgaaaatgccagcgcatcagctggcaggcgttgggaaacgtcactttgttcatgttgcccaccttgttcattgagcgcttcctttagctcgcggcaggggtcaagaccttcgctggtcatgacagtgaagaccttaaaaatagcattcgttcgtaagtacacgtggagttttttagccccgttcggcggttcttttcgctaattttgacatgggtcatgtcctacgcaagattaggcaaaaggccattactccgcgggcccacctgaccattgaaggggcgggtaaacttcggcatcttcaagtattttttttccgctgcagagccctttatgcctgacatgacaccagacgatgattgtcggaacacccgagccacccgtgagctggtgctgcgccatcacctgtgctggcgccatcgcgatctggacggggtcatggcttattaccaccctgagatccaataccacgacttcttccagaaccgcgtggtgggttatgccgaactgcgtgagtacctgcaggccagcatgccccgagaagcagacgaggcgatcgagcataccgaccgtatccgtgccgatggcgacaccgcgtttatccagtaccgcatcactttacggggcggccagggcctggtgtcgtttcgcaccagcgaagccatcaccgtgcgcgacggattgatctggcgagtcaatgaatatgcatccctggtgcatgagcagcctgcccagtccatgcgccccacggtcagtcgcctgggcttgtcgccccagcaattggggcatatggcgaacgacctgcagcagtactttgaatccaggcaaccctatctggatccggacctggacctgcaacgggtcgccaaggaagttggctacagccgcaatcagatctcctacctgctcaatcaggtgctggggcagagcttctaccgctacgtcaatcaggcgcggctccagcatttactggccgcgttggacagtgccgctgcccctgtcaaagtcgatgacctggcctttgccgccgggttcaattcactctcggcgttctacagtgctttccgccagcacaccgggcagtcgcccaaggcttacgtcaagcaaatttccctgcgtgcacgcgcgcaagacagcccctgacgccgcgctctaggatcgaccctatcgaaacgaggtaggggaacctggcatgccggcatggcgcaatatcagtctatggatggaccagctggacgacccgctggaggcgcggccgtccctggagcatgacctggatgtcaacgtggcgatcatcggcgccggctataccggcctatggaccgcctattacctgaaacgccaggccccggagctgaaaatcgccatcatcgaggcacagaccgccggctttggcgcatccgggcgcaacggtgggtggctgatgggcaatctgctgggcgaggaccgcctgctggccagcctcgcgccgcagcaacggcgtgcttcgtttgacctgctgcacggcatccctgatgaagtggcgcaggtgctggtccgtgaaggtatcgactgcgactatcgcaaaggtggcgcgctgtattgtgccgcacgctaccccgagcaggaggccagcctgcgccagtacctggacaagctgtatgcccagggccttaccgaagatgactaccgttggctcagcccgcagcagttggccgagcaggtccgtatcgccaagccctatggcggtatctatgcacctcatgtcgcgaccatcaacccggccaagctggtgcgcggcctggcgcgggccgttgaaaacctgggtgtgagcatctacgagaacagcccggtgacccattggcaatccggcagcctgcgcacggccaaggccagtgtgcgtgccgcatgggtagtaccggcagtggagggttacgccactaccttgccgcccctggggcgttaccagttgccggtacagagcctgatcgtcgccaccgagccgttgccggccagcacttgggatgacatcggcctcagtcgtggccaggcatttggcgagagcagcagacaagtcacctacggccagcgcacggcagacaaccgcttggtgttcggcgccagaggcggctatcaatttgccggtaagttgcgccacaactttgatctcaccgacagcgaagtacagctgcgtcgctacctgtttggcgaactcttcccacagttgaagagggtaaggattacccattcctggggcggcaacctcggcatgtcgcgcaatttccgtccgcacatgctctgcgaccataaaaccggcgttgcgctttccggcggctatggcggggagggcgtaggcgccaccaaccttggcggccgcaccttggccgatctgatactgggccttgaaacgcccctgacccgtcaaccctgggtgattcgcgaacgcggcctgcaagccctcaaggcctgggagcccgagccgtgccgttggctgggctataacgcgatcatccgcagctttgtccatgaggaccaggtattggccaaccccaataccgcgccctggcgccgcaggctggcaaccggcatcgccgggttcatggaaggcttcatgcattaagtcgttccactcacacgggaaaaccccatgagcatcacgcaattcaaagacgcactgaacacccgtctgccggactcatctccggtcgccgcgccattgggcgagcctatcgctgtggcctcgaccttgagcgtggagcgcactgatggggtcgagaccggtatctgggaatgcaccccagggcgctggcgccggcagatcaagtcccaggagttttgccatttcatccagggccgctgcaccttcacccccgataacggtgaacccctccatatacaagccggcgacgcactgatgttgccggccaacagcaccggcacctgggatatccatgaaaccgtgcgcaagacctacgtattgatcctgtaacgctttgatccttgatcgcctgccataacaacagccctaaaaccgccaggaaatcgaaccatgaaagccattaccctgttgcccttgatgttgctggcctccatcagccaggccgccgagaccgtgaagatctacaactggtcggactacattgcgccggacaccaccaagaacttccagaaagacaccggcatcggtttcacctacgacctgtacgacagcaacgaaaccctcgacggcaagttgatgaccggtaaatccggctacgacgtggtgttcccgtccaatcacttcatggcccgtcaaatccagggcggcgccctgaaaaagctcgacaagagccagttaccgaactggaagaacctcaacccggtgctgctaaaggccgtggaaaacaacgacccgggcaacgagcacggcttcccgtacctgtggggcagcaccggcatcggctataacatcgacaagatcaaggccgtgttgggcgataacgcgccggtggattcctgggacctgatcttcaagccggaaaacatgtccaagctgcaaaaatgtggggtggccatcctcgacaatggcccggagctgctgccggcagcgctgaactacctgggcttgccgcaccatagcaaaaagcccgaggactacaaaaaagccgaagacctgctgatgaaagtgcgaccttacgtggcgtatttccactcctcgaaatacaccgctgacttggccaacggcgatatctgcgtggcggtcggcttttccggcgatatcctgcaggccgaaagccgcgccaaggaggccaggaacggcgtgaacatcggctacaacattcccaaggaaggcgcggccatctggttcgatatggtcgccatgcccgccgacgcgcccgatgaaagagccggctatgccttcatgaactacctgcttcgcccggaagtgatggccagcattaccaactacgtgcattacgccaacggcaacgcggcggccgatagcttggtggatccggcgatcaaggcggacaccaaggtgtatccgagcccggatatgatgggtaagttgtttgcactggaagccatgccgttgaatattgatcgaattcgcacgcgcgtgtggaataccgttcgcaccggacgctgattaagttggctggctcacactgtaagccagcctttttcccatccagagtggcaaataagtccgcggcgaaagcacttgaatagataatgacgtcatatttaagacatttgatgtcaaatattacgcatggaaagtgttgtttgcagtgtgagaaattcggtccgttgcacgtaacactttcacatgaacgcataatctaaaaggtgatttaaatgtcctccatacaaagccttccaccaggtggcacctggacccaacccgaaaacagccctcccgtcttgcgcggcacagaccagcgtgagcgcctggaggccaatcgcggcgaggcctcagtgctgatcggcggcggcgctgccgaccagctggtgggccggcaaggtgaaaatacattcaaatatgagcaaagtaccgactccctcagcaatgatccggacacgatcttgaacttcaatcccaaggaagacgagatcgatgtgtcattggtactaaaagaccacaatatatcggctattaacattcaaccgggcccacccgtggacgtcggtgatgtgcagttgagtcatgagtttggtgtgagtaccttgaatatcaaggtcacccctgaggggccgaacttttctgtgcgcgttgacggtgtaaatctattgccggagcatatcaacttctttcattcggactaaacctacggattatccaggtcgtgccccaatgattggatgaataaagaaaacaactcgggctgggacgagatgtccagcttggcgtacaaatgcctgcggtgcactttcacggtgtccggcgagatcttgaggcgttcggccatggccttggaagaaaaaccgcgcaataccaggcgggcgatttccagttcgcgatccgagagcacaccactgccaaagtggctcaatgcgtctcggatctggctgtccatcgccggagcccgctgagtgctttgttgccagtgctgctgcatcagcggcagcacccaggccgccagcgtggtcaacagcccggtttcctcgaaactgaaccgtcgctgcatgcccagcgacagtgacagcgtgcccgcgccgggcaattgcaggataaattgcacctcgtcttccagcacgttgtcgtggaagtagttgagaaagtactcactctggcggaaatggtccggcgccacttcctccaggcggtaaacgccgctggcatattgctcgcggcacgcctggtaaaacggatcgagcaggtacaggccattgaggtacaccagcatcgaagcaggtttgctgctgggttgggcgtcgtattcctccagggcctggggcgggccatccagcgggtagaaaatcgccagggcgttatcgaagggcaggcattggtgcagcaacagcaccagctgtttccagaaccgttcggtgccgatctgtgacagggtgcggcccaaccccgcgtgcatgccgatttccctgaacaaactcatgtagcaggctcccaccatcaaaaggtcggccaagggttcggcttttagcgggcatcgtcaaggggagtacgccaataggggaattggctgatagatccagggccgataacgtcgtagtcatccagcgggaagcatatcccgcaaaaacatcatttttcgtttctgcctcacaccaaaaacaacgacagaggataacgatatgagtgctacccccgcgcccgatggcgtgctcaagcccaccctgagcgtctttgatgtagtggccattaccgtttccgcggtaacgccagccagttccgtattcgtgattgccccgtttgccatccagcaggcgggcagcggcgtgttcctcgcttttgtgatggccgcgttgctggcgctgatgttcgccttctgttacgcggagctgggccgtgcccataacagcgccgggggtgagtatgtgtatgccaagcgggtgttcggcggcatggccggctacgcgacgtttctgaccgtgctggtgatgttgctgtttatcccgccggtattggcgaccggtgcggcgacttacctgaataacgccctgggcacgaacttcgattcacagaccgtcgccctggtgatcgtggtatccagctacgccctgggtattctcaatatcaagctcaacgcctggatcaccggcacgtgcctgctgctggaagtggcggccttgctggtgatcgtggtgatcggctttggcaacccggtgcagccggccagtgtgttgttccagccgcagatcgtcgaaaacggcgtgttgcacttggcgccctgggccctggtgatcggcgcggttggtatcggcctgttctcgttcaatggttacggcccggcggtgttgctggccgaagacatgaaatgcggcggcaagggcgtacacaaggcggtgttgtggtccctgggcctggtggtggtgatcgagctggtgccgatcacggcattgttgattggcgcgccgtccctgagcgcgatgatcagcagccccgatcccatcggttacctgttgaccagccatggcaatgaaaccctgtcgcgactggtcagtgccgggattttcctgtcagtgttcaatgccattgtcgccatcgtcatccagattggccgcgtggtgttcagcagcggtcgtgatgcgttgtggacgccgagcatcaacaagctgttcacgcgcattcacccgcgctgggattcgccgtggctggcgacgctgttcctggcgattccttcggcgctgttgagtttcagctcgaacctggccgacctgacctcgttcagcgtcttgctgatcatgctggtgtacctggtggtggcgctgagtgcgctgatgagccgggtactgctgcgtgatcgcgagcatccctatcgcatgccgttgtggccgctgccggccttgctggcggtgctcggcgcggggtacctgctggtgaccttgatcctggaggcatcggtgcgcgacatcatgatcatcatcggcttgctggccctgtcggtgattctgtattgcatcagtggccggttgagcccggcgttccagaaattgtaaggagtgggtatgcgagcacgtcaattgggcatcacgttggggctgggcacgcccggcgaattgaatgccatcaccgatgttcccggggttcgcgtgggtcacaccacgcttaaggcagagatcgacggcaagcaggtccgaaccggggtcacattgatccaaccgcgtgccggggaagcgcggcaccaaccttgtttcgccggctaccacgtgctcaatggcaacggcgacgccaccggcctggagtggatcggcgaggcggggctgttgaccacgccgatggcgattaccaacacccacagcatcgggattgtgcgtgacaccttgatcgccctggagcgcgagcgcctggcggacccggcagtgtactggtgcatgccggtggtcatggaaacctacgacggcttgctcaacgatatctggggccagcatgtgcaacctgagcatgtacgccaggccctggaaaacgctgaaagcggaccggtgcaggagggcgcggtgggcggcggcaccggcatgatctgccacgagttcaagggcggtatcggcacggcgtcacggcgtttgccggcggagcagggcggctggaccgtcggcgtactggtgcaggccaaccatggcaagcgccaggagctgcgggttgatggttatcccgtaggacgtcacttggtggacattgcgtcgcctttcgctgagcggggtacgcccggcatggggtctatcgtggtgattatcgccacggacgcacccttgctgccccaccaatgccaacgcctggcgcagcgtgcatccattggcatcgcgcgcaccgggggtggcaccgaggattccagcggcgacctgtttttggcctttgccaccggtaatcaggatttgccgccggcagactacgggcgtagagacctgccactgcaaacggcgctgcacatggtcaataacgatcatatctcgccgctgttcagcgctgcggccgaggcagtggaagaggcgatcatcaacgcgatactggcgggcgaggacatgagcacgcaagagggcgtcaaagtgcctgggctgaccggcgagacgctctttgaagcattgcacaagtgcgggtggtgtatgtcccggtaataggggacaacgcactttaatagtgcgaatgatggctctttaatgctgccattgacaccgtgacaatatattggatccattattcaagtgcgccgctcaactcgagcggctttactgctatttaatatttaaatatcaccgcgtcaaacgaggcagctaaaaagcaagggttcccagtaaacactacgtgcgacttactcaagttgaacctgcgtcacattttagccgtggaaatagtggtagacgaaagatttcaagttgtgtcagttttcttacgccttcaaaagaggtgagtgataggactatcctcgcccgcgaggttcctatcgaacaaagactgatgcacttgcaaacaaggaagtacgtttatgtcaaaagtaaaagacaaggctattgtatctgccgcgcaagccagcactgcttactcgcaaatcgatagcttcagccacttgtatgaccgtggcggcaacctcacggtcaatggcaaaccgtcctacaccgtcgaccaggcagctacccagctgctgcgggatggcgccgcgtatcgggactttgatggcaacggcaagatcgatctgacctacaccttcctcacctcggctacccagagcaccatgaacaaacatggcatctcagggttcagccagttcaacgcccagcagaaagcacaggccgcactggccatgcaatcctggtcggacgtggccaacgtcaccttcaccgagaaagccagcggtggtgatggtcacatgaccttcggcaactacagcagcggccaggacggcgcggcggcgttcgcctacctgcccggcactggcgcaggctacgacggcacctcttggtacctgaccaacaacagctacacgccgaacaagaccccggacctgaacaactatggccggcaaaccctcacccatgaaatcggccacaccctgggcctggctcaccctggcgactacaacgccgggaatggcaacccgacctacaacgacgcgacctatggacaggacacgcgcggctacagcctcatgagttactggagcgagagcaacaccaaccagaacttcagcaaaggtggcgtcgaggcttacgcttccggcccgctgatcgacgacatcgccgcgatccagaagctctacggtgccaacctcaacacccgtgccggtgacaccacttacgggttcaactccaacaccgggcgtgatttcctcagcgccacatccaatgccgacaagctggtgttctcggtctgggacggtggtggcaatgacaccctggacttctccggtttcacccaaaaccagaagatcaacctcaatgccacctcgttctccgacgttggcgggctggtgggcaacgtgtccatcgccaagggcgtcaccgtcgaaaacgcctttggtggcgcgggcaacgacctgatcattggtaaccaggccgctaacctcatcaagggcggggctggcaacgacctcatctacggtggtggcggtgcggaccaactgtggggcggcgccggcagcgataccttcgtgtacggtgccagttccgactcccggccaggcgctgcggacaagatcttcgacttcacctcgggttcggacaagatcgacctgtccggtatcaccaagggtgcgggcgtgaccttcgtcaatgcattcaccgggcatgccggcgatgctgttctgtcctacgcctcaggcaccaacctgggtacgttggccgtggacttctccgggcacggcgtggcggatttcctcgtcaccaccgtaggccaggcagcggtcagcgacatcgtggcgtgatgtgaagcgcgcggtgcttcggcgccgcgctctatgatggagcttgaaatgccgcgtttttcccatttgatcgcctgtgtgtcgcaggtgttgttcgtgtcggcaggagcccatgcaatggcgagcagtctggttttacccaccaccgcgcaattggccgggcattgggagttgaagcagcaggataaggtgtgtgccctggagttgctggagcaggccaattccctggatggcgatatcgcgtgtgccgcgcaatggctgggcgataagccactgacctggtcgcccacaccggatggtatatggctgtttaacgctgagggttcagggattacgcacttgaatcgccaaagcgagggtgaatatcaagcccgcactaaaaccggggaagttgtcgagctgaaacggataccttagttcaagttataagcatataactcgatttaatagttggccgagccctgtttggggcaagggtgattattgcgcgtcattcgctccaaggaagatcaaataatatggcgaagtcccataaggttgcgcccttattcagggcgttgggtgaatacaagagtattttgatcagcatcggctgctttacggcgctgattaacctgctgatgctggtgccgtcgatttacatgctgcaagtgtatgaccgtgtgttgtcctcccagaatgaaaccacgctggtgatgttgacgctgatggtcgtgggcttctttgcatttatcggcctgctggaagtggtgcgcagttttgtcgtgatccgtattggcagccagttggagcggcggttcaatctgcgcgtctacaaggccgcgttcgagcgcaacctgcagcgcggccaggggcatgccgggcagtccctgggcgacctgaccgctatccgccaattcatcaccgggcctgcgctgttcgcattcttcgatgcgccgtggtttccgatctacctgttcgtgattttcctcttcaacgtgtggctcggcgtactggccacggccggtgcggtgctgttgattgggctggcgtgcctgaatgaatacctgacgaaaaagccgttgggcgaggcgagtatcttctcccagcagtcgacccagttggctaccagccatttgcacaacgccgagacgatccaggccatgggcatgctcggcgcactgcgccagcgctggtttgcggtgcacgcgcaattcctcggtttccagaacaaggccagcgacaccggttcggtgatcagctccctgagcaaatccctgcgcctgtgcctgcaatccctggtattgggcctcggcgccttcctggtgatcaggggcgaaatgaccgccggcatgatgatcgcaggctccattctgatggggcgcgtacttagccccatcgaccagctgattgccgtgtggaagcaatggagctcggccaaactggcctaccagcgcctcgacgaactgctgcgcgaattccccccggaagtcgagcagatggccttgccggcacccaagggccaggtcagtttcgagcaggtcagcgccggtccgccggggcgacgcatggcgactttgcatcaggtcagcttcaacctggcggccggggaagtgctcggtgtgctgggcgcgtcgggctccggcaagtccaccctggctcgggtgctggtgggcgtctggccgaccctggccggcaccgtgcgcctggacggcgcagatatccatcgttgggaccgcgacgacctcggtccgcatatcggatatttgccccaggacatcgagctgttcagcggcagcatcgctgacaacatcgcgcgctttcgcgacgccgacccggagcaggtggtcaaggccgcgcaacaggccggtgtacatgaactgatcctgcgcctgccccaaggctatgacaccgtgctgggcgacaacggcggcggcctgtccggtggccagaaacaacgggtggccctggcccgtgccctgtacggcaacccgcgcctgatcgtgctggatgagcccaactccaacctcgacaccgtcggcgaagccgctttggccagcgccatcatgcagatgaaagcccagggcagcagcgtggtgctggtgacccaccgctcctcggcgctggcccaggctgacaagctgctggtgctcggcgaaggccatctgcaagcgttcgggccgagccaggaagtgctgcgcgcattgtccgggcagcaggaagcgccgaaagaaaaaaccggtgtcagtttcagtcgtcagtaccaggccggaaggaatccaggcgcatgagcagcatgaccgttgaacctcgttttaaagaacacgacgctggcttcttcgtaaaaatgggctggctgctgaccgttgtcggtgccggtgggtttttcctctgggccagcctcgcgccgttggaccagggcattcctgtccaaggtaccgtagtagtgtccggcaagcgcaaggccgtgcaaaccttcagccccggcgtagtcagccgaatcctggtgaaggagggcgaactggtcaagcaaggccagccgctgtttcgtctcgaccagacccagaaccaggctgacgtgcagtcgttgcaagcccagtaccgcatggcctgggccagcgtggcgcgttggcagagcgagcgcgacaatcttgccggtgtcacctttcccgctgagctgagcgccaaccccgacccggccctggcgttggtactggaaggccagcgccaattgttcagcagccgccgcgacgcgtttgcccgtgaacaggccgggattcgcgcgagcatcgaaggcgccacctcacagttgggcggcatgcgccgtgcccgcagtgacctgaccgcccaggcccaatccctgcgcgatcagctcggcaacctgcaacctttggccgacaacggctatatcccgcgcaaccgcctgatggaataccagcgccagttgtcccaggtgcaacaggatctggcgcagaacgccggggaaagcgggcgcatcgagcagggcatcctcgagtcgcgcctcaagttgcagcagcacagcgaggaatatcaaaaggaggtgcgcagtcaattggccgatgcacaattgcgcagcctgaccctggaacagcaactgacctctgccggtttcaacctgcaacacagcgagatcaacgcgccggccgatggcatcgcggtcaacctcagcgtgcacaccgaaggcgccgtggtgcgcgccggtgaaaccctgctggagatcgtgccccaaggcacgcgcctggaagtggaagggcatctgccggtgcatctggtggacaaggtggggccccatttgccggtggacatcctcttcaccgccttcaaccagagccgcacgcctcgcgtgccgggagaggtcagcctgatctccgccgaccagatgctcgatgaaaaaaccggtgcgccgtattacgtgctgcgcaccagcgtcagcgaagcggcgatggaaaaactccatggcttggtgatcaagcccggcatgcccgccgagatgttcgtgcgcaccggcgagcggtcgttgctcaattacctgttcaagccgctgctggatcgcgccggctccgcgttgactgaggaatgagcatgaagtcagtgttcatttcgctggtgctggtgtgtggcagtgcccaggccgccatgggcccgttcgatgtgtacgagcaggccctgcgcaacgacccggtattcctcggtgctatcaaagagcgcgacgccggcctggaaaaccgcaccatcggccgcgccgggctgctgccgaggctgtcctacaactacaacaagggtcgcaacaattccgaggcgcacctgcccgacgggcgtggcggcagctatcgcgacgaccgcaactacaacagctatggctcgaccttcagcctgcaacagccgctgttcgattacgaagcctatgccaactaccgcaagggtgtagcccaggcgctgttcgccgacgaaagctttcgtgataagagccaggcgttgctggtgcgggtgctgagctactacacccaggcactgtttgcccaggatcagatcgacatcgcccgcgcaaagaaaaaggccttcgagcagcaattccagcagaacgagcacttgttcaaggccggcgagggcacgcgtactgacatcctggaagccgaatcgcgctatgaactggccaccgccgaagagatccaggccctggatgagcaggacgcctcgctgcgggaattgggcgcgttgattggcgtgcaaagcgtcaacatcaacgacctggcgccgctgaaccagagctttgccgcgttcaccctgaccccggccaactacgacacctggcatgaactggcgctcaccaacaacccggtgctggcctcccagcgccaatccctggaagtggcgcgctatgaggtagaacgcaaccgcgccgggcatttgccgagaatcaccgcctatgccacttcgcgcaaacaggaatccgacagcggcaatacctacaaccaacgctacgacaccaacaccatcggcgtcgaagtgagcatgccgctgtatgccggcggcggcatctcggcctcaacccgccaggccagccgcgccatggagcaggcggagtacgagctggaaggcaagacccgcgaaaccctgatcgaattgcggcgtcagttcagtgcctgcctgtcgggggtgagcaagctgcgcgcttaccagaaagccttggtctcggccgaggccctggtggtttcgaccaagcagagcatcctcggcggcgaacgggtcaacctcgatgcgctgaatgccgagcagcagctgtacagcacccgccgcgacctggcccaggcgcggtatgactacctgatggcctggaccaaattgcactactacgcgggcaacttgcgcgacaccgacctggccaaggtggacgaggccttcggccctgtgaaatgagcatccataacaacaaataaggatggtttaaatgatcactgattcaccgcgtttcaaacccttcaccgccggctccttgctgctgctgtccgttgcggcacaggcgcaatacgccgagaccggccaaccgggtaacccggccagctggcgttcggccgagtaccagagcgactggggcctggggcggatgaaggccgacgaagcctacgctgccgggatcagcggcaaaggtgtgaaaatcggcgcgctggactcgggtttcgaccccaaccaccccgaagccgccaaggaccgcttccatggggtgaccgccaccggcacctacgtcgacggcagcgccttcagcaccacgggcgcgctcaaccccaacaacgactcccacggcacccacgtcaccggcaccatgggcgccgcccgcgacggcgtgggcatgcatggggtggcctacaacgcccaagtctatgtgggcaacaccaacgccaacgacagcttcctgttcgggccgaccccggaccccaagtatttcaagtcggtgtatagcgccctggtagattccggcgtgcgcgctatcaacaacagctggggcagccagcccaaggacgtcagctaccagaccctggatgacctgcacaaggcctatgcccagcactacaaccagggtacctggctggacgccgcggcggatgtggccaaggccggcgtgatcaatgtgttcagcgccggcaacagcggttatgcgaatgccagcgtgcgctcggccttgccgtatttccaaccggaactggaaggccactggctggcggtgtcagggctggataaagccaataaccagaagtacaacaagtgcggcatcgccaaatactggtgcatttccactcccggcgcgctgatcaacagcaccattcccgacggcggttatggggtcaagtccggcacctcaatgtcggcgccccatgccaccggggcgttggcgctggtgatggaacgctatccctatatgaccaatgagcaggcgctgcaggtgctgttgaccactgccacgcagctcgacggctcgatcacccaggcgcccaacgcgatcgtcggctggggcgtgccggacctgggcagggcgatgcatgggccggggcaactgctcggggtcatggatgtgagcctggcagccgggcagggcgatgtgtggagcaatggcatctccgaccaagccttgctccagcgccaggccgaggaccgtgccgagcacaccgcctggcagcagaccttgatcgacaagggttggcaaaacggcgtgggcgccaatgccagccagcaggaccagaccgactacgccattggcaacgcccgcgaccaggccgccgccaaacgcgtgtacgagggcagcctgatcaagtccggcgccggcagcctggtgctcagcggcgacagcacttatcgcggcgctaccaccgtcaacggcggcctgctggcggtcaatggctcgctgacctcggcggtcacggtgaacaacagcggtaccctcggcggctccgggcgcatcgccgcgctgtcggtgaacagcggcggccgcgtggcaccgggcaattccgtgggcaccttgcaggtagcgggagatgtgaacctcggtgcgggctcgacctatgcagtggaactgacgcccaccagcagcgaccgcattgttgcgggcggtaaggcggtattgggcggcggcaccgtcaccctggcgatggaaaacagcccgacgctgctcagccagagccaggtgcaaagcctgattggccggcaatactcgatccttgaagcggcgggcggtatccagggccaattcgggcaagtgctgcccaactatctgttcctcggtggcaccctcgactacgccgccaatgctgtacagctgaaagtcgggcgcaacgacgcgagttttgccagcgttgctgccacccgcaaccagcgcaacgtagcggcggctgccgagcaactgggcgctggcaacccggtgtatgaaagcctgctgcagtcgcagtcggttgccaccgcgcaacagggcctgcagcaactgtccggcgaaatctaccctgctgttggcgcgatgctgatcaacgacagcctgcaactgcgcaacgctgtgggcgagcgcctgcgccatgtgccggtgagcggtgaaagcaacctgtggttcaaggccctgggtgcctggggcaaaagcgaaggccgcagtgaaacggcgggttccaccacctccatcggtggcctgctggcgggcgtggatggcgcactggatgagcagacccgtgtgggtgtggtcgccggctacagcgacagctcgttgaacatgggcagtggcacgcactcatcggcgtccatcgacagctaccacttcggcgcatatgccgggcgcgaactgggcgactggcgcctgagtgtcggcggtgcctacagctggcatcgcggcgatgtgaagcgcgacctgcaactgggggacgtcagcggcaagcaaaaaaccaagctggatgcgaccaccgcgcaactgttcaccgaagcggcgtaccgcattcacttgcaaccgctggcgttggaaccgttcgccaacctggcctacgtgcatttggacagcgagtcattccacgaaaaaggcgatgccgccgccctggagcgtggcagtgaccggcgcgatgcggtgctcagcaccctcggcgtgcgtgccttgaaaaccctggccctcaatgaccaccagcaactggaactgtccggttcgttgggttggcaacacagcctgacggcggtggagtcggaagaacatttggcgtttgtcgcaggcgggcattcatttgccgtgcgcagtgcgccgttgctgcgtgacgccgccctggtgggcgtacaggccagcctggcgctgaatgcgtcgacgcgggtcaacctggattacaacggccaattgggtgggcgcgaaaaaacccaaggcgtgggcttgagcctgaactggcagttctgaagaaaatgtgggagacgcagccctaatacttgtaggagcgtgcttgctcgcgaaaaaaccataggcgacgcgtttattcaggaagcacgcgtaatcgttgacgtttttcgcgagcaagctcgctcctacagtcatcccacagggaaagtgattcacctaccggcaataagaaaactaaggaaggtcaccgtgaaaaaacgcaagtcagggttaaccatcgccatccacaccggcccgggctacccgctcaaggcgctgagctgcgtgccatacggcgcgctgctgtgttgcctggccagcctgggaaccgcccaggccgcaccctacgtagaaactggcaagctcggcgacgccgccagttggcgcagcaatgagttcaaggccgattggggcctgggcgccgtgcacgccgacaccgcgtatgccgccggctacaccggcaagggcgtcaagcttgggatcttcgaccagccggtgtacgcccagcatccggagttcgccagccccgacaaggtggtgacgattgtcaccgagggcatccgccaatacaccgacccgtatatcccggtgaaggccggcgatgccttccgctacgacggcacgccgtccaaggactccaacggcaagctgggtaatcacggcacccacgtcggcggcattgccgcgggtaaccgcgatggcgggccgatgcatggcgtggcgttcaatgcgcaaatccttaccgccgaaaacggtgacccgggtccggaagacggaatcatcctcggcaacgacggcgcggtgtacaaagcgggctgggatgggctggtcgccagtggcgcacgcatcatcaacaacagctggggcattggcattggtgatcaatatgccaagggcggccgcgatccggcgttccccaatttcaccgtcaatgaagcccaggcgcagttcaatacgatccggccgatcctcggcacgatcgcaggcggtgcttatcaaggtgccatcgatgcggcgcgcagcggtgtgctgaccatctttgccgccggtaacgactacaacctcaacaacccggatgcgatttccggcctggcctattttgtgccgcagattgcgccgaactggctgtcagtggcggcgttgcagcagaacccggacaccaccagccccaatccctatgtgatcagcaccttctcatcgcgctgcggctatgcggcgagcttttgtgtgtcggcacccggcaccaagatctacagctcgatcatcaatggcaccgacctcaccaacctgaccaccgactgggccaacaaaaacggcacctccatggcagcgccccatgtggcaggtgctgcagcagtgctgatggagcgcttccagtacatgagcggcgaccagatatccacgctgctcaagaccaccgccaccgacctcggcgcgccgggcatcgactcgctgtacggctggggcatgatcaacctgggcaaggcggtcaacgggccggggatgtttgtcaccgcagaggatattcccgccgagttccgtatcgatggcgcttacggcagcggccagttcgtggcggacctgccggggatcggcgcagtggtagatgccggtaagccgacccagcggatttgcaacgatgtgcactgcgggctggatgtgtggagcaacgacatctcgggccatggcggcctgaccaagcagggcatcggcaccctggtgctgaccggcaccaacacctatagcggcccgaccctggtcaaccagggcttgttggcaatcaacggctcgctgacttccgacgtcagcgtcggccaggccggcgtgctcggtggctcggggcgcatcggttcgctgaccgcaaaaaacggtggcaccgtggcgccgggtaattccatcggcaccttgaacgtggcgggtaacgtcacctttgagccgggctcgacctatgccgtggagttgtcgcccaccagcagcgaccgcatcgtcgccggtggtaccgccacgcttaacggcggcaccgtgaccctggccctggaaaacagcccgacgttgttgagcgcgacccaggcccaaagtctgatcggccgccaatacaacatcctgcaagcggcaggcggtgtgaccggcagctttggtgcggtattgcccaactacctgtttgttggcggcaccttgaactacgcggccaacggtgtgcagctggacgtgacgcgcaccaacagcttcgccagtgtggccgctacgccgaaccagcgcgccgtggccgccgccgccgagcagttgggcgcgggcaatggtgtgtatgaaagcttgctgctggctcccacggccgcctcggcccagggtgcattccagcaactgagtggtgaagtctacccagcgctgcaaaccgcattggtcaatgacagccgctacgttcgcgaagcggtaggcgagcgcctgcgcaatggcgagatgggcgccaccagccaagccatcgacacccgcggcaacgtgtgggtcaaggccctgggcgcctggggcaagaccgacagccgtagcgacacggcaggctataacacctccatcggcggcatgctcgccggggtggacggggcgctcgacgacgccacgcgcatcggcctggtggcgggttacagcgacacgtcgttgaacatgggcagcgacacccacagccgtgcctcggtcgacagctaccacttcggagcctatgccgggcatgaaatcggcgcctggcgcctgagcggtggcgcaacctacagctggcaccgtgccgatgtgaagcgcgacctgcaatacggcgatgtcagcggcaagcaaaaggccaaggtcgatgcacacagcacccaggtgttcaccgaggcggcgtatcgcatcaacctgcaaccgctggccctggagccgttcgccaacctggcctacgtgcacctgaacactgacagcttcaaggagaagggcgatgccgctgcgctgaaaagtggcgatgacagccgcgacttggtgttgagcaccctgggtgtgcgtgccttgaaaaccttcaatgtcaacgaccaccagcaactggaggtgtccggcaccctgggctggcagcacaacctgagcagcaccgattccgagcagcacctggcgttcgcttccggtggcccttcgttcagcgtggaaagtgcgccaatggtgcgcgatgccgcactggtcggggcacgggtcagcctggcgttgagcaaggaggcgcgggtgaacttcgactacaacggcctgctggccagcaaggagaaagtgcacggcgtcggtttgagcctggactgggcgttctaaaggcgtcactcccctgatggcgcccacggtggccatcagggggctactggtgttttggctttctctacaaatccaacaacagagaggcactaccaatgggtatttttgactataaaaacctcgctaccgaggactccaaggcgctgttcgccgatgccctggcgatcactgtgtatgcctaccacaacctggatcacggctttgccgtcggctaccagaacaatggtctcggccttggcctgccggccacactggtcggcgcgctgattggcagcagcgattcccaaggggtgatccccggtatcccctggaaccccgacgcggaaaaagccgccctcgatgcggtacaaaaagccggttggacccccatcagcgccgataccctgggttacagcggcaaggttgatgcccggggcactttcttcggtgaaaagcctgcctacgccacggcgcaggtcgaggtgctgggcaagtacgatgacgctggtaaattgcaggaagtcggcatcggctttcgtggtacgtcgggacctcgggaaaacctggtcacagacgccatcggcgacgtgatcagcgacctgctggccgcgttcgggcccaaggactatgcgaaaaactacacgggcgaagcctttggcaacttgctcggcaacgtcgcggcctacgccacggcccaaggcctgagtggcaacgacgtggtggtcagcggccacagcctgggcggcctggcggtcaacagcatggccgacttgagcgacggcaaatggtcggggttctataaggacgccaactacgtggcctatgcttcacccacccagagcgccggcgacaaggtgctgaacgtcggctatgaaaacgacccggtgttccgcgccctggatggctcgtcattcaacctgtcgtccctgggtgtgcacgacacgccccacgaatcgagcaccgacaatatcgtcagcttcaacgaccactacgcgtcaacgctgtggaacgtgctgccattttccatcctcaacctgtcgacctgggtttcacacttgcccaccggttacggcgacggcatgacccgcatcctcgattccggcttctacgagcaaatgacccgcgactccacggtgatcgtcgccaacctgtccgacccggcacgggccaccacctgggtgcaggatttgaatcgcaacgcagaggcgcacaagggcgacacctttattatcggcagcaatggcaatgacctgatcaaggggggcaggggcgcggactttatcgaaggcggcaagggcaatgacaccatccgcgacagcagcgggcacaacacgtttttgttcagcgggcagtttggcaatgatcgggtgattggctatcaagcaaccgacaagctggtattcaccgatgtgcagggcagtacggattatcgcgagcacaccaaggtggtgggcgcagacacggtgatcagctttggcgcggattcggtgacgctggtgggtgtgagcagtgtgtcgggggaggggattgttatcgcttaagttggaatgcggttgaaaactgtgggaggggggttgctccctcccacatttgatcctggttcgcctggaaagattagttttccttgcgcaccgtggccacatcatcggccttgatgcgaatgcgcttgccggcaatatcggtgaactcatagaagccgtcggctgtcttggcgttgggtgtgtccttggtcaaatactgcgtaccattttgcaatgtcacgacggtttgcgtggagcaaccggccaataccagaaaagtgagcgcaaccagtggaagccccaaattcttcatgttcattacccttaccttaaccctgaaaagtcccgccacccatggctgggggcgataaatattacgcgatcaactccctcatctgatcgcttttttacaaaaagttgcagggaccatttatctattaccgattgcaacaagcgcttagcagcggcactctgtatgcataaccagtatttgattgccttgcgccatggtcaacaccctcgaaaaccccttgtattacttgcataacttccgccaggtgctggcttggctggggcagcgctatgccgatttgctcgaggcgcacgaagagcatttcattcagcaatttgacaggttgccccaggcgtcacaggcgttattggtgcgcatggtgatgcgcaagggcgtgcattttcgcggcgccaagctcaattacctggaaatcggttgcccccatgcagcggtgggcccgttgcgcgaactgggctgggtggacgaccaaagtccgctgccgtttgcgaccttgttcaccttgctgcaaaagggcgaaatcctgaatgcgttcaggccctggatcgaccagcccaaggccaacaaggcagcctggctcgagccactggccacgcagttcagcgaacagcgcagttttgcccaatggtgtcccgatgtagacgatgtgctctatagcctcacggtgatggagttgtgtgatcgcctgcgcctgatgttcttcggcaatctgcatcaggactggtcggaattcgtgctggcagacctgggcatctacacctatgaaaaagtcccgttctgcgccgagtcacgtggtttgcgcacccgtgacgacgtgcagggtttcctgttcctgcaccaatgtcagcaagcctttgaagccggtgaggcactggatgcggtgctggcacacatcgccacgctgcataccgataacccctggctggaaaaacgtcgcgccaaactgctcttccagatcggccagtatggcgagcgctgtggcgagttggcgctggctgaacaggtttaccgacactgcacctatcccggcgcacgggcgcggttgatccgtgtattggagcgccaggaggattacgcgcaggccatggccttggcgatcgccgcccaacaagccccggaaagtgccgcggagcaccagcacttgctacgggtgctgccccgcttgcggcgcaaactgggcgagccggcgctgcccaaggccaagccacaggccgttgcgcgcctggacctggcactggtgccggagccgatgatgtcggtggaattttgcgtgcaggcgcatctgaacgagccggacgcaccggtgtattacgtcgagaacggcctgatcaattcgctgttcggcctgttgtgttgggacgcgattttcgcgccgctgccgggggcgttcttccacccgttccagcgtgggccggcggacctgcacagcgaggacttccatcaacgtcgagaagccttgtttgctgcctgcttcgagcaactggaggatgagcgctacaaggccaccatccgccaacgttacgcggacaaatggggcatccagtcgccgttcgtgttctggaacctgctcagtgaagagctgctggaacaagccctggcctgcctgcccgccgaacacctgcgccattggtttgcgcgcctgctggtggacatccgcgccaaccgcgccgggatgccggacctgatccagttctggcccgcacaaaagacctaccgcatgatcgaggtcaagggccccggcgaccgcctgcaagacaaccaattgcgttggctggcgttctgcgccgagtaccagatgccggtcacggtctgctacgtgcgctgggcggagcagagcgcttgagctacagcgtggccgtgcgggcgttgtgtgagttcaccgccaaggtcggcgaccttgacctgcgttttacgccatcgcccagcgcccaggaagggatcgtcggtcaccgcacggtggcttcccggcgtagcgcgcactatcagaacgaggtcgccctcgagggcgaatacctgcagctcaaagtgcggggcagggcggacggctacgatcccgacgccaaccgcctggaagaggtcaagacctaccgtggcgatctcgccgcccagcccgccaaccatcggcaactgcactgggcgcaggtcaaggtgtatggctggctgatgtgccagaaactcggcctcgacgacatcgacctggcgctggtgtacttcgatatcgtcggcgaaggcgagaccctgctgaaccaacatttcaacgcgccagacctggagcacttcttcaagcagcagtgcgcgctgttcctggactgggcccggcaggaaatgcaacaccgcaccgcacgtaacagcgccgcccaagccctggcgtttccccatgccgagtttcgtcctgggcaacgtgccttggctgaatcggtctacaaagccgtgagtaccggccgttgcctgatggcccaggcgcccaccgggatcggcaagaccgtcgggaccatcttcccgctgctcaaggcgctggcgccacagcaactggacaaagtgttctttctcacggcgaagacccctggacgcaagcttgctctggacgctgcccaggtgctgtacgccagcagccccgatctgccgctgcgggtacttgagctggtggcccgggacaaggcatgcgagcacccggacaaagcctgccacggcgaatcctgccccttggccaagggcttttacgaccgtctgcccgccgcgcgccaagccgcgtcccaagtgcgcctgctcgatcaacgcagcctgcgcgacgttgccttggcccatggggtgtgcccgtattacctgagccaggaaatggcgcgctggagcgaccttgtggtcgccgactacaactacttttttgatttcggcgccatgctgttcggcctcgcccagttgaaccaatggcgcgtcgcagtgctggtggacgaggcacataacctggtggaacgggcccgttcgatgtacagcgccagccttgaccaatacagccttaagaccctgcgtgacatggcgcccgaggcgctgaagaaacccttgcagcgcctgaaccgcgagtggaacgccctgcacaaggagcaagtcgcaccgtaccaggcctatgccacccggcccgaaaaactgctgcaagccctgagcctgtgcatcagcgccatgggcgactatttcaacgatcaccccgaagccctcagcggcgacctgcaggctttctactttgaagccctgcaatgggccaaagtggcggagctgttcaatgaacatttcatcttcgatatcagcaagcgccagttcaacggcaagcgcagcagctcaaccctgtgtctgcgcaatgtggtgccggccgagttcatccggccccgattgaccgcagcccgcagcagtgtgctgttttccgcaaccttgagcccgcgtcactattacgccgacttgctcggcatgccagcggacaccgcctgggtcgatgtggagtcgccgttcaaggccgagcaattgcaggtgcgtatcgtcgatgccatctccacccggttcgtgcatcgccaggcctcgcttacgcctattgtcgagctgattgcgcggcaatttgtcgaacagccgggtaactacctggcgttcttttccagcttcgattacctgcaacaggtggcgcagttgttggccgagcggcacccgcagattgcgcagtggctgcaatctcggggcatggccgaggccgaacgccaggcctttctcgaccagttcacccagcacagccaaggcattggctttgcggtactgggcggtgcgtttggcgaaggcatcgacttgcccggtgcgcgcttgatcggcgccttcattgcgaccctgggcctgccgcaactgaacccggtcaacgagcaaatgaaggcacgcatgggcgcgatcttcggcgccggctacgattacacttatctttatcctggcctgcagaaggtcgtacaagccgcgggcagggtgatccgcagtcaacaggatcgcggtgtggtgatgttgatcgatgaccgtttcggcgaagcgcgggtagggcaattgctaccgcgttggtgggcgatcgataactgacagacgtacggcggtcaaaatgtgggagggggcttgcccccgaaggcagagggtcagctacagatgtgctgactgacacactgctatcgggggcaagccccctcccacatttggatcgcataggtatctacacaacttcgtagcagcagaccgtaaccacgatgcgcagcgagccgctcctgatcttgatctgcttttgattttgatctcaggcgccccgttaaaccacgctggccggaattcgacagggatttggggggtaaaccggcagggatgccggtttagccgccccgcgccatggatggcgcgtggcggcggccccccaaatccatggcggattacgggcacaccgagcctgggcgaggtgccgagtggtggggcaagagcgtttggttactttgcgcttttcaaagtgacccgctgtaaaagcggaaccaatattggccgttgcccaaataacggatatgtgctcggtctgatccaacatcctggtcaactgtcaggtagccatcgggagcaagccccctcccacatttggatcgcggtgcatcagttagatagctataagctcccttgccagagaagcagcggtgtaccaaagttgtgtagatacctatggctgtcgggggcaagccccacattcaaagcgtgttcgttccaccctgggcgtgaacaaacttgaacttcatcgaagcccacgtcttctaaccagattagttattgtgtggagccccgtcgtgcccagaatcatctctccaaacacgcccgaagcggccctgaccgaccacagcgagcacaacgcgaaaatcttcggctcgcccaaggaccgtctcgacttctatcgccgagagatccagtacgaaacctccatcctggccaaccgcactgacgcctacctcacggcgcagtcattcctggtcattgcctttgtctccggcatgggcaacctcaacccggagtggggcaagctgttcaccctggtggtgccggtgatcctcgccgcgctgggtatcttaagctcgctcaacgcctggcctggtatacgtgccgcctatgaaatcatcgaccactggcactacaagcaaagcgagttgctgcgcagtgaaccggtgatgggcatggcctacgatgaatcgccactgttctccgagatggagtcgacgcacaagggctatcgcaagtcgctgctgttctccatgcgtgcgccgtggttgttcatggtgttctggctggtattggggatctatgccttctatatccaggtcgacaacccgttgcgatgagcaattggaatgaacttcattgcctgacgtggcgccttacctctatgccgtacagtttcccccagcgctgcaaagaggtgcgccatgaccaacagcaaagacccccagctcgacaatcgtaatgatcccgccatcgacggtggcgagccggctcccggcaccgctgccgatgcccccaaagaccccaaggccgatagcgaccccaaggccaaggaaaacgactacagtccagacttcaagcctgagcgcgagcccaagcctgaaaccgatgcggatatcgatacccaaggcggctagaggagaggctcatgtcaaaagaactcgacgacgaactcaacgatccgggcaatgaagacccgggttcattgatggatgatgccgaagtcccgcttaatgatctggatgaggcggcggacgtcggcaataccgaaaatcaggactgacccttcgccccggcacgtcgttcataccagcccagcatcggctgggtactcaggccgtgaacgacgatgctcagggcgatcaccgacagggtaaggttcaccgccaccgtgctgctggtgccgatcagcccatggttgagcgcgtagaacaggtagtagatgctaccgatcccgcgaatcccgaaccaactcatcagcccgcgttgccgacggtccagcaggccgccccaaggcatggcaaatacactgaccgggcgaatcaccccgaacagcaacgccgccaccgccagcgcgcgccagtcccagtggctgaccagcacgatgcccaacagcgtcaccaggaacacttccatggaacgctcgaccaggctgccgaacgacagcatgtcgttcatcatcactccggcggcgatttgcgtgtcctgcaattggctgacgtcgccgtgcagggcctgttcaggttccacctcaaggtgacccaccaccggttgcgccaggtgttcggccggtgtatcggcgttgccggtggatttgacctccgcttggcgcagacccaagcccgccgcaaacacggcaaggaagccgtagccgccgacggcttcagctgccacgtaagccagggcgatcagtgccagggtcaggtagtcattgggcgacaaggtgctgtcggcattggtgatgcgcatgcgcaacgtgacccggccaatgccacgccccatccagtagccaatcagcagccccgccggcaccgcccatagcaggtttttcagtacccagccgcccagccagtcgccgtcaaacccgccgtgttgcatgaacagcaggccgaatatcacaaaggggaaggctgtaccgtcgttcaaaccggcctcgccggacaaaccgaagcgcagggcgtcatagtcctgggcattgttgacctgcaccaggccggccagcaccgggtcggtcggcgcgagcatggcgcccaccagcagcgagacgccccacgacagttgcaacaggtagtgcagcaccaggcaggtgccgaggatggtcagcaacatcactggccccgccatgccaaacgcaatgcgccaagtgcgatggcgcagtggcaggcgcaatttcaagccgctgacaaacagcgaaaacagcaccgcaacctcggtcaagtgctccatccagcgcgccgagcccttgatatccaggtgcaacaggtccacgcccaacgggccgatggcgatgcccagcagcagacagactgccgaggtggtcacaggcatccagcgcaggtaggaggaggtgagggcgagggtgagcaatacggcgccgagcacggccatccagagaataaaagtcatcgagcgtgttccagggccgtggtctatgcaggtttgaggacggccgagggatgcaggttcaatgtgattacagccacatgttggccgttgaacgagtgctgggtatgcactatgttgaatcctccttcccgttcacctattaacgggtccacgctttttcattttgaaccagaggccctggcatgcggttttcccccttcgtcgaacgaattgcagggcagggcgtcgccgcctgggatatccaccacgctgcgttccaggcggccagccagggcgaagacatcattatcctcagcgtcggcgacccggatttcgccacgccatccttcatcaccgacgccgccgtcaacgccctgcacatgggcgactcccattacaccgaaatccccggtcgcccggccctgcgcgaggcggtcgcggcgcgctacagcaacaccctggatcgcccgctgacggccgacaacgtgatcatcgttgccggtgcgcagaatgcgttgtttatcagctcgctgtgcctgctgcaggctggcgacgaggtattggtgctcgatccgatgtacgtcacctacgaggccacgctcaaggccggcggtgcgaccttggtgcgagtgccatgcagtgcgcaatccggctttcgcctggattcacaactgctcgctgctgcgatcaccccgcacacgcgggcgatgttcttttccaacccgaacaaccccaccggtgtggtgctcaacccgcaggaactgcaagccatcgccgaccttgcgatcgcccatgacctgtgggtggtggtggatgaggtctacgaaagcctggtgtttgacggccagtaccacagccttgcggcgctgccgggcatggctgagcgctgtgtcgtcatcggcagcttgtcaaagtcccatgccatgaccggttggcgtatcggttggctcatcgccacgccacagatggtgaagcacgccgaaaccctgatgttgagcatgctctacggcttgccgggctttgtgatggaggcggcgacggcggcggtgttggcccatgaccaggtgactgaaggcatgcgcgagatctaccggcgccgacgcgacctggtggtggctggcctgagtgcttgcccaggcatccaggtacaggcgccgcaagcgggcatgtttgtgctggtggatgtgcgtggcacaggcctcagctccctggagtttgcctggcgcctgtttcgcgaggccggggtgtcggtgctggacgcggcggcctttggcgagccggcccaggggttcgtccggctgtcgtttaccttgggtgaggagcgtctggccgaagcctgtcggcgaattgctcagtttgtcgctaatcagccaagggcggtaaacgccgttttaccggcgttttcttgatgatcgcggtgttggtttcggcataggcattgagccggtcgagcaggacgtccagatgctccatcgtgcgcacatgcaggcgtgcgataaaacaatcctcgccggtgaccttgtcgcattcggtgaactcggggatcgcctggatctgacgttccacctcctgcaatttgccgggcagggggcggatgcgcacgatggcttgcagcagatagccgaaatgcctggggtcgataacgacggtgtagtgagtcagcacaccgcgttcttccaggcgtcgcaggcgttcgctgacgctcggtgaagacagcccggtgatgcccgccagcgccttgagggacagtcgcgagtcgtccatcaaggccgcgatcaattgctggtcgatggtgtcgatcatgctatccgcctaataaggaaaggtgtttttcaggttttgccttttttagtcactgtagccgtgtcgagcagattgccataattgagcctcacttgaggagtttcaatcatggattcatccctccgtcgcgggtcgtgggaaatggtcgccgccatgctgatctcgggcagcattggctggtttgtgctggtgtctggcgtgtcggtgatcgaagtggtgttctggcgctgcgtgatcggcgcgctgacgctgttgctggtctgcgcatggctgggttatctgcgcctggacctgctgaactgggcgacgctcgggctggcagtgctcagcggcgtggctatcgtcggtaactggttgctgctgttcgaatcttattcgcgtgcatcgattgccatcagtacggcggtatacaacgtgcagccgttcatgctggtgatgctggcagcgctgtttctcggtgaaaaaatcaccgtgcagaaactggcgtggttgagcgtagccttcctgggcatgttggcgattgtcaccgcccatggcgagcaaacgagcggcggcaattatctggtgggtattgcattagccctcggcgcggccttcttgtatgcgatagccgcgttgatcatcaagcgcctcaaggcggtgccgccgcatctgatggctctgatccaggtggtcactggcgcagtactgctggcgccgctggtgccctggaatggcttgccgacatccaccaatgcctgggccgcattggtgacgttaggcgtggtacacacagggctgatgtatgtgctgctgtatggcgcgatccagaaactgccaaccgcgatcaccggcgcactgtcgttcatctacccgattgcggcgattttcgtcgactggattgccttcgggcatcgcctgggttggctgcaatggctgggggtggcggcgattctgctggcggcggcagggttgcagcggggctggtggtggccccgctcccccagggtcagtgcgtgccctgatagatgaggttttccgggttgaaatgctctacggcgctgcccggttgcggcaacccaaggatatgccccttgatcttgcccaccacatgcatttcgcagggcttgcagtcgaacttcaaggtcagcacttcgtcgccgtgaatcaactgcatcggcgctaccttggttttcaccccggtcacgcccttggcctgttttgggcacaggttgaacgagaaacgcaggcaatgcttggtgatcatcaccggtacttcgccggtttcttcgtgggcttcaaaggccgcgtcgatcagcttgacgccgtgacgatggtagaagtcccgggctttctgattgtagacattggccaggaacgacaggtgcgcctcggggtagaccggcggtggcgaggtttcagccttgcgcccgccccgtgggtgcgccttgatgcgggcagcggtcagcgcctcgatcacttcacggcgcagtgccttgagctgcgagttggggatgaagaaggcctgcggcgcatccagctcgatgcgggtggcgtggtattcggtggtgccgagctggccaagcaggtcgcgcaacgtgtcgagcgcctgttccggcttgttggccacgccaaacgggccgggcagggtgacgttggcgctgatgccttcttcgctggtggcggtgacttgcagatggtcttcacgcaggcgtgccacccatgacaggccgatacggcgctcggccgaggtcttcaacagcgcctgttgccagttatggtccaggttgcggttcagcgggtggttggggcgcaattgatgcaggccggcgggcatttcattcggttcgacgcgatagcggtagcgcttctcgccgtcttcttcgaactcacccttgggctcggcgatattggcgcggaaccccaccacttcacgcttgaccagcacattcaggccatcaccgttggacagtggctcctgggtgaccacctgcaagtcacgcttgccggctttttccaccacacccaccggcaggccggtaaaggtcggggtgtcgaacgcgccgatgtcgatcttgcggtcggtgacgaagtaatcggtgctgccacggtggaaggttttttccgggtcgggcacaaagaaatgcgcggtacggccgctggaagcgcgggcaaggtccgggcggtcttcgaggatttcgtcgaggcgctggcggtagtaggcggtgatgttcttcacatagcccatgtccttgtagcgaccttcgatcttgaacgagcgcacgccggcttcgaccagggcacgcaggttggcgctctggttgttgtccttcatcgacagcaggtgcttttcaaacgcgaccacgcggccctggtcatctttcaatgtgtacggcaggcggcacgcctgggagcaatcaccgcggttggcactgcggccattttgcgcatgggagatattgcactgcccggagaacgccacgcacagggcaccatggataaagaactcgatggcggcatcggtctcgtcggcgatggcgcggatctcttgcaggttcagctctcgggccaataccaattgcgagaaaccggcctggtcgagaaacttggcgcggcccagggtgcggatgtcggtctgggtgctggcgtgcagctcgatgggcggaatatccagctccatcacgcccaggtcttgcacgatcagtgcgtcgacaccggcatcgtagagctgatggatcagcttgcgcgcaggctccagctcgttgtcatgcaagatggtgttgatggtggtgaacacgcgggcgtggtaacgccgggcgaattccaccagttgagcgatatcgctcacctcgttacaggcattatggcgcgcgccgaagctcggcccgccgatgtagatggcgtcggcgccatgcaggatagcctcgcgcgcaatggcaacatcgcgggcagggctgagcaattccaggtgatgcttgggcaaggacatagtttttttagtcaggcttgtcacggtcgaggcgcgcattgtagccgtgaaatgcctgggcggcatctaccgcagggctgtcggccccccaggccaccccggactcaacaggtgccccccacaccggattggccaaaccagtcagccaggttgaaggctttgaccattgccgctgcaacgctctggagcgactattccagctgatttatcgagtcaaaaagtcctgaaaataaaaatacagaaggattggaaacgatgcgtgagtatttggctgccaccaccgggtttgattaccagcacaccgtcgacgccgcgctggccggcaatctgcaggcgttgaatgcctgcgtagaatgctgtgaccgccacgcgctccccgggcgtatcgctttgttctgggaaggcaaagatgggcgcagcgccacgtcaaccttcaccgagctgcaggaacaggccgcacgtttcgccaacttcctcctgtcccagggcgtcaagcgcggtgacaaggtcgcaggcctgttgccgcgcacggctgagttgctggtggtggtgctcgccacctggcgcatcggcgcggtgtaccagccgctgtttaccgccttcggccccaaggccatagagcatcgcctgaacagctccggggcagcgctggtggtcaccgacgcggtcaaccgtcccaagctggccgaagtcgccggctgcccgaccatcgtcacggtggccggagccaggggcgagggcatcgtgcgcggtgactacagcttctgggccgaactgcccaaccacgccaacgtctgcgagccggtgatgctgggcgccgacgatccgttcctgctgatgttcacctcgggcaccaccggcccctccaaggcgctgtcggtgccactcaaggcaatcgttgcgttccagggctacatgcgcgacgccgtggacttgcgccccgaagatgcgttctggaacgtcgccgacccgggctgggcctacggcatctatttcggcgtgaccgggccgctggccatggggcatccgatcactttctacgatggtccgttcaccctggaaagcacctgccgggtcatcaataaatatgggatcactaacctggccggttcgcccacggcgtaccgcctgctgattgccggaggcgagcagttcgcccgttcgatcaagggcaagctgcgcatcgtcagcagtgccggcgagccattgaacccggaggtgatccgctggttcgccgatagcctgggcgtgaccatccacgaccactatggccagactgaactgggcatggtgctgtgcaatcaccatggcctggcgcacccggtgcatgtgggttcggcgggcttcgcctcgcccggacaccgcatcgtggtgctggatgaacagcatcaggaactgcccgccggccagcccgggattctcgccatcgaccgcgaacaatcgccgatgtgctggttcgccggctatgagggcgtcaagaccaaggcgtttgtgggcaagtactacctcagtggcgacaccgtggagctgaacccggacggcagcatcagttttgtcgggcgcagcgatgatgtgatcaccacgtccggttaccgcgtcggtccgttcgatgtggaaagcgccctggtcgaacaccccgccgtggttgaagcggccgtagtcggcaagccttgcccggaacgtaccgagctggtcaaggccttcgtggtgatcagcgagcaataccgcgccaccccggagttggccgaagagctgcgcctgcatgtgcgccagcgcctggctgcccatgcttacccacgagaaatcgaatttgtcagcgacttgcccaagaccccgagcggcaagttgcaacgttttattttgcgtaatcaggaaattgccaaggcccaggcggccgtggcttgatccctttcaaaggaaacaatgatgcagattgaaaacaaggtattcctggtcagcggcggtgcttcgggcctcggtgcggccacagctgaaatgctcattgcggccggcgcgaaggtgatgttggtcgacctgaatgccgacgctgtggcgaccaaggctacccagctgggcgacaacgcccgtagtgccgtagccgatatcagccaggaagccgctgccgaagcggccgttaacgcggctgtcgaggcgtttggcggtttgcacgggttgatcaactgcgccggtgtagtgcgcggcgagaagatcctcggcaagaatggcccccacgggctggcgagctttgcccaggtaatcaacgtcaacctgatcggcagcttcaacctgttgcgcctggccgctgcggccattgctgaaaccgaggcgaatgccgatggtgagcgcggtgtgatcatcaataccgcctcggtggcggcgttcgatggccagatcggccaggcggcgtatgctgcctccaaaggcgcgattgccagcctgaccttgcccgttgcccgggaattggcgcggtttggcatccgtgtgatgaccatcgccccgggcatctttgaaaccccgatgatggcgggcatgaccccggaagtacgcgactccctggctgctggtgtgccatttccgccacgtctgggcaaacccgccgaatatgccgcgctggtgcgacatatccttgaaaacagcatgctcaatggcgaggtgatccgtcttgacggcgccttgcgtatggcggccaagtaaggagccacctgtatgaatgacccaatcgttattgtcagcgccgtgcgtacccccatgggcgggttccagggcgatctcaagagcctgaccgcgccgcaactgggcgcggccgtgatccgcgccgctgtcgaacgtgccggtatcgccaccgacgccgtcgacgaagtgctgtttggctgcgtgctgccggccgggctcgggcaggcaccgtcccgtcaggccgccctgggcgccgggctggacaagggcacccgctgcaccaccctcaataaaatgtgcggttccggcatggaggcggcgattcttgcccacgactcactgcgtgccggtagcgtcgacgtggtaattgccggtggcatggagagcatgtccaatgcgccgtacctgctggaccgcgcacgcagcggttatcgcatggggcacggcaaggtgctcgaccacatgttcctcgacggcctggaggacgcctacgacaagggccgcctgatgggcacctttgccgaggactgcgccgagcacaacggttttacccgtgaagcccaggacgccttcgccattgcttccctgactcgtgcgcaggaagccatcacccatggcagcttcgccagcgaaatcgtcccagtgcaggtcaccgtgggcaaggagcagaaaaccatcctgcacgatgaacaaccgccgaaagccaagctggacaagattgccagcctgaaaccggcgttccgtgaaggtggcaccgtgacggcggccaactccagttcgatctccgatggcgccgctgcgctgttgctgatgcgcgagtccgaggcccacaagcgcgggctcaaaccgctggcggtgattcacgggcatgcggcgttcgccgatgagcctgggctgtttccggtggcgccggtgggggcgatccgcaaactgatgagcaagaccggctggaacctcgatgaagtcgacctcttcgaaatcaacgaagccttcgccgttgtgagcctggtgaccatgagcaagctggagattccccacgacaaggtcaatgtccacggcggggcctgcgccctgggccatccgattggcgcctccggcgcacgcatcctggtaaccctgttgtcggccttgcgccagaagggcctcaagcgtggcgttgccgccatctgcatcggcggcggtgaagccacggccatggccgtcgaatgcctgtactaaggactgcttatgctgcccaatgacgaacaactgcaaatcagcgacgccgcccggcaattcgcccaggaacgtctgaaaccgttcgccgccgaatgggatcgcgagcatcgcttccccaaggaagccattgctgaaatggccgaactgggctttttcggcatgctggtgccagaacagtggggtggttgcgacaccggctacctggcctatgccatggccctggaagaaatcgccgcgggagatggtgcctgctcgaccatcatgagcgtgcataactcggtgggctgcgtgccgatcctcaagttcggcaatgaccagcaaaaagcccggttcctcacgcccctggccagcggtgccatgctcggcgccttcgcgttgaccgagccccaggccggttccgatgccagcagcctgaagacccgtgcgcgccttgaaggcgatcactacatactcaacggctgcaaacagttcatcacctccgggcaaaacgccggggttgtgattgtgtttgcggtcaccgacccggcagcgggcaagcgtggcatcagtgcgtttatcgtgcccaccgattcaccgggctataccgtggcacgggttgaagacaagctcgggcaacatgcctccgacacctgccagatcctgtttgaagacgtgaaggtgccggtggccaaccgcctgggtgaggagggcgagggctacaggatcgccctggccaaccttgaaggcggtcgcgtcggcatcgcgtcgcaatcggtgggcatggcccgtgcggccttcgaagcagcccgcgattacgcccgtgagcgcgaaagctttggcaagccgctgatcgaacaccaggcggtggcctttcgcctggcggacatggccacgcagattgccgtcgcccggcaaatggtgcattacgccgccgccctgcgcgacagcggcaagccggccttggtcgaagcgtccatggccaagctgttcgcttcggaaatggccgagaaagtctgctcagccgccttgcaaaccctgggcggttacggttacctgagcgacttccccttggagcggatctaccgcgatgtgcgggtctgccagatttacgaaggcaccagcgatatccaacgcatggtcatctcacgcaatctttaaggagccgatacatgagttacgaaaccatcttgcttgacgttcagggccgtgtcgggctgatcaccctcaaccgcccccaggcgttgaacgccttgaatgcacaactggtcagcgagctgaaccaggcgctggacggcctggaagccaaccccgagatcggctgcatcgtgctgaccggctcgaagaaagccttcgctgccggtgccgacatcaaggaaatggccgagttgacctacccgcagatctacctggacgacctgttcagcgacagcgaccgcgtggctaaccgccgcaagccgatcatcgcggcggtaaacggctttgccttgggtggcggctgtgaactggcgctgatgtgcgactttatcctggccggcgacagcgccaagttcggccagccggaaatcaaccttggcgtgttgccaggcatgggcggcacccagcgcctgacccgcgcagtgggcaaggccaaggccatggaaatgtgcctgaccggtcgctttatcgatgcggtagaagccgagcgctgcggcattgtggcgcgtatcgtgccggccgatgagttgcttgaggaggcgctgaaggtcgctacccttatcgctggcaaatccgtgccgatcagcatgatggtcaaggaaagcgtgaaccgcgcctttgaagtcagcctgtccgaaggcgtgcgttttgagcgccgggtgtttcatgcggcattcgcgacccaggatcagaaagaaggcatggcggcattcgtggccaagcgtgcgccgcagttcaaggacaagtaacaccgtctctaccacactggagatgcaaatgtgggagggggcttgccctaatgccgttcagttaaggcattttgtaggagcgagcttgctcgcgaaaaactcacaggcgccgcgttcattcaggaagcacgcgttatcgttgacgcttttcgcgagcaagctcgctcctacagagggcgatatacgcttaactgaacggcattagggcttgcccccgatggcggcctgacagccgaccagaatgttggatcagaccgagtacatatccgttatttgggcaacggccactattggttccgcttttacagcgggtcacgttgaaaagcgcaaagtaaccaaacgctcttgccccaccactcggcacctcgcttaggctcggtgtgcccgtaatccgacatgcatttggggggccgccgccacgcgccatccatggcgcggggcggctaaaccggcatccctgccggtttaccccccaaatccctgtcgaattccggccagcgtggtttaacggggcgcctaagatcaagatcagaagcagatcaagatcaagagcggctcgcttcgcatcgtggttactgacggtcgctacgtcagagttgtgtagataccaatgctcatcggggcaagccccctcccacagttttatgctctgtctcagtcagagctggtagtttttcagctccctggcaatcaccatccgctggatttcgctggtcccttcatagatctgtgtgatccgcgcatcccggtagtagcgctccaccgggtaatcttccaggtacccatacccgccatggatctgcatggccttggagcacacgcgctcggccatttccgaagcaaacagcttggcctgtgaggcttccgataagcacggcttgccggcagtgcgcaggcgcgcagcgtggaggatcagcaggcgcgcagcattcagctgggtttgcatgtcggccagcaggttggccacgctctggtgttcgatgattgccttgtcgaactgcacccgatcacgggcgtaggccagcgccgcttcaaaagccgcgcgggcgatgcccagggcctgggcggcaatgccgatgcgcccgccttccaggttggagagggcgatagccaggcccttaccgcgctcacccagcaagttggcctcgggcacgctgcattggttgagggtgacggcgcaggtgtccgaggctcgaatgcccattttgtgttcagtgcgatcaaccacaaagccctgggtatcagtgggcaccaggaacgctgaaatacccttcttgcccagttccgggtcggtcaccgcaaacacgatggccagcttggcgcgcttgccgttgctgacaaattgcttggcgccgttgatcacccattggccgtctttcaattcagcacgggtacgcaggttatgggcttccgagccagcctggggttcggtaaggcagaagcagccgatggcctggccactggcgagttcggccagccaggtttgtttttgctcttgtgtgccgtagttgaggatcggcccgcaacccactgaattatggatactcatcagggcgccggtggcaccgtcacccgcggaaatttcctcgaccgcgagggcgtaggccacgtagtccacataggtgccaccccattcttccgggaccaccatgccgagcaggccgagctcgcccatcttggcgaccagggcgtcgtcgatccagccggctttttcccaggcctgggcatggggggcgatttcgccgcgggcaaagtcccgcgccatgtcgcggatcatgacttgttcttctgtatattcaagatcttgcatggcttatttctcaatctgcacgaagtcgcggaagaagcttttgacatgagcggcgtccagctcattaacgctcggcggattccagcgcggggttttgtccttgtcgatgatcagcgcacgaaccccttcgatcaggtcgccgcgctcgaaccactggcggtctaggtgcaactccaggtcaaagcactgttccagcgtcaggtggcgaccacggcggagcatttgcagggtaacggccatggctagtggcgagcgggtctgcatcaggtgggcggtggtcaacgcccattcatgggtgtcggcgatcgtgactgcctgtaactgctcgataatgctcggcacatccggcaaggcgaagaaatggtcgatgaccggccgcaaggtcgccagtggcgcatcgggcaattgctgcgcggccagtttggcgagcacgccctgcaggtccttgaggggcgagtcgtgccattgcagacgatcaagctgctggtccagttcggggagcgttgcgctgtcgatataccagtcggccaatccgcaatacagggcgtccgccgcgcggatctgcaccccggtgacgcccaggtaagtccccagttcaccgggaatacgcgacaggaaatagctgccgcccacgtccgggaagtaaccgatggccacctccggcatggccaggcggctgcgctcggtaaccactcgcaggtctgcgccttgtaccagccccatgccgccgccgaggacgaacccgtccatcagcgccagcacgggtttagggtattggtggatgatcaggtcgagcgcatattcctcgacgaagaaatcctcgtgcagggtgttgccgttcttgaagctgtcatacagggaacggatgtcgccgccggcacaaaaggctttctctccggcgccgcgcaatacaacggcatggacctgcggatcatcggcccaggcccgtaactgcgtggtcagcaggcgcaccatgtgcagggtgatggcatttaatccggcggggcgattgagggtgaggtggccaatatggttgcgcacttcagctaagacatcttcctgaagaccctcgctgcggcttgcttcggataaaacctgagcagtcatctgtaactccctgcttttattgttctttgtataaatgtttgcggacgaaccatcccgtgatcgtaccagtgcaaatttgccccgtacaacccggaatcatgcaggtcgtttttgcatttatgcagggttggggcctgggggtgtcccgccgccaaaatgcttcgccagggcgtgcgcacactggaggatggccttgcgcgcagcgaggtgttcaccagggtagttgataaaaccgtggtccatgcctggatactctgtgtgtcttacttgcacgccggcttttttcaaccggcgtgcataagcccggccctcatcacgcagtaaatcgcagccggcggtgagaatcagcgcttttggcaagccctgtaacgaagcccggtgcgcaggcgacaaccaggggtggtccaaagattgcccttcgcccacatattggcccagataccaggtgagcatttcagcggtcaggccggatctacccgcgaactcggcccgggaacgagtgcgcgccagacaatcgagaagcggataaagcagtatttggaaaccaatggtgggaccgtggcgttcatgggcaatctgggagataaccgctgccaggccacccccggaacctccaccggcgactgcgatccggcggctgtccagtcccagagtcgtgccttgggcggccacccattcggtgacggcgtagcaatcttccacggcggcgggaaagcgagattccggtggccgggcgtaatctacggcaacgaccgcgcacctggcccactcgcacatgatccgacagaagctgtcatgggtatccaggtcaccagctacccagccaccgccgtgaaaatacagcaggaccggggcaggcgcggttgtcgactgccggtacaggcgtatacgcaccgagcgcggcgccgtctcgaccgagcaatcctgaacgctcatcaccacagcatcacgcaccgcggcgcggactttctcggctgtcatcactggccggtccatgcctgggcctctatttctatgagataggcaggcgcgatcaattgattgacgcccaacagcatggtggtcggcggacaatggctgaaaaactcctgatgagccttggcgatctgcggccaccaggcgacatcagtggtgtacatgcgtgtggcgaccacaagagtcctgtcgactcccagctgcttgagcgcggtttcgatgatttccaggcagcgtctggtctggcggtatacatcaccgggagcgtagggattgccctgctcatcgaacgccaccgtgccactggtgacaatcaggttgccagcgcgtagcgctcgacagtagccgccgttcttttcccacggtgctgcggaaaagcaacgcgtgatggtcgcgccagccggttgcagcgcgacgtggatatgactcaaaccacgaaattgcagactgttggtacgccatgctggctgttgctcgtcgatcaggcgcacatcgggaaagcgttgcagcaggcgagtaaatgcaatccttgcttcgagcttgaaaagcagcgtgcccatgcaaaaatgcgggccacggccgaacgccaggtggtcatgttgctggcgatggatgtcgaagcgatcagggtcgttgaaatgccgcggatcacgattggccgcggcgcggaccaggtataccaggtcacccttgtgcagggtctggccatgcagcgtgacgtcttcggtgacgacccgatgactcaactgcccggcggggcaaatgcgcaatgcttcctcgatggcattggggatcagccccgggttggccttgagttcggccaacgcctgtggatgggtgagcaaatagaacaggataatgcccaactgatcggcgctggtcgtcgtggctgctaccaatataaaggccaactgagccacgaagtcgtcttgggtcatcccggcctgttcgccggcggcaatcacttggctgaccagatcagcgccaggtgattggcgacgttcatcgacgagacgcgagaagtactcgtacatctcttccatcgcctgcaaggcctctcgcggcccgaatgccggatcagtgctacccaccatgaacacgatgatcgcatccgtccaacgcctgaccttcagtgcttcctgagcaggtatgccgaacatgcgcgccaggatcaatgcgggaatcttgttgaacagttctgtcatcagctctggctgggggcctaattgcgccagcaagtcatcgacgatctgctcgatatcatctgccagtgcctcaatggcacgcggggtaaaggccttgcccagtaccttgcgcccggcttcatgggccttgccgtcctgggcatacatccaacgcgaagccttgtcgatgaagggttccagtgccgctcgctggtgcgggggtacctgggcatttaccagttcgcgcatgcgattggaggagtaacggcgggcatcggcctgtgcggcggatacgtcgtcaaaccgggttagcaaccaggccttgtagtgttgcgaccagaacagtgggtggtgatgacgcaagtaggcaaatgctgcgtagggctcacctatggtttcagggtcggcaaaatccggtagtgactggagttccatgtcaatgctcctcatagagcgcgcgggtgaactgctggacataatcaggtgaatcgatcagtgcgctgaccagcacctggggcggtttgagctgcgtgaccaacgcttcgatctgcgttgagctgacctccacgccaatccgttgaggcttgcgcactccccatggatacagttgatcagcaaactcaccgatcaggtcctcgagggtcgcaggtggcagcagcccgagcgcttcggcctcctgaatcaccagatccagtgccttggcataggccagccccacagcctgtgcatgggtgaacccggtggccttgcgacattgctcgaggatctgcacttcgacgctctgggcgatgttggcgggcgggctgtcgacgaaccgtggccgcgccagggcgctcttgatcacttgataggccatgatcgagctgtcaccggcaaaggtattggcaacctcgcaatccatgcgctgagtgacgatctggttgtaatgatggaatccctgggatccacacagctctctggacagggcgatcacttcgagtccttgccatgcacccactgccttgcacaaggctgccagcacgtggagttccttgcgcttggccttctgtgcccagtcggcttcaaagcgcttgcgcactgcctgctccaggtacttgagcgcgagcgccttgagctgtatggcataaaggcgttgacgaaacatcggctggctcaacaacgccacttggcccgagggcgcctggatgaggcggtgatgggcgaagcgatagctcaggtgagcggtcagggcggcaatgtggcgaatgcctgcgatgaagatcaagcgctcttgcaggaacgttttcagcgcctcgataaaacgcagaggtaacggtaggtcgctgacgaacgtgccctcgtcagtgaagtgcgcatggcgttgcagcagcgcgtcaacgggcaacttcacctggcagaaacgtattgccgccacttggttggcgtgtattccacccttgggatcacacgtcattattttcacgccattgagcagtcgaccattttcgcgcttgcgaataaccacgcgaaaccaatggtggccttgatcctctccgtcgacgatcaggcgggcaagtaccatcagtacctgggcggcgcgcaaggcgttacctatccagcatttgcaggcctcgggcgaaggggagtcgagcaccaggctatggttttgccggtcgtacgtcaccgtcgttcgcacattgcgcacgtcggttccccctgcgacttccgtacagccgaaggcgtagaccttgcgcaggtggatcacttcgtctcgatagcgctttacctgtgcggcagagccatggttgaacaacgtgtcgacggcaatcatgtgatcgactatcgaggagtggagtgcgtaatcgaaggcgcccacgtaccccatcaactcacagagcgaagaaaactccgattgccgtggttggcccaaccacagttcgttattgatcaggccggtgtcaaagatcgcatgcatgcgcttgatggtcaggtccatgtagcttttcagcggcatgtgatggcgttggcgcggctcgaacagagacgagccgagtaattgttcgaataggtcgttcaaggtgaagctctcctgtttcgaatgagcatttcgaaacacccgagcaggagcactggcaggaaaactacgaggagggcatcagataccgaagtgatagaggcagctgctgctattgatccaaagccagacattccttgtcttcgctactggtacagcaaggccccagacatcttttgaactgcagacgacttcaagtgctatgtagactctagtcgtcatccgccaggtcgcaagcggcgcattgcaccatttgtcgtgtggtgcggataaggcctcagcccacacgacttgccagcacctcgccgatactgcgccgccgcgcatggacttcggcggcatgaatcaactgttccagctccgtgggttcgacatcgaagaattgctccatctcggccagcgccagcttgagatcggcagcggtgatagccggatcggtcacggggaggctgccgatgaaaaccggcgcaggttcgacagggcctttggggtaacgcgtgcgcgtggcgttgttgtaggccagggcacaggccagcagggcgccggcgccgagcatcaccggcgccagctggtgccagcccagtgcgattgaggctgggtcggccaataccagggtcatggccaggccgccggcgggtgggtgcaggcagcgcagccagcagatcaggatcaccgtcatgccggccgcaaggcaagcactgcccaaggtgcgccccagcacccgtgctaccagcaacgccacgatgccggcgcagagataactgcccatgatcgaccacggctgggccagggccccggatgagacggcaaatagcagcaccgccgaggccccaagcgggccgagcaggtgcagggcgacctccatgccgaatacttgggcacaggcccagacactgaacattgtgcccagcgccatgccgattgcggcacggctccattcggaggggcgggtattgattgcagcgggtaaccagcgagcgagcattgaaagacggtccataaacagcgggcgaaaaaaaaggcctgcctggtttcccggtacagccctttgaaagttccaacgtttgggggaggaacactgcgcagtgtgccgctgataaggcgtcggcaccactgcatattaatgaggtttaaatgcaaaaatgatgcagtcaaacgctatcgccataggtaatcggcccgaccggtgttggcgtggccgtgcagattttacccagcacacggatgcttgcttcttcattgaacaggcgggcctgcaggtcttcccgcagcttggggtcgtctgccaacggccccttgagtgcaaccaacgcgtcgcgtaactccatcaaacgatccagtctgggtaaaggtacagtgaacagatcctctcgcacggcattgtcctcttaatgaagtaagccatcgcgtgggcagcctacagcgtccttgttgtcatggagtgacttggcccgattgacagcagatgagccctgacaatcgggtagtagatatttagtgcacgtggcagcgagtctacagttgggttccaagcgcaggaagggaaagtgcaccagccattacgcaaaggaatgtaggtgttttcttggtgcctttgatgaaagacgcccactggctgaagagtgggcgttctttcttacgttgccatgggaaaagcactcaaggcgccgaagtggtagccaaatgcagcagtacataaggggtcttgtcgaactcgccggtgagcgtcggcgtgatcgcacgcatacgtggatcgtccagcgtttcaaagtctgcctggctcatgacgacccaagccggtgccaggatcggtttcaaatcggcaggcaattgggtaaataacggcaccttgtcacaatcgtaattaaccatgaactttatggctttcgcgtctttgcccaatgcgtgcagtaccagcggggccggctgctgcaggaccctggctttgacggcaagactgaacgtgcgggtgtcatacagccggcgttccaggggctcaaccaccatgatgtaggtggtccagagcgccatcacggcggccaaggcgggaccgtagtggcgtagccgcgccttgagcagtgccagcaaagccacgacctggagcagcccgagcacgacgaagatcagctcgaggctggccagcggctctggataacgtcgccgcgccaccaccaggccaatcgccaatagtgttggcagcagcgtccagagacccagcgtcagcccacgtagccaggcaaagaggcggccttggctgacctggaaagggtaggcggcgatgatggctgcaaacggcagcatcggcaggatataacgcgccttcttggcctggggcaccgacaggcccagcatcaccagcacaccggcggcggcgcaatagcacaccagactcaacgccgggtccggcccgcgccggccgccaaccaccacggccagcagcaccagtaatgccaacggataggccaaggcgtagttgcccatggagctggtgaagtaatacagcgcgccgccggagccttcgctgccgtccatgcgcccaaggaactgcatgcgaatcacgtcatgcatgaagtcttcgccgccactgagcttggccagcagcaataacaagccgacacacgccgccagcagcgccagtgacagcaggccgaagctgaacagctggcgccattggcggttgatcaggtaatagctgcacaacacgccagtggggattaccaggccaatcggcccacggatcgcaaaccccagcaacagcaacagaaacacccaatgcaggcgtttggcggcagcgaagtgatcatgggcataccccaggtaaaacacggccagggccacggcagctagcatctggtccagggagaccgagcgggtttcgctgacaaaagtgctgctgagcagcaacatcgcaatgctcagcaggccccagcgcggcgagtagggcgcgatcaggcgatacaccagcatcacgatcagcgccgatgcgaacgcggtaggcagccatgccgtcaggctggtgacttggccgaaaggcaacgacaacagccaggtcagcagggtcgacgtcgccaggtagtcggcatagggctgaccgtaggtggtggggaaaaagcttggcccatggcgcagcatttcctgggcaaagaccacgaagcgcgaatcgaagccgatgatcgcctggtgccagttgccggcaatgaacagcaccagcgccaggagcccaagccccagcgactggcggcggatcgttgcactctgcagggacgggaaaaccttgttcacctagccgacatccctgacctgttccacccagttttgctggggaatcggcaactcgcaggaatcgccacggccgatggggaaatacttgaagcctttgcgtgtcaggcgctcaccgtcatacaggttgcggccatcgaagatcaccggggttttcaggcgttggtgaatcaggtcgaagtccggtgccttgaattgctgccattcggtacacacgatcagtgcatcggcgccgcccagggtggactccggggtgcccatcagcatcagccgcgggtcatcgccgtagatgcgctgggtttcctgcatggcttcggggtcgaaggcgcgcacattggcgccggcagcccagagggcttccataagcactcggctgggggcgtcgcgcatgtcatcggtattgggtttgaaggccaggccccacaaggcgaacgtcttgcccttgaggttgcccttgaagaacgcgttgatacgctcgaagagcttgctcttctgccgctggttgatggcttccacggcttccagcaggtcgctggagcaattggcttgcttggcgctgtggatcaaggcacgcatgtccttggggaaacatgagccgccatagccgcagcccgggtagatgaagtggtagccgatccgcgagtcggcgccaatgcccaggcgcactgcttcaatatcggcgcccaggtgttcggccagctcggcgatctggttgatgaagctgatcttggtggccaacatgcaattggcggcgtacttggtcagctcggcactgcgcaggtccatgaagataatgcggtcgtggttgcggttgaacggggcgtacaggtcgcgcatcacttcacgcacttgctcacgttcgcagccgatgatgatgcggtccggacggcggcagtcggcaacggccgagccttccttgaggaattccgggttggagacgatatcgaagtccaggtgacggcctgcaatatgcaggttcttttcgatatgggcgcgcagggtgtcgcctgtaccgacgggtacggtggacttctccaccaggatcaccggctccacgcggtggcgggacacggcgtcacccaccgacagtacgtatttcaggtcggccgaaccgtcctcgtcggacggtgtacccacggcgatgaacagcacttcaccgtgctcgacggcgagtttttcgtcgtaggtaaagtgcaggcgtccgctttccaggttgtccttgaccatcgcggccagacccggctcgaagatggtcacgtggcctttttgcagcgactcgaccttgctcttgtcaacgtccatgcaaatgacatcgtgaccgacttcggcgagcacagtggcctgtaccaaaccaacgtaaccactaccaaatacactgattttcatggggtattcctgggacttgaggtgctagcacgacgagagttgataaccagtacaccgaggatgaccaaggccacccccagggtttttgaaagcgataaaccttcgttgaacaccggcaggctggcggccagcaggtaaaccagcgcgtagctgatgctgagcaacgaataggcgcggccaaggggcaagtccttcagcgcgccgagccagcagagcatcgacagcgcataggcgctgatcgccacgatcaccacgcccaaggcgctgaggtcgatgctgttgctggtgaaggcagccagccattcggcgggcgagggcaggcgtgtcatgctccagcgcatgcccagttgggcgccactcaccaggccgacactgcccagggccagggtgaaaccccgtacgcggctcatacctggcgccccagcaaggcaacaccggcgatcaccaacaccacacccagccagtgacggccatcgatgggttcgtgaaacacaaagcgcgccaccagcgtgaccagcacgaaattcaagctgagcatggggtaggcaatgcccacttccaggcgctgcagcaccagcagccacaccagcaggcccaggcccaggcacaccagcgccgaccataaccacggcgagcgcagtttcaacgcccaaccatccggcacgtcacgccagctttctacggcgaacttttgcgagacctggcccatgcaggtgagcaggcaggctgcgagcaacagcagcagggtgatcatggcgcgacctgcgggaaaatcaggatcacgatcttgccctgtgcatagcgcttgccatcggcaggcagcagcgcgagttcttccttttcgccggcgctattgacccgcatcaccacgccaacagcgccggtacgccgggtttgctccatccatgcctgaatcgcgttgcggtccaccaggcgcggggccgtatccgcataagtcaggccgtacttgacctctcctgaggtgttgtacagcgtgatatcggggcgtttcaggcgccatgacagcgctgaggcggcgccaaggtcattgctcaacagggcgacggtgggctgcaactcgtcgatgtgatcaatgatgaactggtcaggggtcttgttataaaccaccgaatggggcaacgccgcaggcaccaagaccaccagcaacccactgccgatcaggggcgcggcccacaatgtcaaggggcgcgccgcttgcagcagattgacgacgatccaaccgaacaagaaggtgaacaccaagaccaggctgagggtttcctcgccgggttcgtacaccggtttcttcaactggaaccagctgagggccagcagcaccagtacaccgatcgccaggttcaaccaaccgttgatgcgcaggacgcggccgtggcgctgagtgagtttgtcactcagggtcgagcccatcagcagcgccaggggcaacatgcacggcatgatgtaggaaggcagcttgcccttggccaggctgaaaaacgccaggggcatcagcagccagagcagcaggaacgccgtctttggcacgcgtttttgcagccacgcctctttggctgtagacggcagcagcgcaacccatggcagcgcgaacgccaccagcagcggcaggtaataccagaacggttcggcatgctgagcgtcttcaccggcgaagcgttggatatgctcgtgccagaagaagaagtgccagtagtccggctcttgcaggtgcacggccaacgcccacggcacgctgaccacaatcgccaccagcacggccacaacaccgaactttaacaattcacccaagcgtttttgccagagggcgtagggcagggcgaccaataccggcagcaaccaggccaggaagcccttggtcatgaaacccatgccgcacgcgaaacccagcagggcccaggaccacagtcgaccacgctgcgtgctgctgtcgaagcagaaccacaacgccacgccggtcaggttgacccagaaggtgaactgcgggtccaggttggcatagccgccgagcgccgcaacactgacgaagctcatgtacagaacggtgctgaccaggcttttctgcgggtcgttccacagccggcgagataccaggtagaccagcagaatgctcaaggcggtgctcaaggccgaggcaaaccgtacgccgaacaggttctgcccgaagaacgcctgacccagcgcgatcatccaatagcctgcggcgggtttttcgaagtagcggatgcccatgaagtgcggcgaggcccatttgccggtcagcagcatttcctggctgatctgcgcataacgggtttcatccggaatccacaggccatgggtggccagcggcagcaggtagaccacagcaaacaccagcaggagcaggggcaaagcccagcggcggatcatgcttgctgtactccgagccaaccctcgcggccgctcaatgcgccgcgcaccagctgttgctggggcagggtggccacatctgcaggcaacaactcacccaggggtttgaactcgatgccacgctgccctgcctgggcgagcaattggcgaaaatcattggccatcagaatcccttctacttctgcgtggatcgtgtagacgttgagcttcgaggcgttgaaccgatcaagaatgaagctattgaagtccttggcagccactaccggcccgacgatctcgtcgaaggtcggcaggtcaaccggaatttgtggggtgcccgcactgccatcggccaaggtcggtcgaaacaggctggtgccccggcaatcactgttgtagcgaaagttgaacccttgcttggcttgcaccacacgctcatcggcacgccaaccggcggccgccgaacaatccacgcgctcaccaaggatgtcgctcaaggtctgtacaccgcggcgaatctgctcgaccaactgtgcctcgctccagcgcccggcgttggcctgccagccatggtggtcccaggcgtgcaggccgacttcatgcccggcggccttggcctggcgcatcaaatgccccaggtcacggccgatcggcttgcctggccacgcggtgccggccagcaggatgtcccagccatacaggccggcggcattggagcgcagcatcttccacaggaattgcgggcggatcaggcgccacaggtggcgccccatgttgtccggcccgacactgaagaagaacgtcgccttcactccagcttcgtccagggactcgagcaaccgtggcacaccttcacgggtgccacggtaggtatcgacgtcgatgcgaagacctgccttcattatttggcttcgtcaatagactgggcgatttcaaccatggcctcgcgtaagaagaaatccagggtgttgccgatggtttcgctcatctgcacggtcggctcccagttcagcaggcgcttggcgttttcgatgctgggcttgcgatgcgccacgtcctggtaaccggtgccgtagaacgccttgctttccacgtcgcggaaaccggcaaacggtgggaagttatggcgcagcgggtgggcttcgaactgacgcagcagctcttcgcccaattggcgaatgctcgcttcgttttccgggttgccgatgttgatgatctggccgttgcaggcatcgttgtcgttatcgatgatgcgggccagggcttcgatgccgtcggcaatgtcggtgaagcaacgtttttgctcaccaccgtcgaacaggcggatcggcgtgccttccaccaggttgaggatcagctgggtgatggcgcgcgagctgccgatacgcgccgagtccaggcggtccaggcgcgggcccatccagttgaaggggcggaacagggtgaagttcaggcccttgtcgccgtaggcccaaatcactcgatccagcagttgcttggacaccgagtagatccagcgctgcttgttgaccgggccgaccaccaggttggaggtgtcttcgtcgaagtactggtcctggcacatgccatagacttcggaggtcgatgggaagatcacacgcttgttgtacttgacgcagtagcgcaccagcttgaggttttcttcgaagtccagctcgaacacgcgaagcggattacgggtgtattcaatcggggtggcgatggccacgaggggcaggaccacgtcgcatttcttgatgtggtactcgatccactccgagtggatgctgatatcgccttccacgtagtggaagttggggtggctgcgcaggcgctcgatggcgtcggagccgatgtccaggccgtagacctcgtaacggtcgtcgcgcagcaggcgctcggacaggtggttaccgatgaaaccgtttacccccaggatcagcacgcgggtacggcgtggcttgcgcccggactcagcgccgcgcagtacggaaccgtccaccaggcccagctcatcggccagggccgggccggccaggtacaggccattttcattgcgctggccgaaccggatcaccagagagtcttcgccgcaggcaatacgcagcgggttgacgctgatcacgcgacctggcgccaggccttcgttgcccttgaccacctcggcttgccagacaatcagcttgtgctcgccaacggcgcaaaaggcgcccgggtacggctgagtcacggcgcgaaccaggttgaacagggttgcggccggttgcttccagtccagcttgccatcggcggcggtgcggcggccgaagtaagtggcttggctttcatcctgggcggtttcagtcagcttgccctgggccagttgtggcagcgcatcgcgcagcagagtagcggcggcatcacgcagcttggcgtgcaggctcaggccggtatcggtgcgatcgatgctgaccttctgctgggccaggatggcgccggcatcggcacgcttgaccatgcggtgcagggtgacgccagtttcagtctcgccgttgaccagcacccagttggccggtgcgcggccacggtatttgggcagcaacgagccgtgcaggttgaacgcgcctttgcgggcggtggccaacagcgcttcgctgagcaggttgcggtagtagaaggagaagatgtattccgggttcagcttggcgatgcgctcgatccacagggggtggttggcgtcttccggggcgtgtaccgggatgccattgcgtgcgcagagctgggcgacggagccgtagaagttattttccctggggtcatcggcatgggtgaacacggcagcaatttcgtaacccgcactgagcagggcttcaatgcctgcacagccaatatcgtggtaagcgaagacaacagcttttgaactcatgactggacctgatcggaaggagaagtagaagtatgggaagacaccaggccgtctaccacgacgactggagccggtgctgccggctggttgcgcagcactttttcaataaagaagcgtgggcgggcgcgtacatcgctgtacatgcggcccaggtattcacccaacaggcccatgccgatgaactggccgccggtgaacacgaacagcacggcgaacagcacgaacaggccgtcaccggcccagtcggcgccgaaggccaggcgcatgatgataagtgcgaaggcaaacaacacacccagggccgccaggctgaaaccaacgatggacagcaggcgcaatggcgtggtggtcatgcaggtcagcaagtcgaacatcaggctgatcaggcgcatggcgctgtatttggattcgccgtgttcccgctcggcgtggtgcacgaggatttccgtggtgtggcgggcgaagccgttggccaggatcgggataaaggtgctgcgttcacggcaggcgagcatggcgtcgacgatcgtgcggcggtaggcgcgcaacatgcagccgtagtcgctcatggctacgccggtggagcgttgcacggccaggttgatcaaacgcgaaggccagcggcgaaaggccgagtcttggcggttgttgcgcacggtggcaaccacgtcatagcccagggcggcttgctccaccaggcgcgggatttcttcgggcgggttctgcaggtcagcgtcgagggtaatcaccacgtcaccacggcactgctcgaagccggccatgatcgcagcgtgctggccatagttgcgattgaggatcaccgctaccacgtggctgccttctgcagcggcggcgtcttcgagcagttgggctgaatcgtcgcgactaccgtcatccaccaggatgatttcgtattcgtaggccagttgctcgcacgctgcagtggtacgacgcagcaattcgggcaggctctcttgttcgttgtagaccgggataacgatcgacacgcaatgaatagggtagggtttcaaagtttcatgacctcgggctggagcaacttgacgcgtgaaaacagcagcaattattgggcaaaactacagcccgcagattacaaggcggcgctaaagataaagcgtaatcaacaggttagtcgacaaaccgcggattgctctgaagtactgcctacaaggttaagcgcaaaaatgtgcaacgaatatgaaaggcggatgaaaaactcgtttatttgacaggtagacagctagggttcagctaagtaactaaggcattacaagtacagcggcgtgggcaagatgggagcgctcgacaggggggttggttcaattttggcgcggcgggccagccgatgaggcttattcaacaatcttctctgcattggcgctcaagtgccggtaaagtaagccatctcttgccagggtactcgaatgaatagcgtgcaacttttatgcggccagttgcggcccgcgctgatgggactgttgatgacggtggcctgtgccaccagcgtgcgggccgatgacggcgtcgcactgaccagcatcgagcaggtgccggaaggcgtggaagtacgcggtaaacaggtcgctgcctacacctgggatgaccgccagggcaaaaacctgctggtgcttgccgaacaggtcagcgagcgggacgacgatggtactcagtcggccttcatctacgcggcgcagtacctgctgggcggcgaccggcccaagcgtgtgtggatgctgtacgacgacgtgcagcactgcgaattcgacgccgggctgcgctttgaccgcgccgccaccaaggtcaccgacctgctgggcgacggcaatacccaggccacggtcggctattcgcgtacctgcaccagtgatgttagccctaacgaattcaagctgatcatgcacgtcggcaagtccgagaagtaccgcctgcgaggcctcgaccgtgtgggtgccagttggtgggatgaagacgccggagccttgcgcggcatgccattgcccaccgactgcagcgtcgcggcccagcaggcgctggtcagccaatacaaggagcagggcaccgaactgccgctgccaggctgctatggcgacgagaaagacttcgccaaggcgccggacggctacctcaccttcatgcgcaaacattggttcgcgctgatgcagcagcaggatgccgactggggccagtccatggcccagcctcaggcttctggcgaggaggacgccgcggagccgtgatgccctgatattcgccgctcaaaatgtgggagggggcttgcccccgatggcggcgggtcagccacagatgcattcactgacacgccctcatcggggcatgggtatctacacaactgcccatgctgactcgctgcttgctcttgcttttgatcttgctctgcttttgatcttgatcttaggcgccccgttaaaccacgctggccggaattcgacagggatttggggggtaaaccggcagggatgccggtttagccgccccgcgccatggatggcgcgtggcggcggccccccaaatccctggcggattacgggcacaccgagcctaggcgaggtgccgagtggtggggcaagagcgtttggttactttgcgcttttcaaagtgacccgctgtaaaagcggaaccaatagtggtcgttaccgcagcaacggatatgtactcgatctgatccagcatcctggtcggctgtcaggccgccatcgggggcaagccccctcccacagggtccagtggcgtaccagaagttgtgtagatagccgtgctcatcgggggcccataccctcccacatttggatgtgtagatagccatgccgatcatgggttagactttgccctcgccaattcactaaatacatcgattaatcaacaggttaagcgatttatttaatccaaaggctgatctaccttgactgagtctatccgcaaccccctgaccctttacctcacccgcctggcaccttccagccaactgaccatgcgctatgtgctacaggatgccgccgatcgcctgggcttcgaggacatcaacctcgaagacatcgactggcacctgctgcaacccgatcatgtgatcgccctggtcgcggcgttgcgcgaggacggctatgcgccgaatacctcgtcgttatatgtgaatgccgtgcgcggcgtgatgaacgaagcgtggcgcatgagcttgatcagccaggaccacctgttgaagatgcgctcggtcaaggccgcaccgggcacacgcctgggccagggccgtaacctgcgtcgcactttgatccgcgagatgctcgaggtctgcgcagccgaccctcgcccccagggcctgcgggacgccgcagtaatcggcctgctgtatggctcgggcatgcgcaagtcagagtcggtcaaccttgacctggcacagatcaattttgacgaacgcagcctgcgggtgatcggcaagggcaacaaggagctgatcaagtacgcgccggactgggcgtttgccaaactacggacctggctggaatttcgtcgcgggcaactcaaggaaggcgaacaggacgacagcttcctgttcaaccggatccgccggggcagccatatcacccgcgaacgcatcaccaaacatgcgatttactacatcgcccgccagcgcggcgaccaggtgggcgtgaagatcatgccccatgacttccgccgctcgttcatcacacgggtgattgaagagcatgatttgtcgattgcacagaagctggcgcatcacaccaatatccagaccaccgccagctatgacgtgcgtgacgacaacgagcggcggcgggcggtggatcggtttgatttgtagcctcaggattaatgaagatcaaaatgtgggagggggcttgctcccgattagcgatggaccagctacacataagctgactgacacaccgctatagggggcaagccccctcccacaattggtctttcagagggcttagagaatcggcttgccgccagtcaccgcatagcgtgacccagagatatagctggcctcatccgaagccagcaagacataaatcggcgccacttccaccggctgccctggacgccccagcggggtttcgccgccgaagtttttcacgtcctcatcggtcatggtcgcgacgatcaatggcgtccagatcgggcccggcgccacactgttgacgcggatgcccttgtcacccagcaactgcgccaagccaccggtaaagttggcaatcgcgcccttggtggcagcgtaggccagcagtgttggcttgggcatgtccgaattgaccgagctggtattgatgatcgaactgccggccttcatatggggcagggccgccttgcagatgcgaaacatcgcggtgatgttgatatcgaaggtcttgacccattcttcatcctcgatctcttcgaaggtttcgtgagtcatctggaacgcggcgttattgaccaggatgtcgatacgcccaaactgttcgacggtcttgtccaccaatgcctggcaagtggctttttgcgcgatatcgccaggcagcagcaggcattggcgaccggcttcttcgacccagcgcgcggtttccttggcgtcgtcgtgctcatccaggtacgcaatggccacatcggcaccttcgcgggcgaaggcgatggcaacggcgcggccaatgccactgtcggcacccgtgatgagggcaattttattggccaggcggccggagcccttgtagctctgttcgccacagtcggggtacggatccatttttttctgggaacccggcacggcttgggcttgaggggcgaaaggcgggcgtggatagtcagtcatttcagtctccataggtttccaaaggtgctatggagttagtaattacgtggccggcgatagttgtaatggatgcccgcaaggcccgacgaatggtttacgccttgcctcaggaggagggcgggacgctggaggccagatgtgccggcaaacggcgcaaggtccacagcgtggtaagcattgcggcgagcgcacacaacgcgatgccaatcaacatcggcgccggggtatggtcggcgaatatccccaccagggtcatcgctacggcggcagtgaccatctggatggcgcccagcagcgccgatgcagaacctgccactgcgccatgatcttccagcgacagcaccccagccgccggtagcagcaggccgaggcagccaaacccggtaaacagcagcgccatcatcaagaccaggctgtcaccccatagcgtggtggccgccagcagggccatgaccgcggctacgcccattaccgaccagcggatcagtggcgccaggccgaaacgcgcgctcaggcgtgcggtcagctggctcatggcgaagaatgaagccgcgttaagggcaaagcacaggctgaactgcgtcggagtcaggccgaaatacttgatgtacacgaagggcgcactgccgataaagacgaagaaggtagcgaggccgaaaccgcagaccaccgacaaccctgtgaataccggatcgcgcagcagcgctccgtagctgccaaatgcattgcccagggtcttgcccaggcgacgctcggctggatgggtttccggcagttgcacgatggtcatcaccaggcacagcacggccaccaccgccagcaccgcaaacacttcgcgccagctccagatcgaaatcaccaggctaccggccaagggcgcgaggatcggcgaaacactcatcaccagcatcagcaaggccatcagccgcgcggcttcatggccggtgtacaggtcgcgaacaatcgcccgcgggatcaccattcccgcgcaggcaccgaatgcttgcacagcacgaaagccgatcagcatttcgatggtcggcgccagggcgcagccgatactgccgatggtaaaaatcaccagccccacgtagatcggcaacttgcgcccgaacacatcgctgatcgggccgtagaacagctggcacacgccgatgatcatgaaaaacaccgtcaggctcatttgcacggcggccggcgaggcctggaggctggcgccgagggtcggcagggcaggcaggtagatgtcgatggcaaacgggccaacagcggtgatcaagcccagcagcagggcgaggtgggcaatacttcgagacatgggtagatccggggcgcagcaaaggtcggttagcttaagggatcggtgcaaatccgcaaacttaggcttcactaaccagagactctggccgataacggtagcaggggtggtcaagcggttgggttcccaaccggcagtccaggtacggggatacgagcatgacgatcaaattacgcttgatgttgttgattgcgaccggattgctcactgcgttggtcatgagcgtggccggttacctgggaaataaccggatgggggcagcggtagaggacaatgaagtcagcatgactgtgctgcgcaatcacatggaagccgacatgatgcacgatgccctgcgcgccgatgtgttgtcggccatgctggtgggcctggggaaaagcaccagcaccagggatgaggtcaacacttcgctgaaggagcacgccgagcactttcgccaggtgctcggagacaacctcaagctgccggtggaagacacgatcaaggaaagcctggaaaaaatcaaacccagcctggacacctacatcagcgccggcgagcgcatcgtcgctttggcgctggataaccccgaagccgcgcgggggcaattgaatgcctttcataccgccttcagccagttggaagatcagatggctgccctgagcgaactgatcgaaggccatacgcaaaaaaccagtgccggcacgcaacataccatcagcaacgctaacttcaccctcggcgcggtattgattgccagtctggtgttgctgttgggccagggccgctgggtgaccatgagcatcatgggaccactgcaaaccgccagccgcatcgccgcgagcatcgcccggggcaacctgagcgagccgattgtggagccgcgtcgccaggatgaagccggtttgttgatcagcagtctggccaccatgcagcgcgacctgcgcggcatgatcgaggtggtgcgcagcaacgcccatggcgtcaatggcatgagcgagcgccttagccaaggttgccatgaagtggccgacagcagccagcaacaaagtagcgctgccagcaccatggcggcagccgcaagtgaaatgaccgccagcatcgaggaaatcactcgccacgccgggcgcgccctggacatggccaaccaggctgaaaatttggccaaggacggtggccgtgtcattcaccaggtggtcaaggatatggacggcatcgctcgttcagcgcagcagtcggcccaggtcatccgtacgctggataaggagtccgaggccatctacagcattatccaggtgatcaaaggcattgctgaccagaccaacctgcttgccttgaacgctgcgatcgaagcggcccgtgcgggcgagcaagggcgcggttttgccgtggtggccgacgaggtgcgcagcctggcgggacgcaccagcgcatcgacccaggaaattgccagcatggtcgggcgtatccagcaaaacactcgcgaggcggtgaccagcatggaggagggcgtctcccaggtggacaaaggcatggccgtgaccgctgaggtggagcgagctatccgcgacattcttcaggccaccttgaataccaccgagttggttaacgatatttcgcgcaccatcagtgagcagagcctggccagcaacgaaatcgcccatcaggtggaaatgattgccggcatgtcgcaaaacaacagccgcgttattggtgaaaccgcctcgaccaccgatgaattggccggtttggcgagcaaattgtcgcagtccgtggatcggttcagcctgtagcgcagacgttttttggccggctccttgtgggccggttttttttgcgtgaatgccatccttcagcaacggctcaaggccgcgtaccggcgcatgatacccggccctttcccgtgcctattcgtatgatgcgttgaatcgtgcccacaaaaaaagattgaatattcacacctaatgttatttaaataacaaaacaagagcgacgtgacctgcctggtcgtgctgcaacaaggtggaatagcaatgagcaagatcgcagtcatcggcagcaacatggtggatttgattacctatatcgaccgtatgccggcccagggcgaaaccctggaggcgcctggctttgccacgggttgcggcggcaaaggggccaaccaggcagtggcggccgccaagcttggggctgatgtcctgatgctgagcaaggtcggcgacgacatgtttgccgacaacacagtggccaacttccagcgctttggcatcgacacccgttatgtgcagcgcgtgcctggcgtttccagtggcgtcgcgccgatttttgtccgggccgattcccataacagtatcttgatcgtcaagggcgccaatgcgcatttgctgccggtggacatcgaggcggcggccgccgacctgcgtgactgcacgctgatcgtgctgcaactggagatcaatctggagacggtctaccacgccatcgaattcgctcaccgacagggtatcgcggtgctcctcaaccccgcaccggccctggccggcttgagccgtgagcacctggcgcaccttgacttcctgatccccaacgaatcggaactggcgttgatcacaggcgaagtcgtggactcgccggaatcggcccgaaccgctgcccgcggcctggtgaccagcggtatccgtcacgtgatcgttaccctcggcgagcacggtgcgctgtacgtgggggaggagggggagttccaggtgccgggggtacgggttgacgcccgtgacaccaccggtgccggcgatgcctttatcggttgctttattcaccactggaaccgcgaccgccatattcgtcaggccatggagcaggcggtggcgtattccgcgtgctcggtcatggggctggggacgcagagttcctatcccgacagcgaaacgttcgatcgctttaagcaacagcgctgacaccttcacccagcccggagaacaataatgaacaaacctgcgctgcaacagacccccgatggtttctacctgaaccgcacgccctggttcgcctttatcctgctgtgcagcatctttgcactgtgggccgccgcggcgagcatgaacgatgtgctgatcgcccacttcaagaaagcgtttttgctgagtgatttccagacggcctttgtgcagtcggcgttttacctgggctacttttttgtggcgattccggctgcgatggtggtccgtcgtttcagctacaagagcacgattctggtggggctgctgctgtacatgctgggttgcttgttgtttttcccggccgcgtccacggccaagtacggcatgttcctgctggcgctgtttgtgatcgccgccggcctgtcgttcctggaaaccgcctgcaatacctactcgacactgatggggccccgggaaaccgggacccggcgcttgaatatctcgcagacctttcacccgttcggcgccatggccggggtgtatgtgggcagtttcgtgatgttcaaggacaccgacgccaccactgaacaactggctcagatgagcgcttccgaggcagcggtgcagcaattgcagatgatccagtccacgttgttgccctataagtggatgattgcggtgctggtgctgatgtttatccttgtcgcgattacccggttccccgcgtgcaaaggcaataagcctgccgacagcaagccgggcagcgtgcgtcaaagcctggggcggctgtggcgtaacccgcgctttacctttggcgtattggcgcagtttctttatgtgggggcgcaggtcggggtatggagcttcaccatccggctggccatgcagatgggcggtatgaatgaacgcagcgcttcatggtttctgctgaccacctttgccgcctactttgtcggcaagttgatcgccaacctgttgatgcggcgcctgcatcccgccaaggtcctcgcgatctacggggtgctgtgtatcgtgctgctggcctacaccattctggtgccgaacatttcggcggtatatgcagcggtcggcgtgagtattttcctgggtccttgctggccgaccatctacggcctgaccatcgatggcctgggtgaagacaccggcgtcggcggttcattgctggtgatgagcattgtcggcggcggggtgatcccgatcttccagggcctgttgtctgacgccagcggcggcaacatgcaactggcttacagcgtgccgttgctgtgcttcattgtgatcgtgatgtatgcactcaagtgcatgcgccaacccggcgccttaccggtgggcgcgaccggggcggtggcctcatgaagacacgtatcgcgttgtaccctgcggtgtttggcgagcaggagaaagtcctgctgcaatcgtcggccttcaaggtcagtgcctggacttacccgtctggtgtactggccgtaagcctggagaatagccgtggccgattggtgatactgccttatcaggggcagatgatctggtcagccgtgttcgacggttgcgacttgaccatgagcaatctgtttgagcaaccccggcccagcccgacgatcatcgagacctacggctgcttcatgtttcacagtggcctgctgcgcaacggctgcccggcgccggatgacacgcatgccttgcacggcgaaatgccctgcgcgcccatggacacggcctggctggaggtggacgagggcgttgtgcgcctgggaggctcgtatgaatatgccaaggggttcggcgatcgctatcgggcgagtcccagcttgacactgcgcgccgattcggccctgttcgatatcgacatgcaggtaacgaacctggccggcaagcccatggacctgatgtatatggcccacatgaactatgcgtatgtggacggcgcgcggtttgtcgagccattgggcatgcagcgccagcgtttgcgcaccagcgtgccggaccatgtcaagccgacgccggcatggagcgcctacatggcgcagctggccgagcagcctgcgaaattggcctgccttgaacagccggccttgtacgacccggagatcgtgtttttcttcgacgacgttggcaccgacgccacgggccaggcgcactttctgctggatcatcccagcggtgcggcgttctacacccgctaccgtcccgaacagtttgcccacgctgcccgctggatcctgcacacgccggatcagcaagtggcggcattcgtgttgccgtccacctgcgaacccgagggctataacgccgagaaagccaaaggccacgtacgcatgctggcggctggaaccagcgcttcgttcagtgtcagcaccggttatttgagtgcacaggaacggcaacggttgctgggttaaaccagcaactgcgcgccattggcctggatgacgtccttatagctgcgggggattttcttgtcgctgaccacgtactgaaagtcttccagggcggcgaagtgcgcggtgcgcaccgtgtcgaacttactgaaatcggcaagcaatacgcgttgctgagcctggcgcatgaccttctgcttgacctcgacttcattgaagttgaagcacgttacgccaaacgcctggctgacgccggcggcagtcacaaaggcccacgtcaggcgcacgctgtcgaggatgctgctctcggcgttgctttcgaaaacctggttcttgcggtgaaaggagccaccgcacaacacgatgtggcaattgggcttgttctgcagtttgagcagcacgttcaaggaactgcacaccgcagtgaactccagcgcatcagggatgaaatcaaccacaaaaggcgaggtggtgccacagtcgaaaaataccgtatcaccggcctggatcaacgcggcggcgagtttgccgatgcggcgtttttcctcgacgtggcgggtgtcctgctcggccacccggtaatcgccgctctcattgccgatgcgggtgatatagccacccagcagccgcaggtgatcgctgaagtggttgagatcgcggcgcagggtcatctcggaaacgtccagcagtgcagccatttccttcagatgaatggcgttctggtcttgcaaggcttgttggataagcttcaatcgctcggcttttctactgtccacgagtcttccagggcttgattgttagtgttaaataagtaacattatttgttattattgtaactaattaacgtgagcgctgtgacaagcgcctcacaatcattggcaacatacaggcaagggcccattaaatgaacagtctcccacccgccgcattggccaaatacatcgatcacaccttgctggcgcccgacgcctcccgtgcacagatccgcaccttgtgcgaggaagcccgcgagcatggcttttattcggtgtgcctcaattccgcacaggtgccttatgccgcttcgtgcctgaccgacgacagggtggtgatttgcgccgtggtcggctttccactgggcgccggcctgagtgacaccaaggcttacgaagcccaacaggcgattgccgccggggcaggggagatcgatatggtgctcaatatcggctggttgaaggacgggctactggacgccgtgcgcgaagacatcgccctggtccaacaggcctgcggcgccgtgccgttgaaggtcatcctggaaacctgcctgcttgatgacaagcagaaggtccaggcctgcgagatctgccgtgacctgggtgtggccttcgtcaagacgtccaccgggttcagccgaagcggggctacggtcgaagatgtggcactgatgcgcagaactgtgggtgccagggttggggtaaaggcatccggtggcgtgcgcgattatccaacggcgttgaagatgattgaagccggcgcgacacgtttgggcagcagctctgggattgcgattgtggctggggcgatgacggcggtgagtggttattgaggtttttttgtcagagcgataaagctgcatttatataactatactaaatagtcatttagtttagttataggtattggttatatcgcaagggcacagctagctaatcctttacgctagtgtgggtacatgcacgatacttaacatttgagcatcataaagggacggtctctatgcggggaaggcttacgtcaggtctatgggtggcatgtctcctgaccagtgccacggcgctggcggatgaactgccgcgtagcgagcaggtaaaagctttccgcgctgctggatttaaccaagaggcgtcggagtgcgaagtcgagacaacgggtagctacacgccggcaaccatggagttgattgaggacctgaacggtgacggtcggccggatgcgttgattaccgaaggcagcactgactgttatgggcaagcaggtaccggattttatctagtcagccagcagcctgacggtggctggaaactcatgctcaaagaaatcggcgtcgctgagtttctccctggcaaaggcagtaatggttggcctgatgtcgaggtcggcggcccgggttcttgtttcccagtactgcgttatgacggacaacgttatcgatttcaccacagcgttggtgaacggtgtgctgactcgccgtaaacgtccgatggcccaagggtcaattggaggcaggtcagtgagggcgacgatggctgcttttgaatctggggcgcggtgatcgtcgcattagtgaaatgcgacgaacagagcccctgaaggacagtcccaatggttcgcataatgtatattatgttaaatttgatattatgaaggaagcctgtcactcgccccctaatatttctgtaaggttctgcaattcaatggatcatcagtgatgcgtcacaattgattgccgatactggtcacggcgcgaatgctgctgtccgaagaccgcactcggctcgtcattgaagcccaggataaaggcgtacgcagcgggccttgagcgcgcgccttttgagagcgcggagaaacaacgcgaagggaatcaagagcaggcgggttcaatcacaaccggctgagctgagtcggtccagcatgatattgcgggagctgtcgaagaaggtattcgatcaggctgcccgaatctcattgaattaccgatcacgccctgcagctggcgcaactcaccaccctcctccttgagccgctccagatacacatcaacgttcagtaattgataaggatcctctcagggtttagcactcacgccgattgcccaagcaagagcagcgtcttgcggtccggctcacccgaataaaactgctcgagcgcctgctgatacaccgcggggccggacgggacactcttgaacagcgtaaggcaggagcgaaatttcaggtcatcgggcgagccgaatatccgctcggcactcacccctcgatgctgcaaaacggctgcgacgcacgcctccagtcgtggcccaagcaactcatgctggaggtaggcacgagcctcggcaaggccggaaatcgcgaagcgtccggccatatcggagcgacccagcccctgcaattgcgggaagacgaaccacatccaatggctcgtcttgcggcccgcgcgcagctcgtccatgactcgactgaacaccgggcgctgagcctcgacgaaacgggacagattgaacgtatcctgcatgattcgctgctcctacgataagcgcgtcggtaatctcagttctgcgcacagtccgccgccttcgcgatttctcaaggtcagggtgccgccgagggcttgtgccagttgctgggcgatagccaggcccaggcccgtgccgccggtgctgcggttgcgcgaattttccacgcggtaaaatggctcaaccacacgggccagctcctcttcggcgatgccgggaccacgatccatcacggtcactgagaggctgtcgccgtccttcgattcgacccgcagctgcgctgcaccggcgaatttgagcgcgttatccgtgaggtttaccagcactcggcgcagcgcgtggggccgcgtgtgaatcactgcggcgcttttgccgctgagctgcacgtccttgcccatgtcctggtagtcgaacacgaggctgtcgaggaatgaatcaagatcggtacggcggctttcttcggtggcaccatgcacgctgcgggcataggcaacgccttcacgcaccagatgctccatctcgccgaggtcattccacaatttgtctttgtcgccgcagtcgtccatcaattcggcacgcagtttcatgcgcgtgatcggggtttgcaggtcgtgggaaatcgccgccagcagttgcatgcgctctttcagataggcagcaatgcgcgcctgcatggcattgaaggcgatggcagcgtgtgcgacttcggtcgggccttgttcatccagatgcaccgggtgagtattgggatcgaggttttccacggcctgggccaggcgggtcagcgggcgtatggcaatgcgcacggccagccacgcgcacagaatcatcaaggccaactggcccagcaaaaccaccggcagccacggcgacaacggcaccattgaggggcgcacgtcgatggtcacggggctgccgtcagccagtttcagatggacctggaagtgttttataggcccgggaatgtctgtcacggtcatcgggtaatccttgccgatggcctccttgatcgaggtcactgcaatcggcgtgtcacgcagggcggcgcctggcgagccttcatcgagcagatagcggtaattgcgtcgatccagttgtttcaaccaactcatgcgttcctcggcgggcaagcggtcgaggatggcaatggacgtcgacacatcggtttccagattaccgagcatggtgtttttcgcggtttcgtaacgctcgtaatactgcacgccgaaggacaaggcctgcgccagggtcagccctaccagaaagatcagcgacagccgcgagacgagggtacgaggccaatgcagcgaaggcttcatgccggtgctccaagcacttgcaccggcagcgagaagacatacccttcgctgcgcacggttttgatgtaagccggctcgcgggcatcgtcaagcaggcgttggcgcaggcggctgaccagcagatcaatggaacggtcgaacaggtcggcgtcacggccctgggtcaggttgagcaactggtcgcgattgagtacccgttgcggatggtcgaggaacacccgcagcaggcgatattcagcgccgctgagggcgaccatggtgccgttttcatcaagcagatggcgggcggatgtgtccaggcgccagcgcccgaactccagcaaccttccggtttcggtaacgaccaggttgggcggcagcatgcgcgtacggcgcagcacagcgttgatgcgcgccagcaattcacgggcggcgaacggcttgaccaggtaatcgtcggcgcccatttccaagccgatgatgcgatcggtttcgtcgttgcgggcggtcagcatcagcaccggcgtggccttgtgtttaccggcgcgaatgtcgcggcagagcaccaggccatcgtcgcctggcatcatgatgtccagcacgatcaggtcaaccggcgtggactcgagaaacgagcgcatctggcggccatccgcaaccacggtagtgcgcaggccgttcttcttcaggtagttgcctaccatctctcgaatctcacggtcatcgtccacgatgaggatgtgatcaacgtgttccatgggccaagcctctgtcaatgggaattgcggctcagtctatagagactgagtccgttcgcccgcggcggtttgtattgcagtgtatctgctctggcgaaggatacatgcagaggcaaaaacaacaatttccgggggggttgtatggccgtgtatcaggacggggtcctgatacgaaccgagttatccgcgcctgtttttgacacagacgagatacctcacgggcttctaatgagccacatcgaggccaacccaagcgcctcggctcaactgaaccacccaaccatcgaagccttgagaaaacgaccatgaacaccaataccctctatgccgcttgcctgtttgccgccctgaatatctgcaccttctcggcccgcgccgaagctgacgtcacgccgcaaacctacacctacggcacgcacctggacatccagaaagtgctggcaatgacacaggatgccggggcttcctgcggcatcgtcgatgcccaactgacctacctgaattcgcagggcaagaccgagaccctgaactaccgcaaatttgccgattgccacagcgataactgagttcggcccacatttcatcaggtgacccttatgttcctcatcgcattcctgggcggcttattgaccgtcctcagcccttgtatcctgccggtcgtgccatttctgttcgccggtatcgaccgcacacgctcatcgatcctgctcacccttggcggcatggtcctgaccttcgcgctgatttccagtctggccgtggtcagcagtgaatgggtgattcaggccaacaacaccgggcgacatgtggcactggtggtgatggcgctgtttgccttgtcgctgatctcggcgcgaatcagcggctggctggccagcccgttcgtgttactgggcaatcgcctcgacccccagacgcgcaaaatgtccgggccgctgggttcgctgatgatcggcgtcgccaccggcctgctctgggcgccgtgtgccgggcctatcctcggggtgatccttaccggcgccatgctgcaaggcgccaatgcgcaaaccagcctgctgctggcagcctacggcctgggcagtgcactgtcgttgggtacgctgattttcgccggacgcggtttagtcaatcgtctgaaggcctcgattccggtcaccggctggctgcgtcgcgccaccggttttgcggtcctggccgcagcgctgatgatttctaccggtgccgacaagacgctgttggccggggcgtcgtccgaaggcgtcagcgtgctggaaaaaggcgtgctggaacgcgtccccaaagtcgtcgaatacctggtaagcaaggccaaggccgagcccaccctcgacaacgcccaaggcccgatgccgtcgctggccggcgcggtggaatggctcaattcgcccgcactgaccagtgagtcgctcagaggcaaagtggtgctcgtcgatttctggacttacgactgcatcaattgccagcacgccctgccgtatgtgaaggactgggcgcagaaatacgagaaggatggcttggtggtaatcggcgtccacactccggaatacggctttgaacggatcatcagcaatgtcagggatgaggtgaaaaagctcggcattacttacccggtggccatcgataacaactacgcgatctggcgcaacttcgataaccagtactggcctgcgcactacctgatcgacgccaaagggcaagtgcgtttcacccacttcggagaaggtggctacaagacgcaggaaaagatgattcagcaactgctgcaggaggcgaaagctgcagccgcgtaacccttaaagaaacaatggcccacaggcaacgcgccgtgggccattggctttttctcctggggcctgggttgcgcgaccacaatctgccgctcaccccaggttaatcggacacgatgcttttggcctcaagaaatgcttccagcccaaagactccaaactcccggccgacaccggactgctttaccccgccgaacggcgccagcagctctggcgaaattctgttgatcaacaccgagccggcctgcagctggttcgccaggcgttgggcacgttccggttgccgggaaaacacataagcctgcaagccgtagatactggcattggcaatggcgaccgcttgttcttgcgagtcatacgccatgatcgatagcaccgggccgaatatctccgcttgcgcgatgtccatgtcactgctgacatcggcaaagaccgtaggcctgacgaaatagcccttatccaagccggtcggtctgccctccccgccgataatcaacgtcgcgccttgcgcctgcccgcggcggatgaaagcttgtacgcggtcgaattgggcgcgattgaccagcggcccgagagcagtggccggatcctgcggattgccgacgaccatcgctccaaccaggcttttgacgcggttgataatgtcttcggcgtgcgtgcgtggcaccagcagacgtgtgccggcgacacatgcctgaccgttgttcatgaacgcagcactcagagccaggggaatggcgatgtcgagatcggcgtcatccaggatgatagaggccgacttccccgtgagcgacagactcactcgcttcatggtctcgattgcggcgtgtgcaatgagctttccggtggcggtggacccggtgaatgaaattttcgcgatgagtgggctggcgcttatttcgtcacccacatcactgccgcgtcccaacagaatgttgaaaacccctttgggcaacgctgcgcgatgcaacgcttgggcgagcacggtggtctgcaaggggctcaactcgctcggtttgatgaccgaggcacagccagccgcaatggccgatgccagtttgctgcatatcgtcccggcggtgctgttccagggggcaaacagcgccgcgactccgaccggctccatcaccacggtcgcgtcaccgaccgtacgactcaggtcgaagtgtttcaacacctgcgccgcattggtaaatgactgcgaagcgtagcgactgacccattgcgcacgggcaaacggcgcaccgtactcttggatggcggtatcgcgaatttcattcgtgctcgccagcacggcagtctgcaactgctcgagcatgtcgatacgctcggccttggaggtgcggctcatcgcgacttgagcacgcgaagccgccgcgatagcgcgcctggcatcttcacgatcagccagggtgagcgtaccaatgacctcctcagtagccggattgatgcattgcaccgtttcattgccctgaacgggaacgaatgctccatcaatgtaactgtgattgatcttccacatcgtggcgtacctgattatgggccccagttgacgatctgtggcgagtagtcaaccgacttgatagcgtgcggataggcccgctaagtcacggcaatttcccaaggcgttgcatgagtgccgtgtcctgtcggaaactggtccttcgccagatcattgataccctcagcgtgttacttcgccgtggcggctttttcgatcaggcgagcgaccggttccgggtttgaaaccatcacgacatgtgacgcgccctcgaccacttccacggctttggcagcggcgcgcttggccatgaatgccatggcttgcgggggaatgttcttgtccttgtcgccgtagatgtaccaggacggaatatgtttccaggcggggctgccggacgcttcgttgagcgccgcttccgttaccggacgttgggtagcggccatcaatgccgcctctttcgcggggacatcagcggcgaactggttgtgaaatttgtcctgctggatgtacaaatccttgcccccatcggccagcggtacaggcgcagccagcgttgggcccagcgtgctgcccgggaatttgccggccagcccggcgacggtttccccggcctcaggtgcaaacgcactgacgtaaaccagggctttgacgttgacatgatcgttggccgcatcgctgataacggtgccgccataggaatggccgaccaacaccaccggcgaatgaatgctcgtcagcaatgccgagattgccgaaccatcgctctttacaccgcgcaatgggttggcagcagcaaccaccgggtaaccgtccttctcaagaatcttcacgacaccattccaactcgacgcatcggcaaaggcgccatgcacgagcacaatcgtgggtttttcagtttgcgaccaagcgtgtgtcgccatgctcaggctgacagcgacggccagtgcggttaatacttttttcattgttaactccgggtttgacgggaaatcagggagcgaagcgagtgaagacaaagtcgtgattacgcactcgcgcctggtgacaggcgaagcaggtttcgtgttgggcttcatcggccggtttaccgttgataaaccgcccgaatccccaaccaccggttgctgcatattttttcgagtccttgaccatcacctgcacggtcgtggccggtcccgggatggacgccggctcgaattccggggactgcacatgtttccaggccagctttaccagcaccgtgccatcggggaatggcagcgttgagtcctgataagccttgatggccaagtcattgcccagcacggctcgcagttcattcaggggtgctgcttcctgcgccggcgcaatcagcggccataggcggtagttttcaggcaatttcacgccatagatcggtgaggcgtcgccagtactggcgtcgcccgaggcaacaccggtagcggtcaacgctgcgattgcaatggcagccggcatcgcggcaagaaatttcagcttcatcatcgccctcctctcagccagttttttcaaagatgatcggcatcgatcaccgcctgggcgaaggctttcggcgcttcctgcggcaagttgtgcccaacaccgccggtgatcaatcggtactcatacttgccagtgaagcgcttggcgtacgcttcggcaggtgggtgcggtgcgccgttcgcatcaccttccagggtgatggtgggcacgctgatggatggaaatgccgcgagtttcttctccagcgcgtcgtatctggcctcgcccttgaccagccccaggcgccagcgatagttgaaaatcgacacggccacgtgatcagggttttgcaaggacgccgcgctgcgctcataagtggcgtcgtcgaaattccactgtggcgacgccagcttccagatgagcttggcgaagtcatgggtgtttttctcgtagcccaggcgcccgcgctcggtcgcgaagtagaactggtaccaccactgcagttcggcggctggcggcaatggcgccttgcccgcctcttggctgcctatcaggtaaccgctcacagcgaccagggctttgactctttccggccacagtgcggcaacgatatctgcagtgcgggcgccccagtcaaacccacccagcaccgccgtcttgatcttcagcgcgtccatgaagtcgatcaggtcgctcgccagcgcagcaggttgaccattgcgaactgtcttggccgagagaaaatgcgtatcgccataaccgcgcgcagaagggatcaacactcgatatcccttgtccgccaaagcaggagcgacatcagcgtatgcgttgatatcgtagggccagccgtgcaacaaaatgaccacagggccatcggctgggccgagttccgcgtaagaaacgtccagcagccccgctttcacatgcttaagagcaccgagagaggtgtgagctcccggcgtgatcgccccaatggtggacgcgggtacatcagccgcgctggcttgggaaaaaccgacagccaccgctgcgaattgcagcaccgctgctgccaacagcgatggggcaagaccccgcaggcggctggatttattttggttgttcagcaaggtcatctccatggtgtttctccgtagcgagccgccgaatagcggcccggtgtgttgactcgattgcgtgcgagctactgggctgtcttcgttgcgctcagcttggcgcgaagcggccggaaggcctcccgcaactcctcgctgaacaattgaggttgctcccaggaagcgaagtggccgcccttgttaacctggctgtagtaggaaagtgatgggtaagcgcgttgcgcccagctttttggcgcctgatagatctcgtgcgggaagaccgtgatcgccaccggcaccttgatgcttgcggtgttctgcgcggctgcgctgaaattgttgttgttgttttcccagtagaaacgcgatgacgatgcgcctgcgttcgtcagccagtacaggctgatatcgtccagcatctcgtcacgggtcaatacccgttcaggctgaccatcactgtccgtccacgcggcgattttttcgtacatccacgccgcagtaccggtaggcgaatcggccagcaggtaaccgatagtctgcgggcgcgtaaccatcatcgcgccgtatgctgcattgcggccgaagaaggtgctcaaggaatcaaacgccttgcgttcaggctcagtgagcccgacaggggtcgggtcaccactattgatcggcttgaccaattcgggcgggatggtggccggcatgttcaagtgaatgcccaacagacccggcggattcaggcggcccaatgcatccgatatcaccgaaccgtgatctccgccctgggaaacatagtgggtataacccaggcgcttgatgagcacatcccaagccttcgcgactcgatccggcccccagcccaattcagttggcttaccggaaaaaccgtgtcccggaatcgatggaatgatcacgtcgaacgaatcttcaaccttaccgccgtaagcaacgggatccgtcagcgggccgatagttttcaggaactcgaattgtgagccaggccatccgtgtgtcagaagcagtggcatcgcgttggggttgcgcgagcgaacatggatgaattgaatatcgacgccgtcgatagtcgtgatgaattcaggcagcgcattgagctttgcttcggccttgcgccagtcatagccgctgccccaatacttcaccagcgccttgacctgggccaactgcacgccttgggaaacgtcattgacggtctctttgtccggccagcgggttgccgcaatgcgctttttcagatcggtcaattgagcttcatcgacatgaattcgataaggtcggatcgattcgggattggtcgagggcgagctggcaactgacgcatcggcggccgggccagcagcccaggcaccaccgctgccggctatcagggccaaccccaaaacgcccattctcacggaagaagccagactatggcgccaggtgaaaccgaacgtagctgcaggcattttgaatttcctataagtcattggtcgacaacgtcgcgaaacgcgcagagatagccgcgagttaaatgagtcatccattggagagggtttgcgccttctcgatgggttcatttaaagccccgcaggtatcccgtatgtgtcatcaaccgacttaaaagaatcgctgtgtatctatctaattcgcagatacacaacgatacaaaccgaccacacgctcatcagaaagccaatgccccgactttcggggacgtggaaaacataggtgaacctgggaatgtccaatccttagctcccgcgcaacgtcgtgccttcatacgccgtgcgatacacaccaggcgcttgcaacaacggtatgacttgcacagtaaaccgattgaattgctgcgggtgcctaggctgcttgggtcaatttcttttcaacccactcatatatttatgcaattccacttatcatcacgcacaccagtacattcattccacttccaagtgggtagagttccaaatacggtactcatctctacaccccttacgcacgcccaatggcacagcaacaggagcggcccgtgaacaagttggctgagatgcattgcttcgtggtaaccgtcgataccggtagtatttcagaggccgcaaggcgtcttggaacagccaagtcggtggtgagccagcgcatccggcagttggaaaaacgccttggcattattcttttcgatcgaggtcgccaagtaagcccgactgaggcgggaaaagtgttttatcagcactgcgtacgtatccttgcggatgttgagcacgccgaagaagccattcttacgttcacatctgaattaagcggcaaccttcgtttgtcggcaccgatggcgttcagcagccgttatctgacgcagattctttcgtcctttgcgctgcgctacccgtcgttgcgcctggatattgaatatgatgaccgttatgtgaatttacaggaggagaactttgatgctgcgattcgcattggtgaattgcctgactcctccctggtcgccagaagcattgctggaaaccgccatctcatctgtgcaagtcctgggtacatagccacttatggtgcgccgcaaacgcccgaggagttggccgagcaccatgccctgctgtatgtgcatcgtgagcctcacggcatgtgggcattgccggtaggtaacttgacagagtctttccgggttcgaagccggatgcgcacaaacaatggatttcaattgctggagggtgcaaaagctggcatggggctggcgatattgcctaccttccttgccgtggatgcaatcgttgccggtgagcttcagatcgtgttgacttctcacgagcctcggggcggtaacatatcgctggtttatcgtcagtcgcagcgcacatcgcctaagttggaggccttgtcgaactttctgatcgaacagattggcagccctcctatatgggagcagcaactgacggcttatctggaaaccgtcagttgagtgtgcgcaaagcccgagatcttcgtttgctttgaaggcctggtcatgtcagctgttgaggtgttgactgaaccagctggcagcggcttcactcgtaaccttgaagttttcaacgtagggagtgaagtgccctcctttgatcatcacaagcttctttggctccagcgctttttcataggccgtgaggcatatatccgtggcggtcaagagatcgttatcccccacaatcatcaggaacggcgttgggctgatacgcgaaataaaatgacctggttcgttctcccggaacaactctgtgctcctcaaggtcacctcattcttccagttcggcgcaaaagacgtagtgttcataaagtactcataactgtctgctcctaccatggcacaggcaacgctcgggtcattggacacagccgcaatggttgcaggttgtgcacctgcaaaacgggcctgccggtcattgtcatagcgagcaagcatggcaggcaccaggtccgagcgtagccgacgcttcgccgactcatagccactgatcgagggaacctgagcaacaacgcattttacgcgacgatcgattgcagcaacttctatgacatgcccgccgctcagacttgttccccagatgccaattcgctgtggatcaatgcctggaagtgattgcacaaaagtaatggcgtcgcgatagccccgacgttgcaatacagggtccatctcctggcgcggcgtgccttcactttcgccaaagtttgcatggtcatagaccagtacatgaaaaccttgcgaacagaacacctccgcatatttatcaagatattgttccttgaccgatgtaaaaccatgcgccatgacaatagcgggtgttgcagacgaggtgttttctggctcgtaaagccagccctttaatagagtaccctcggaaataaaactaatattgctgcgtttcataacgtcctcatcatattcaaactgttgcctgtgcactaaagagcgcgcgcacaacggcctttaatcgtggtacatcacgcaaatcacggtggtaacccagccagagttcccggccgggtggaggcgctcccagatcgatcactttaagttccgggattttctcacccacgaacaccggcaacactgcgagccccagccctgccgcgcataactgcgcctgaatgatccggtcgttactgcgttgcatgacggacgcttcgggtagcaatttctgtagccatgccacatccggaaaatggttgaggtctgcattcatcagaatcaggttgaccccctcccctgtaccgctggcgacgctgtagttctgcgccgcgtacaccgcatatcgaacgtccatcaatttgcgctgaacgatatccggttggtcgaacgggacgtttctaagtgcaacgtcggcttcacgtctggataagtcgagcatgcgcggcgaagtcaggatttccactcgaatattcggatgcttgcgcgcgaagctcaccatcaagtcaggcattacataaccagcgaaccactctggacaggtaattcttatagcgccctcaaggtgctcatcatggactgccatcttgcgatttagcgccaaggcgctttgttccatgctttctgccagctcgagaatggattcgccttcggccgtgatcaccagcccctccccggtgcgctggaacagtttttggcccagtgcttcttcaagggcctgcacacggcggctgacggtaggtcggctgaccctcagttgcgttgctgcatcggcataggttccggcacgcacaacggcaagaaagaccttaacatcgccccactccatataattgctccttgtctttagtgccgttgtgctcaatcacgctgcactcatttctgaacgggatgccagaggtagtcctcgcccttcttttccaccttgccaatacctgggaaatcaatatgggcgtcggcaacccagtatcggtcagtggatgtggaggcatcctccaaggccgccttacgggtactgatcgcctgacttggggtgctgtcatagatgacggtgacttgcggctcagggaattgaaccggttgcacatggattacatcaccccagaacagcaattggtcccctccttcactgaccttgaacccggtgtgccctggggtatgcccgcgcaaatcgatggcttctatgcccgccaaaagcttgtcgccccatttgaatgttctgacacggccagcttcctggtaaggcttgagataacgtttgaccgcagagaatgcttcgggcttgtcctccttgcccaacgcaatggaggggtccgacatccagtagttcaactcattgtcattgacctccactaccgcgttcttgaacgcgcgctgctgcccgttcaacaaccctccaatatgatcggcatgcagatgggtcatcagtaccacatcgatctgatcggcgttgtagccagcggccttcatgctttcctgcaggcggccggcggtgcttccggtcagttcgccaccgccggtatctatcaggatttgcttgtccccggtatcgaccagataaacattgacggacatgcgcgcatctttattcagccctgcctgttcaagcagcgtgcttatgcgggcgccgtcgcccccctcgaggatcttgaccatatcggcaggaaggtagccgtcatagagggcgaccaccttgaacttgccgacattcatcgagtaactggcctgggcgtcgggcagcgcagatgcgaacacactattggagatagacagtgcgaatgcgaacggcagtactgctgaatacattgatttaaataggttcattgtgtggttcctgaagttggttgtgttgcgaaactgtccgctattgaacccactgagataaacgtttttgtgtgaaaaccgggcgtacaaaaatgtacgtcagcccagcagcggtcgttcgccaaatacgaaacgttgattcgctttttgccggcttatcaagcagtcgagttcggctctatcgtttcctcagcacgcatctgacctcaggttcaacaggaagaaaatgcatgagagaaacactcggtaacccctcaagaaggactctactggcaagcggtgttgcagtcgccgcaaccctggcagcaggcagtgggctgaccagtgcttacgctgccggtgagcctcataccaaagactcggacgcaagctcccgcgtggatgtgatcattgtggggggcgggtctgccggtgcggtattggccaggcgcttgagtgagaacagcaaccgtcgggtactgctgcttgaggcgggtcacagttatggtccgcaaaactatccggaaattgtcgccaacagcgacattgtcggagccaatgccaaccctgagttcgaatggggttacaagactcagccaggttacgtcgaccaccctattggggcgctgcgtggcaaggtactgggaggcagctcggctattaatggggcggtggcgattcgcgcacgtgacaccgacttcaaacgctggaatttgcccggttggagttacgaagaactgctgccttcgttcaagaaacttgaaacccgcagcggcggcgacactgccttgcatgggcacgaaggaccactgccagtacaccaactcaagcgcgcagacgtaacgccgatgcagcaggcgttcatggatgcgacgttggccaacggattcaaaatcatcaacgatttcgatggggtcgacgctgacggcgtggggccctatccgatgaacatcgtcaatggtgtgcgcatcaataccggcatggcgtacctgagcgaagaggtccgggcgcgtaagaacctcgtaatccgctcagacagtctggtggacaaagtcattttcgaaggcaagcaggctattggcgtacggctggccgatggcgagacgttgcacgccggcgaagtgatcctgtcggccggaacctatggcagtgcggccatcctgctgcgctccggggtcgggccgaaagcagacttgcaggcgttgaaaatcgagcaagtggtggagttgcccgttggccagcacctgatggatcaccccttctattacaacgcctacgcagcccggcccgaactgatcggccgacagtcacctgccattggtgccaagttgtggacccacagcagcagcgccagccatggcgatcttgatctgcacatcaccgcaacccatctgttcccgcacgaccagagcccgaccaaggtggggttcgtactcgctgtagccctcacccgcccctcgtcccagggcacgctgaccctggccagccgtgatccatttgttgcaccgcgcatcgacctgaatttcctcgcaagggaagaagaccgccagcgcctgctggagggtattcgcctggcccgcaagatcggtaacaccgcaccgctgcgggagttgattcactcggagctcaaccccggcaaaggcaacgactcggatgaagccctgctggccagcgcccgggctaccctcgatacctatcaccatcccacttcctctgcgcccatggggcgtccaggcgatgcgcgtgcggtggtagatctggatgcgcggccatttggcctgcaagggttgcgagtagtcgatgcgtccatctttccggatgtgccctcggtcgccaccaacatcaccgtaattgccttggccgagaaaatagctggccagtacgcatgacccacgaggcgacacaatgagcaaattaccggtattgaactggatcaatggccaatggctggactctggcaattacaaagactctattgatccggcaacctacgcatccatcggacaatacgccgaaggtgggttgaatgaggccagccttggtatcgaggctgcgcagcaggcatttggtcatagcccgtggtaagacgatgtgacgttgagagcccaaatgctactggagttggctgatgcgttcgagcgaaatgccgaggcattgatcgaactgctggcgctggagaacggaaagagtgaggtggacgcgcgacatctgaagcgttttggcctggaattgggaggcaagacgccaatgatggtgttcgcggacgccgatctggatgctgcgatccccgtgctggtcaaggcgctgaccgtgtttgcagggcaattttgtatgaccggctcgcgattgctggttcattgaagactggaagggcaagttggtctgtgatgattttggtggctacaaagccagcttcgagctcggcgtgaccgagatcggctgtatggcccatgcgcggcgcaagttcttagcctactgaagatcagccctactgctgggatatgggggccactctctctctgtattcacgaggcgaacacgtcataatgcgcttgaaagcgtggctaaaagcactgtcggagtcatagcccagcttttgtgctatggacgaaatggtcgtgtggtttgttttcaacaatctcgtagctaattgcatgcgccagcgcaagacgtactctaaaggggcgacaccagatttttgcttgaatcgcaaagcgaaggtcgagcgagaaacacccgcgattttggcaaggctctctactgaccaagaacgcgccggatcggcatgaatggcttgaatggttgccccgatacgtggatcagatatagcaagcaaccagctcggtgcggtatttccttcttggatcaaataaattcgtagaacctgcactagcatgatgtggccgagatgctgaaccacaatcgagttaccaagagccggattggtaagttcatgagcaatacgctgcaaggcccaattcagcacggaagcttgatccgaaccacttttgatgacggcgacgggaggcaatccgtcaaatagaaggcgagcctcctcaccgaagtcaaaacgtcccccgatcaggaaaaactcatcggctgtcccacaactggcgatgccattgacggcatggcgataaatcgcatccgagtggatggccggaaatgacaagtcgctgcggagtgaaaacgcccgcttgcgtggcagaagaaagcagtctccggccgtcaatcggataggttgctccacgccttgcaccattagccaacaagtcccttcaacgattgcattgaacttgatgccgtcgggtggtggaaaatcgatggcccaatctccaccagccttcagacctgcaaaaaaggagttatgagtatttagaagagagagggtttcggaaaggggatccataaggtgcgtaggacgatctcgacagataattggactttgctgcattcacagtcccaagtctagtctagacaatggtgtccatgggttttgccccaattccatgtcagattcacaaggacacgccatgaccagcaaacagtctcccatccactcaggttacggagcggtaaccaccgccgcagaggtacttgaagggtgcgatctatccaacaccaccgccattgtcaccgggggtcattccgggctgggcctggagacgacaagagcactgacgaaggcgggcgcgcgtgtcgttgtcgcagcgcgtgatgtagacgatgctcgcgcaaaaactagcggaatctccaatgtagaaatcgagcgacttgatctttccgatctgaccagcgtacgcgacttcgctcagcgtttcttggcaagcgaccgacacgtcgacatcctgatcggcagcgcgggaatcatggcttgcccggaaacccgagtaggggcgggttgggagtcacagttcgccatcaatcatctggggcactacgccctcgtgaatttgctatggcctgcactcaaggggcgagcaagggtggtagtagtgtcatcggcggggcatcaccaatcgggtatccgctggaacgatgtgcaatttacgcagggctacgacaagtggttggcatatgggcagtcgaagacggccaatgcattgtttgctgtccaccttgatcggcttggtcaacacgagggtgtacgggctttctcccttcaccccggcaaaattctcactccgctccagcgtcatctggcgcaggatgaaatgattgccgccggctggctagacgtcaatggccaccttgccgatccgacgttcaagacgacgcagcaaggtgcggcaacccaagtttgggccgcaacagctccacagttgaatggcatgggaggcttatattgcgaggactgtgagatcgcttcgctggatgcaaacgaaccaccatcctttgccggcgttcggccttatgccgccgacccagaccaagccgaacgcctttgggcactatcggctcagcttacagggattgacgcttttgaaaggaaatgagtgatcggtacagaatgtccatacctatgttgctatctgtccgaggctggagaacttttttggctgcgcagcgtagaaactgcccatcgagtcgccgccgctgtcgcacacgacggaagaactgggcaaagaccctgggcgaacagttgggatcctgaacatcacgccccggcagcttgccgttgagggcgccatggaggcttgcaaggacgcaatcaaggcgataggcaaatagccggccggaaggggctagccggtcaattgtgatcgatgaagctctgacggtggacggaaaggaagcgtccctgacggaacgccccttcctctatgactcagcggcgaaagagacgatctagaaccagcagcgctactgcaccaatcgcgattgcagcaactggtttttctttaacgaacgtagatacgccgtccagtacgtcgccgtaggtctgggtcaactgaccagccgcttgacgaccagcgccttctgcttccagcttagaatcaccaaacagcttcccgacgacgctctgtgtctttccagcaaccttttctgcaacaccttcgacttgttcactcttcataaatcaccaaacctttgcgtgtaattagttagctcaggttcaacctgagccaggcgctagctgcacagtgttagggggatgggcgttagcataagttcaaagttgttgaggctcgtgaggtgaccgctggattcctgctcgaattcctcgcgtttcgtttgcactccagccccgccgaccacatcagcccgccctacaagatcttgtagtcgctaaccctccacaagtcctctataaaaaaccgcacttccccctcccccaaggaacaccctgccatgcacatggaagagcacacgctgagcgcaatggatgacgagcttaaacttatgctgggtcgctttcggcatgaacaattcgtcgaaaaactagggtggcgattgcctatcccaccgcaccaggccggttatgaatgggatcaatacgacaacgagcacgcccgctacctcctggcgttcaacgagcatcgttcaatcgtcggctgcgcccggttgatacccaccacattccccaacctgctggagggcgtgttcagccttgcctgcgaaggcacaccacccaggcatcccgccatttgggaaatgacacgcttcaccacccgcgaaccgcaactggccatgcctttgttctggaaaaccctcaagaccgccagcctggcgggtgccgatgccatcgtcggaatcgtcaacagcacgatggaacgctattacaagatcaacggggtcaagtacgaacgcctggggtcggtaatcgagcatcagggcgaaaaaatcctcgccatcaaactctcggctcaccgcgaacaccaccgtggcgcccgcttaccttcagccttcacgtctgaggcgttattggaagagactgcttgataataacggccgagtcgtcctcttgggcgactcggcgcagcaggtgaacctcagatatagcccagcgcgacggcgtaagacacagcctgtacgcggttgctggcgccgattttgcgttggatgttgcgatgatggtagttcacggtgtcggtgcacacgcccatgatcacgccaatttcctccgaggtcttgccatcggcggtccagcgcaacacatcacattcgcgctcgctgaactccacatccgtgttgaacgcacgtacatcagtctccagcgccgaaatcttctccagggccgccgccgcaaacgctttggtcactggcttcaatgcttcgaattcctgaaggctgatggcgttgtccttgcgtgccaggcttaacaccccgaccctgccctgggtgttgaacgaaggttgggccaggccatggcatagcctcgagtcgttggcttctgaccacaggtccgggcagtctcggaacaactcattgctccataaaatgggggccgatgagattttgctgtgtttcaccgtggggtcgatcagcgcatagttagcggcttgatagcgttgtagccagtgctcgggatagttgccgtacatataggtcttgggccgcatgaacggcgtcacgctgcacatgccataggcgaaaaaatcgaatcgcagttcacgcaaggctctcaatgcaacaacggtgaactcctccatgttcatggcttttgcaaagatactgtaaaaataagcatcccatcccaacagctgtcctaattccattttgaacacctataacactccaagggagtcgtgagactaaaccaacctgaacatctgtcaactcccaaaatcaacagtcatagactgcttcgcactagcgacatgttttttatgtctaacccaactaactagccataggccactgtttctcagctgacgaatgagcctgccccttcataataatgcaacactccatccgaccgatcgcgcccgccctgagccactacaagatctggtagttccaagcccgagaaacgcaggtgtataaacaacaccgcacaaaacgatcaatgcgaaacagttcaaaagcattcaatttcgtcgcatgcaattaactaattatttaattgatgtccgcaatttcaatcaactaaggagaacattgcccatgcccggttcgctttcatctggcggctttaatgaccatcttgaactacgccaaaaaaaccgcgccactgttgatcagtacatgcgtaccaacggcgaagaccgcctgcgccggcatgagctgttcacacaagatggcagcggcggctcctggaacactgaaaccggtgaaccccttgtcttcaagggccacgcgaagctggccgcgctcggcgtatggctgcaacagtgcttcccagactggcaatggcacaacgtccgggtgtttgaaaccgacaaccccaaccacttctgggtggaaagtgacggtcgcggcactactcgagttcctggttatccggaaggttattgcgaaaaccactacatccactccttcgagctggacaacggcaagatcacgcaaaaccgtgagttcatgaacccgtttgaacaacttcgcgccttgggcatcccggtgccaaaaatcaagcgtgaaggtatccccgcctcataagtcctttattcattggagatcgagcatgcctgatagcacagtgcaccaacctatcactgacgatactgaactacgtcgcaagaatcgcgccacggttgaacaatatatgcgcaccaaaggccaggaccgcctgcgccggcacgaattgtttaccgaagacggttcaggcggcttatggaccaccgacacgggtgcaccgattgtaatcagtggcaaagctaagttggctgaacatgctgtttggtcactcaagtgtttcccggattgggaatggtacaacgtcaaggtatttgaaaccgatgaccccaaccatatctgggtcgagtgtgatggccacggcaaaattctctttcctggttacccggaaggttattacgagaaccacttcttgcactccttcgagctgcaagacggcaaagtaaaacgcaatcgcgaattcatgaatgtctttcaacaattgcgcgccttgggtattccagtgccgcacatcaagcgtgaaggcattcctgcctgatccttttgggagagtgatcgcatcatggaagacttactgaaacgggttctgaagtgtgaagcgttgcagcaacctcaatggagcgagccctcacaattgcatgacgcgcaggcctatctcagggacagcgcgtcactgattcgcgttgaagatatcctggtgttgcgcgcgaccctggccagggtcgcggctggcgaagcgatgatcatccagtgcggcgactgcgccgaggacatggatgaaagcgctgccgaccatgtgacccgcaaagccgcgctgctggacatgttggccgggacgttcaggctggtcacccagcaaccggtggtgcgggtggggcgaattgccgggcagtttgccaagcctcgctccaaccacagcgaacgcatcggcgatgttgagttgccggtgtaccgcggcgatatggtcaacggtcgtgaggccgtccccggccatcgccagcatgatgcgcaacgcttggtacgaggctatcgcgccgctcaggacatcatgcaacacctgggatggaaggaaccgtccggccaggagcagctcaccggctcccctgcctggaccagtcacgagatgctggtgctcgactacgaactgccgcaagtgcgccaggacgaacagggccggacattccttggctctacccattggccgtggattggcgagcgtacccgtcagctgacgggcgctcacgtagcgctgctcagcgaagtgctcaacccggtggcctgcaaggtcggcccggatatcacccaggatcagttactgagcctgtgcgagcgcctggaccccaggcgcgagcccggccggctgacgctgattgcccgcatgggcgcccacaaggtcgccgaccgcctgccaccgctggttgaagcggtgcgccgtgctggccacaagatcatctggctcagcgacccgatgcacggcaataccatcgtcgcgccctgtggcaataagacccgcatggtgcagaccatcaccgacgaaatcaccgccttcaaacatgccgtgatctcggccggtggcgttgccggcggtctgcatctggaaaccactcccgatgacgtcagcgagtgcgcctccgatgccgccggcctgagccaggttgccagccactacaaaagcctgtgcgatccgcgcctgaacccctggcaagccattactgcggtgatggcctggaaagcctgccctcctccctcttttgtttccctttgactggagtttgtcgccatgaccggcattccatctatcgtcccctacgccctgcctacctccctcgacctgcccgccaacctcgcgcaatggcacattgaccccgaacgcgccgtactgttggtgcatgacatgcagcgctacttcctgcggccgttgccggatgccttgcgtgacgaagtggtgggcaatgccgcacgcattcgccagtgggctgccgacaacggcgtgccagtggcctacaccgcccagccgggcagcatgaacgaggcgcaacgcgggttgctcaaggacttctggggcccgggcatgaaggccagcccgaccgaccgcgaggtcgtcgacgccctcaccccccagcccggtgactggctgctgaccaagtggcgctacagcgcgttcttcaattccgacttactgcaacgcatgcacgccagcgggcgcgatcagttgatcctgtgtggggtgtatgcccatgtcggggtgttgatttccagcgtggacgcgtactccaacgatatccaacccttcctcgttgccgacgctattgccgacttcagcaaggagcaccattggatggctatggaatacgccgccagccgttgcgccatggtcatcaccaccgatgaggtggtgctatgagccaagccgccgcccgcctcatggaacgcatcctgcaaccggtgcccgaaccctttgccctcttgtatcgtccggaatccagcggcccagggctgctgaatgtgctgattggcgagatgtcgcagccgcaggtcctggctgatatcgacttgcccgccccctcgatcggggcccctcgcctggatgtactgacgctgattccctactgccagattgccgaacggggctttgcggcggtggacgatcagtcgccgctgctggcgatgaagattaccgagcagcaaaccatcagcatcgagcagatgctggcgttactgcccaacgtgccgatccagttgaataacgaacgcttcgatctcagcgacgccagctatgccgagatcgtcagccaggtgatcgccaacgaaatcggctccggggaaggcgccaacttcgtgatcaagcgcaccttcctggcggagatcagcgagtaccagccggccagtgcgctgtcgttctttcgtcatctgctggaacgggagaaaggcgtctattggacattcatcattcacaccggcagccgcaccttcgtcggtgcgtctcccgagcgccacatcagcgtcaaggatgggctcgcggtgatgaaccccatcagcggcacttaccgctaccctcctgccggccccagcctgaaggaggtcatggacttcctggccgaccgcaaggaggccgatgagctgtacatggtggtcgatgaagaactgaaaatgatggcgcgtatttgtgaagacggcggacacgtcctcggtccatacctcaaggaaatgacccatctggcgcacaccgagtacttcatcgaaggcaagacccgtcgcgatgtgcgcgaaatcctgcacgaaaccctgttcgccccgacggtcaccggcagcccgctggaaagcgcctgccgggtgatccggcgctatgagccgcaaggcagggcgtactacagcggcatggctgcgctaattggcagcgatggcaagggcggacgctccctggactcggcgatcctgattcgcaccgccgacatcgataacagcgggcaggtacggatcagtgtaggttcgaccatcgtgcggcactccgaaccgatgaccgaagccgccgaaagccgggccaaggctgcgggcctgatcgccgcgctgaaaaaccaggctgcctcgcgcttcggcgaccacctgcaggtgcgcgcggcattggccagccgcaatgcctacgtctcggatttctggctgatgaacagccagcaacggcaacagacccaggccgacttcagtggccgccaggtgctgatcgtcgacgccgaagacacgttcacctcaatgatcgccaaacagctgcgggccctgggcctggtggtgacggtgcgcaatttcagtgatgagtacagtttcgacggttacgacctggtgatcatgggccctggccctggcaacccgagcgatgtgcaacagccgaaaatcgaccatctgcacgtggccatccgttccctgctcagccagcagcgaccgttcctcgcggtgtgcctgagtcaccaggtgttgagcctgtgcctgggcctggagttgcaacgcaaggccattcccaaccagggcgtgcaaaaacagatcgacctgttcggcaacgccgaacgagtgggtttctacaacacgttcgcggcgcgcagctccagtgaccgcctggacatcgacggcatcggcaccgtcgagatcagtcgcgacagcgagaccggcgaggtacatgccctgcgtgggccggcgtttgcctccatgcagtttcatgccgagtcgcttttgacccaggaaggcccgcgcatcatcgccgacctgctgcgacacgccctcatccacacacctgtcgacagcagcgtttcggccgccgggagataaccatgcacaactacgtcattatcgacgcctttgccagcgtcccgctggaaggcaatccggtcgcggtgttctttgacgccgatgatttgccgcccgcgcaaatgcaacgcatcgcccgagaaatgaacctctcggagaccacctttgtgctcaagccgcgcaacggtggagatgcgctgatccggattttcacaccggtcaacgaattgccttttgccgggcacccgttgctgggtacggccattgccctgggagcacataccgacaaccaccggctgtatctggaaacccagatgggcaccatcgcctttgaactggagcgccagaacggcagcgtcatcgccgccagcatggaccagccgatcccgacctggacggccctgggccgcgacgccgaactgctcaaggccttgggcatcagtgactcgacctttcccatcgagatctatcacaacggcccgcgccatgtgtttgtcggcctgccgagcattgaagcgttatcggccctgcaccccgaccaccgtgcactgtccaacttccatgacatggcgatcaactgttttgccggcgcaggacggcgttggcgcagccgcatgttctcaccggcctacggcgttgtggaggatgcggccacaggctccgccgccgggccattggcgattcatctggcgcgccatggccagattgagtttggccagccagtcgagattttacagggtgtggaaatcggccgcccctcactgatgttcgccaaagctgagggccgcgccgagcaactgacgcgagtcgaggtatcaggtaatggcgtcacatttggacgggggaccatcgtgctatgaacagctcaatacaaggcaagccgctgttgggtaaaggcatgtcggaatccctcaccggcacattggatgcgcccttccccgaatatcagacactgcccgccgaccccatgagcgtgctgcacaattggctggagcgtgcgcgccgcgtgggcatccgcgagcccagggcgctggcgctggccaccgccgacagccagggccggccctccacgcggatcgtggtgatcagcgagatcagtgacgccggcgtggtgttcagcacccatgccggcagccagaaaggccgggaactgctccacaacccctgggcttcgggtgtgctgtattggcgcgaaaccagtcagcaaatcatcctcaatggccaggccatgcgcttgccagacgccaaggctgatgatgcgtggctcaagcgcccatatgccacgcacccgatgtcatcggtgtctcgccagagtgaagaactggaggacgtgcaggccatgcgtaacgccgccaggcaactggcggacgtgcagggtccactgccgcgtcccgagggatattgcgtgttcgagttgcgacttgaatcgctggagttctggggaaatgggcaggagcgcttgcatgagcggttgaggtatgaccgcagcgatacaggctggagggtgcggcgtttgcagccctgagtagcatcggaaatagccggcctttcacaaaaccttctccgtgacacatctcggtcaaaggtgggaggggcttgcacccgatgagcataggtatctacacaactttgcagtcgccaacagcaactacgatgcgaagcgagccgctcttgatcttgatctgcttttgatctcaggccccccaaatccctgtcggattacgggcacaccgagcctaagcgaggtgccgagtggtggggcaagagcgtttggttactttgcgcttttcaaagtgacccgctgtaaaagcggaaccaatagtggccgttgcccaaataacggatatgtactcggtctgatccaacattctggtcggctgtcaggccgccatcgggggcaagccccctcccacagtgtccgacggcgtaccagaggctgtgtagatacctgtgcccgctacctgcgtcctaacgtcgcagcagccagctcttggaaaatcccacacaagccttagaatcgcgcgctcgcttgcagtcgtcgggacttgatgactggaggcttcagcaacgcgtacctgaatggctggccacacattcgtcgatgtgtgtccgactcaaccaccctcatttgcacaacacacttcggtttggcaatcgcacgcacgcctgtgcctgtttcgctgttcgattctagaggtctttatgtctccgcgtttgctggccatggcgctggcgcccctgctcgggctgttcattgttgctctgggcaacggctttctttcatccctgaccacccttcgactggacgcggccggtgcctcggccaccatgatcggtatcgtttcctcggcgtacttcataggcctgacgctgggtgctgtctttaatgatcgattgattctgcgcatcggtcatatccgcgcctacggcagctttgcctcgctgatcgcggtgaccatcctgctgcaggggttgttctatgacacgtggggctggttcgcgctgcgtctggtcaacggctgggcgacggtcggggtgttcctggtgatcgagagctggctgttgctggccggcgacgcgaagatccgtgggcgcttgctcgcgctgtatatgatcgtgctgtatggcgcgggcgtgctgggccaggcagcactgggcaagatcaccggcctgagcgaaagcgcgccgttcatggtggccggcatgctcgcttcgttgtcggtgctgcctattgtgatcctgccacgggtgtcgccgttgctggatcaggttgaacccctcaagccacggcaactgctgggcgtgacgccgaccgggctgatcgggtgttttggctcgggggtcaccattgcggcgatttacaccttgctgccgctgtacctgcaacgcgccggcctggacgtcggcgaggtcggcagcatgatggcctggacaatcctcggcgccatgctcctgcaatatccggtcgggcgctggtccgaccacaaggatcgcttgcaggtgctgacaattctggcgatggcctgcacggtcttgtcgctggtgatcgtattgttgccgttgtcgtcgctgatgctggccgtgctgctgttcctgctcggcggcgcggtatttgcgctttacccggttgcagtcagccatgccgccgaccgcgcccctgccgaggcgctggtaccgatgatccagggcttgctgctgatcaactcgttgggctcggcaatcagtccgatgatgatctcaccgctgatgaattcgttcggcgcaaatgggctgttctgggtattcgcgctggtcaacctgtgcatggtcacctttttcttatggcgccgtaacaaacgcgccgctccggccaatcccgcaccttttgccgctgcggcaacgttctcgccgaccggtgctgaattgcgcgtgaccgaagatctgcgccaggcggcgcaggatcatccgcccatggtcgatgcgttgagtggcgagcctacgcactcccagtcctgaaccacacccaatcgcccccagcctgcgcggctggggggatttcgctcttaagcgctttcccggttctgttgtactgtcggatgtgggctcaacgcccaagcagccatcaaccgctgcggactctggcaagttttacgcttgagcacaaaaccctggcacttttgcgcaaactgttgacggttctgcaccatatccaactgcatctgtgccagttcctgttcgcggcagcgttcaacctgctgaatatccatcgcggctttacgtgcgcgtgcttgagtgtatttctcatcggtcaacgcactgctggcctgctgcatgagccacaggccaaatgcgtctgggcaacgcggtccgatgccttggatcattgcgtattgctgggcttggagggcactgatgggcaggcattcttcggtgagtttatgcgcgatttcactgccgacggcccgtggcaggctgtaggtccaatattcggagccataaagccccatggttttgtaatgcgggttgagcacgacaccctcacgggccaatacaacatcggcggccagcgccagcatcacgccgcctgcgccagcgctgccggtcaggccgctgattaccagttgcctggctgtaagaagctccaggcacacatcgtcgatggcctggatgttggcccaggcttcgagccccggcaccttggccgcctggatgacgttgagatgaacgccattggaaaaactgccgcgcccgcccttgatcagcaacacctgggtatctcgcgccttggcccagcgcaatgcagccaccaggcgttggcattgttcggtgctcatggcgccgttatagaactcgaacgtcagttcaccgacgtgtccggcttcgcggtagcgaatcggttgataggccagcgcatcggacgtctggcaggcgatggagctatccagcaccggcacgccggccaactgctcagccaggacgtgccgtgccggcagcttgaaggtctcctcccctggctgggctttgcgtttgagcgagccgatccacaggctgcggtcgccggccgccaccagcacggcgtcgtcctgtaccgcgaggattgctcccggcgtaccctggcgtgaatccaggtgtgcgtcgtacaggtaatactgcccgccctcaaggcttgccagcacgccgggctggccatcggcggcgtcgatgctgcgtttgatgaagcttgcgcaatcgaaccaactgaaggtgcggtcggcttgggtcatgttcggctgcaaacgcccgatgacgttgggttgtgtgtagtcgagcggcaccgggacgaaaccgttggcaaacttttgcaccacatcgcggatgcaaaccatcgcggcgtcactcaccgggccgttgtacagctcggatttgcgcacatcagtgggcatgtcgaattcgcaggtggaccagatcggcccggcatccatctcctccaccgcttgcagggctgtgacaccccagcggctgagctgcccggtgatggcccaatccagtgcactggcgccacggtcgccgacaatgcccggatggatgatcactaccgggcgctgcgcatggctccacagctgctgtggcacacggtccttgagaaaggggcagatcaccagatcggcgcctgaagcctcgatctgccggcacaccgaggcttcatcggtgaacaccaccacgctggggtcgtgacccgcctggcgcaggtccagccaggcgcgctgggtcaaaccgttgaacgccgatgataacaagaggatcttcaatgaccgcatggctgactcttccttgagaatgcgcggccagagacactccttgagccgtccctggcctttgatggaatcacaagattatagcgctcgccggtacggtcacctgatcaggatcaatcttgcgtgcccagcccggcgatcaacgcatcgagcaccacacgaaccttgggctgcgcctggcggctcttgacccaggccaggttgatctcaaaccctgctgtcgccaattgcggcaagacctggaccaaggttccgtcgtgcaactgccgctggatcagccatgttggcaactggacgataccgcagccagccaacgcagccatcagcaacccttcaccattacccaccacccactgcggcgcagcatgcttgtgcagcgtcatgccctgttcgccggtgtagcgccacgggctaatacgcccatccgcccagccataggcgatgcactgatggtgggcgaggtcgtgctccgacaccggtgtgccatgacgggccaggtacgccggcgcagcacacaagacatgccactcatgcgcgagcaccttgtgccctagcgtctgcggccactcatccgcattgccgatgtgcacgacgatgtcggcgccttcccggaacgggtcgaccaggccatcacagaaggtcaggtgcggcaccagcagcggatgtgcctgcatccatggaacaaggaatggcagcacctgggtgcgaccgaatgtgcctggcaggtcaatgcgcactcgtccacgcggctcggtattttccgcttgcagggacagctcggcttcttccaggtcagccagcaccccggtgcaggtacgcaggaacgccgtgcccgcatcggtcaatgccaatacacgcgtcgtacgctggaacagccgggcgcccaggcgtttttccagcctggcaatggatttactcacggcagacgcggtcagggccatgttctcggcggcagcggcgaagctgccgcattgcgcaacgcagacaaacacgtcaatgcccttcaaacgttcggaggcaaacatagacggtccttattcatgaattcatttccttagtcgttggaaaaagcatcctaaatcagaattcacggcaccagtaagctatgtctatccatacaagcggctcatggcgcttgcacttggtcaatggacgatgaggctcgaatgctcgccacgcttaaaacctaccccgctaccctcaacctactgctgtgcgcttcattggtactgaccctcgcccgggcggtcaccctgccctatctggtgatctacttgtcgggcaactttgacctgggcattgccgacatcggcctggtcatcggcagcacgctgatcatcggctctttattgagcctgtatggcgggttcctggtggaccgcatgcgcagttacccgctgattctcacctgctgcgcagtattcaccctggcttttcttggcgcgtacggcgcgtcccagctgtggctgttctacctgtgcctggtactggtcaacctggcgtatgcggtgattgatatcgcggtcaagtccggattcggcagcctgctccccgtcgatcagcgcagcgaagcgttttcgatcaagtacaccctgactaatatcggctatgccatcgggccatttctcggcgctggggtggccagcctggacatcagcctgccgttcctgctgtcggcggggcttggggccggctacttcctgatctactgcgtatggggcgacaaaaacctggcgactgtggaaacgggtcaaccacccacgccgttcctggcggtcggcaaggtattgctgcgtgattaccgcctggtgtgttttacgctcggtggtttattgagtgcggtggtgttcggccagttcaccgcttacctctcgcagtacctggtggtgaccactacgcccgagactacctaccggatcatcagcaccgtggtggcgaccaacgcccttatggtgatcagcctgcaatacagcctcggcaagcgtatttcccctcggcacctgaacgcctggctggcggcagggctgagcttgtttatcgtcgggctgggcggctttgccctgtcgaccacgctggtggtgtgggtgattgccatggcgatcttcaccctcggtgaaatcatcgtcttcccggccgaatacatgttcatcgacagcattgcgccgaaccacctgcggggcatgtattacgcggcgcagaacctgggcaacatcggcgccgcgctcgggccggtgctatgcggcctcgtgctggcgacgcaaccggcgcagtatattttctacatgctgatgctgttcatcgttgccggtgggttgttctactggctgggcggtcgcattgccagtgatgggaaccttgaaccgctcaggtgaggcgctcaatctgccccgctcgccgaacctgagcgcgatccccgccaggcgacgggtgcaacggccaggaactgcctcagctccatcagtaacatctcgctcgagtaccgcgtagcgcctgggttggcgcatttcaacgccggcatgatgttttccacgccgccgtagtgccaggtacagccttctcgttcatcctgttgaagggctcgggtaaagatcgacaggtcccgacgtggccgaggaattcctgaaatacgctccacccagctctcgtaacgctgcctgacttccagcgcagcaccgtgaacaatcgccacgacaccgcagcgtgtccggttgtgaaaggcgatgttcgacaagccgaaataaggctgctgatggttcaaatgatccgaaacgagcgcagccggcagatggaacaccgccagatcgatatccttgtattccaccagccgcgtttcgggatggctcaacaagcgctcactgcgcgccaggtgatgcatgccttcgacatagcaatgggcgtactgtccgggatgctccaacacgtggcccaccttcggcaacaccgctcggtaggtctgcagcaaggccgtatcggcatcgagaacgcccggccgtttcgcttgggccgccaatgaattgagggtaaaggccactctcaacgcttggggcgacgttcccctggagaagtcgccaagcctggccacatcaatcaacaagtcctggtgccgcagtgcgctggcaggcgacagaaacgcataaatcgaagccagcccatccaagtcgaaatgatcgctggtgacaatccttgcctcaccaacgggattgccttcgcgcagataacggaatgcgctttgcgttgacaggttggctttataacgctgcggtgtgtggttcgatggccaatgtgaaagggtcagtaaggtggcggcgttatcaatggagtccagcgagatgttgggcacctgtgcggtatgccccagcggtagataccggaacggactgtcagggtcgataccgatggcgtgttcaatgccagctcccggatcagcctgcgtacgagcgggtatggtcaagcgacagaaacctgtcttgatcggtccacgcaccagctctccactggtgccgagggcatagcgcaagcgagagaggttttctcgacggatatcgctcgggtcgccattgttcaagaccgtcccactgcccccgatggcgctgggcaaatcaatgaagtggttgttgacgatgccgatggcccgcccacccagtacccgggtttcaaggctggacagctgtgcggcgatatccggatcggccactaactcagatgaacacaagcggttcatgttcgaactcccttcgaagaaataatcaggctgcatccagcgctgcgcgctcggctttgcttcgtataaccggccggacgctgacgaatatgagcagcgacagcacggcgtacaccccaaagagccaggcagcggcactcgatgcacccgtcacgcccccgggtgaagagaagccgccaaggttgacgatcatgccggccaatgcggccccgatcgccgtagcgatcagttgaaccgtggtgatcgaagcgcccgccaactccttttcatcctcggccacgctttccagcacacgtgtgagcagatgcggccacgccaggccgatcccggcaccgaccgcgagcattcccgcacacacgccagccacattgagcagtgatggatcgagccgcggtacgaataccaacgccagtaccaacccggcaacaatgaaaaacggcgcgatgccaatggcacgcagcgcggtagtggatttcagcccggaactgtagagcgcccccaaggtccagcccgccgccatcaacgcactgatatagcccgccagcaacggtgtctgcaggtgcaagacttgcaggaaatacggcacaaagacttcgctggtcatgccgatcaccatcaggctcatggacacgtaaagcggcagtaacgcaccgcgggcagccaggccgcccttgggcatcaagcgccaggtcgagcgggcctctacgcgataaaccaaatagagcagcaagaaacccacggccaggccgagcacgctgtagatcgcctcaggcttgatactgccgaccgaaatggccaacactacggcgctcagaagcaccagttgcgcccacggcaccccgacaggtcgggaggtatccgcgcttttcttcggtagcagtgcccaggccagtaccatgaacaacgcggtgaccggaatcagggcccagaatgcggcgcgccaggcatcgtactcggcgaataccccgcccaccgcaggcccgatcagcgttgcagcaccccacatgcctgagatcagcgccatcgcccgtggccacaagggctcggcgaacaccagacgaatcatcgcgtaaggcagcgcgaacagcagccccccgcccaggccttgaatagtgcggccaagaatcatgaccgccatatccggcgccaggctgcacaccccgctgccaatggcaaagatcaccccggcccagacatacgcggccctggcgcccagggccgtgaggcacttggtggacagcaccgagccaatgatcgaggcgaccacaaacaaggtcgtgttccaggcgtagtagtccagcccaccgatatcggctaccactgacggcagtatggttgtcaccagatagacgttgatggcgtgaagtgcgacgcctcccgccaacgccgcagatcgtaatccgttcttcccaaggagtagcgctgaccaacctgtagtagatgtcatcctgatatccaagtttgattaacctgggatcactgtattacaaaagataaaccttgtgtaattagcctgtcttttttaagtgattttcctgaccgccaaaactgactatgctggcaggcccccgcccttatgcaatgggtgacgccacagtcgacggacgtcagtgatgccttcattttccatggttacgtgcaacctatgaccaccagagctaacgacgacacccaggcctccaccgccgatcgcatcctgttcatgctcaagacccgtggccccttgaagaccactgaactggcgaccctgcttgaagtgaccttcgaagccacccggcagcatattcagaaattgcaggcgtcagagctgatcaccggcatttgcgcaccgaccagcggcgccggccggccgtccctgagatgggcgttgaccgataccggccacggcaagtttccggacgcccacagcgtgttgaccctgcacctgatcgaatccatcgaaggggttttcggcaccgagggggtcgagaaaataatcgccagcatggaaaccaccaatcgacgcgaataccttcaggcctgcgagaaagcctcatccctggaagaaaaggtacgcatcctggtgggcatccgtgaacgtgccggttacatggcgcaaatggaggcggcgggcgacggctggctgctgatcgagaatcactgcccgatctgcgcggcggcccgcaaatgccagggattctgccggtcggaactgcagatattccgcgcagccctgggcgacagcgtcgtggtcgagcgttgtgaatacctgatttccggggatcggcgttgcgtctacagcatccggccgcgcatgtgagccgtccttcccctgtcgccctttaattgcgccatgctcgacaacgaggcagcccttggactatttcgccgccctcaccgccttcgtcgaagctgccgaaggcaataacttctcccgcgccgccgagcgtctgggcatcaaggcctccacggtgtcgcgctacgtgaaggatcttgagcaagacctgggcatcgcgttgttcaaccgctccactcgcacgctgcacctgacggaaggtggccagaccttcctgatgcacgctcgcagggtgctggatgagctggaacacgccaaggccgccacctcggcgttgaaccagcaaccccgaggcttgttgaaactcaacctgccgccggcatttgcccggcatcacatcctcccggccttgaacgattttcgcgcgcgctacccgcaaatcagcgtggagctggtgctggataacgcccaggtcaacctgatccatgccggcgtcgacctcgccattcgcattggcgcgctggccgattccacgctcaaggcccgcaaactcagtgacggccggtactatgtggtggccagtccggcgttcgcgatgcagtacccgcccccgtcaacgcccaccgacctggccggcttgcctgccgtagtgggcacgacttccagcgctatcacttttgtgaacggtgacctggcgttaccgctgatgcatgccgccggtattcgcatcaacgacctcgacgcgcagttgatcgctgcgcgccaaggcctgggctttgcgttgctgccggattggctggtggcccgcagcatcgacgccggcgagcttgtggtgtggttgccgcagtggcgcattcgcgatgtcgagcgggggtttgccgtgtggtttgtctacccgcccaagcgcatcgtgtcgtccaaggtcaggtgttttatcgactttatcgttgagcgactgggccaggcaccgaactggaaatgattcagctgaaacgaatatccagggcgcgcagataggtttgcagcccggcatcctggatcgggatcaggaacgcttcggtgtctgattcattgaagtgcgcgtgccagtacccaggcggtgtgacaaacgccaggcccggcgaccaatccacccgctgagggttgcggatctgcccatccgcatccagctcggtgcctaccagggagtagcaccccaccgggcaatcaatgatgaaatccagcgcaatcgactgatgccgatggggtttctgcaccgagcccgccggcaggatcccgtacattgcccacagcacatgggtcaccgtgcgggtctgcgggaagttgcgattgcccagcagaatgctgatgcggctgcggtcctgcgcacggggatcatccgcagcttcacgcagttttgcgttggccagtgccgcggggtacagcgtcggtgtaaaacgatctgcgctgcgtgtcacccccaggtaacgcaataatggttcatcgtgcacatagtaaagacgcgcatcctggcttgcgcgaaagtgcgccgcctgcaagccgggcaaggcgatgaagcagcctttggaccattgaatctcatacgccccctgaaccacgctgccctccccggcaatcacgtagaacacctgggaggtcgcattcggttgcaggctgagggtgtcgccccgattaaggcgcatgaagttcgcgcacagcccgggcccggtcgccggcccttcacagcccagggcgtcgctgaggtccagcggtatcacgcgcgaggggccgctggcatacagcgaggcgggaaagctgtggtagggaatccgtgggatgagattggcgctgatggggttggccgccttgctgtattcgaagtactcggcgtccacttggttcatgtcgcttggtgcgggttgcaattcacggttcatctggctcacctcggtctgcgctagtgagggaactataggcatggcggctcagcggattaacccctggagctgcacagcagttgtgcaagatgggaacgctggcaagcgtcgtagtgcctttcggtcatttggattgaacgatcatttactcaacctcctctatcgcaggacatgtaaatggaggaagtcatcatgatcgactcagcaaccggaatgagacccggccagcgctacaccgtgcaaaaactggagcgcacgaagaatttcggtggattcttcctggatggtaagtactaccttggtcctgagctgatgactgcggtgggatggctggaaggccagaagttcctgtatgacgaactggatgccaacggcgagcctgtgtttccagatcgggtcgccggcactatcgaagacctgaccctggtgttgaacgatggcgcacgcctggaactgcaggaaatgcaggttgacgcgcccatgcaggcgcctgaatccgcaccggccagtcaacgccgggaagagaccgtcaggcgaaaaaccagtcagccaccctacttattgattgcaacaggcgccgccttgctggtagccggcattgcgattgcgcgtgcctgtcgaatgaacactcaacgccgcagataactgcctgcgcgcccgcactcttactaccaaaggtacgcacgtatgtcttacgactatgaaggttctgcaagtgtcatcaccgcatcgcgtcatctgggcactggctcagatgaatgcctgaatgactcggtagacatccacatgagcagcagcggtaaacccaccgtcgtgcgcttggcattcgataccccgcttgagtggccaggccacccgaacttcgtgacggtcaatttgcccgacggcacctctgtgagcggggtgattgttgaaattcaaagacccaccgatgggccgggctgggtcacgttcactgtggatgactaagaccgtttgcgggcgacactaacggccctggcagcctaaacctatctagctgatgccgagcgattcaaatgtgggaggtggcttgccagtcagtgaaggctttgtgtaggagcgagcttgctcgcgaaaaactcacaggcgccgcgttcattcaggaagcaggcgttatcgttgaggtttttcgcgagcaagctcgctcctacagagggcgatgtacgcttaactgactggcactggggcaagccgcctcccacatttggatcgctcggcatcagtcggataatcttagtggtcaccccttgctgtgttccggcgacgacgggcctttggttacgccacgggggccggccacgctccatatcaccgcgccgacaaatggcagcaccaccaccagcgcagtccatccggccttcgtgcccaaggttttatcgctgcgccatacgctgttgacgatccacagatcgagtaacacgagaatgactgccaggcctatccagaaatacgtggtttgcatgctgcacctccaggtcagtgatgcaagttaggtcaagggcgggtgcgtgaggttcaatataaaggcaactaagcgaagcgacggttgaccctatgggttcagtttcggcgcgcttgaattgatcgcaaaagttatacgaagcggcacgaattaacgctgagttgtataagttttttgcactgcactaccattcatcaccgcgccgtcaccagcttcattcactcctagcgcgcctggacccggcccggcgtacaggttggaatcgacaaccccaggctctcacgcaacgtcgagccttcatacgccgtgcggtagacaccgcgctcctgcagcaacggaatgacttcccgggtgaatcgatcaaactgccctgggtgcccgatatagatattgaacccatccacggcccttgcttgcagccagtcggccattttctctgcgaccgtgacggcgctgccaacgaaggcgccggggcgcagttgccggccaaactcgacggcttggcgcagggtaaagcctttttcccgggcgtgatcagcgatgcgcttggccgcagtgaaaaagctgctgcgcgccgcctccaggctctcttgggggaatggcgcatccaggtcgtactggctgaaatcatgccaaccgaagttacgtccgaattccttgagtgccagttcaaaactatggtcgagctgatggtagtgctgctcgatttccctggcgtgcgcatcggtatcgcccacgtagatttctgccccgggcatgatcaatatctgctccggatcgcgcccccgttgcagcgccctgcccttgatatcccggtaaaacgcctgaccctgctcgatgctggccgcatgggtgaagatgacatccgccgtggcggcgcccaggtcacggccgggctctgagtcgccggcctggaagatcaccggctggccctggggtgagcgctgaatattcagcggcccgaccacggagaaatgttcgccctgatgattcaggctgtgcagcttgctcggatcaagaaactggccggtagcccggttgcgcacaaaggcatcttcctcataggagttccacaagccctgcaccacttgcacatgttcagcggcgcgggcatagcgcgtggcatagtcataatgttcgtcgcggctgtaattgcccgcagtgccggcatcgccgctggtcaccacgttccagccggcgcggcctttgctgatcaggtccagggatgccaggcgccgggcgacgttatagggtgagttgtaggaggtggtcagcgtaccgaccaggccgatatgccgggtgctcaccgccaatgccgataacagcgtcagcggctccaggcgattgaggtaatgggacggcgagccttcggttatgaactggctgtcgacgataaacatcaggtcgaacagcgccgcctcggcctggcgcgcaatgtcgatgtaccagtcgacgttgacgctggcatcggccggcaattgcggatcaagccacagattatgccggcccggcccgccgcaacccatggtcagggcgccgagtttgagctgtctttgagtcattgtgcaggggttccttgaagagtcccgggctgggcttcggccacggcgggctgcaaggacgccgtgaatgaagggtcgaacagggtggcggccgagtaggacttgaccaggccctggctggcaaaaaactcgacggtcttttgcgcttccacaggcgtctgggccgtcaatggctcgacggtggtgcgcgcacgggcaaaccaggcgcgggcgatgtcagcgtcggcgcgggtgcgcttggcccaggcgtcggcatacgcattggcgttggctgggttctgccgagcccagtcacgggcttttttcaggcgctggagaaaatcgctgatgggcccgcgcttggcctcgacggcaccggcattggcggcaatgaagctctgggcgggaatcaacccctcagcggtcgccagtacccgcgcaccctggcgctcctgttgcgtgacgtagggttcccaggtggcgatgacgtcaaccgaaccgccttccagcgcatgggaggcgtccagcgcactgaggtagcgaaattctagagagtcccgcgcaaccccggctttatccagggccgtcagcaacagttgttggctccatgagcctttccagatcgctgcgcgtttaccggcaagatcggccaggctgtggatcgacgatccctttttcaccaggatcgccacgccctcgaggttctgtcggctgaccgcgatcaccttgatcggtgcgcccaatgcgcccaggaacaataccggcgcatcccccagcaggcctatatccaggctgccgacgttgagcgcttcggccaccggcgagccggcggtgaattgcttccaatcaagtgtgtagggcagatcatccagcactcccgccgcttccatcacggcctgggcgttgtagctctggtcgccgacgaccagggtttgtgcctgtgccgtcaggcatagtaaggcggaggtcaaccccaccgccagtgttgtcaggtaacgcacgttcgtctccagatgcccggtcagggcatttcaagtcgatccgcgcgcgcggtctcggcaatggttgtcagggttgatacgatgaggatgcagtgaccatgtgtaaaatacccataatgcataacgtaattctttaataatgcagctattgcatctaatcgatcttctggccggcttctccatcctcaaccctttaaccgacccatcatgggctcgctacgcgggccatgctcaaacgtcataatcctgcaggcgtctgcgtggtaatctcacgccaccacgaatagacattgatcgtcacttgacgatgaccaaagccaggaaagaacatgcccaagatttctcactcagcgctacgccgcaacttccgtgacctgcttgcaacgcccatctgcgttgaaaccgcttccgtattcgaccccatgtctgcccgcatcgcggccgacctgggttttgaagtcgggatcctgggcggctcagtcgcttccctgcaggtactggcggcccccgattttgcgttgattaccctgagtgagttcgttgagcaggccacccgcatcggccgtgtcgcccagttgccgttcattgccgacgccgaccacggctatggcaacgccctgaatgtgatgcgcaccgtcgaagagctggaacgtgccggcgtcgcggcgctgaccattgaagacaccctgctgccggcacaattcgggcgtaaatccacggatctgatttcggtcgaggaaggcatcggcaaggtcaaggccgcccttgaagcgcgggtcgaccctgagctgtcgatcattgcccgcactaacgcgggcgtgctgcccaccgcagatgtgattgcgcgcaccaaggcctatgaaaaggccggtgccgatggcatttgcatggtcggggtcaaagacttcgagcacctggagcagatcgcagagaacctcaccgtgccgctgatgctggtgacctacggcaacccgcaactgcacgacagcgagcgcctggccagcctgggcgtacgcatcgtggtggccgggcatggtgcctacttcgccgcaatcaaggccacctacgacagcctgcgtgcgcagcgccagctgacccacagcacttcgaacctcagtgcgacggagttgacccacacctacaccttgcccgaaagctatgtggcgtgggccgaagagttcatggacgttaaagagtaattaccgcagcggtactgcctcaatcactcaggggccagccgcctgcgcatgcctgcgctggcggccggaccggcctgtacgaggcactggtccagcggcaccaccgcaccttcagccgttgccatcaccggctgcaccggacggcccgtatcgcgttccaccacctccacactggcgccctcttcggcgtaatgccggttgccccacgccaccagggccatcagcaccatccggaagtcctcacccttggccgtcggcacgtattcgtagcgtggcggccgctcgctgtaggcgcggcgctccagcatcccggcttcgaccaagccattcaggcgccgggtcagcatgttgggcgcgatacccaggctgcgcgagaactcatcgaagcgccgtagaccgtgcaacgcgtcacgcatgatcaagatgctccaccactcccctacccgctcaaggctgcgggcgatcgggcattcgtcactgatgagggatttgcgctgcataagaagtcctgggtgcgagttcacacttgtgtggcgccatgttactttcatgatgatagtgacgtccatacgctaggtatccctcaagcaacaggagtcgattgatcatgagtaaacgtatcgtcgtgacgggcatgggcgcgctgacgccactggggtcgagcgtggaatccacgtggcaacgcttgctggacggccagtcgggcatccgtcgtttgccgcaagcattaatcggtgatttggcgatcagtatcggtggccaggtgcaaaacatggagcaagaccccgaagccggatttgacccagatcgactgttggccgccaaggaacagcgcaagatggatcgttttatcctgttcgccctggcggcggcagatgaagccttgaagcaagccgattgggcaccgaaaacgcccgaggagcaggaacgcaccgcaaccatcatcgcttccggtgtcggtggtttcccggcgattgccgatgcggtgcgcaccaccgatagcaaaggcccgcggcgtttgtcgccattcaccattccgtcatttttgagcaacatggccgccgggcacgtgtcgatcaactacggcctgaaaggtcccctgggcgcgccggtgactgcgtgtgcggccggcgtccaggccatcggtgacgcagcgcgcatgatccgcgccggggaaatcgatgtcgcagtctgcggcggtgccgaagcggcaattcatcgggtcagccttgccggctttgccgcggcacgggcgttgtccagcgcattcaatgacgcgccggagcgtgcttcacgaccgttcgaccaggcacgcgatggtttcgtgatgggcgaaggcgccggcattctggtgattgaggaactggaacatgccctggcccgcggtgcgcagccgattgccgagctggtgggatatggcaccagtgccgacgcctatcacatgacagccgggcccgaagacggtgacggcgcgcgccgggcgatgacccaggcattgcgccaggcaggtatcgacgcgtcgcaggtgcagtacttgaacgcccacgcgacctccacgccggtaggtgacaaaggcgaactggcggcgatcaagacagtcttcggtaccggcagcgggccggccatcagctcgaccaaatccgccaccggccacctgctcggcgcagcaggagggatcgaagcggtcttcaccgtgcttgcgctgcgcgatcagatcgcgccgatgacgctcaacctggacagcccggacgccctcgccgacggcctggacatggtgcgcgttgctgcgcggcccatgccgattgaatatgcgctgtccaatggcttcggctttggcggcgtgaacgccagcgtgctgttccgacgttggacatgatcaggggtttgcccctggggtaaatttcgcggaccatggcgcctttctgtccttgccaacaagaggtgcccatggccaaccacgacctgtcctacacccccgacccggatgccgattccatttcttccgatgttatcggcttcaacggcatcctggtttccacccaagtgccaacccgcgccgacggcagcctggaactgggcaatatcaccctgcaaagcgaatgcaccctgcaagccttgaaagtcgcgctggaaaaagccggcagctccatggaccgggtcatgcacctgaccatctacctcaccgacatggccgaccgtggggcgttcaacgaagtctacaagcgctttttcgccaagccatggccggtccgcgcggcggtgggcgttgctgcgctggctgtggaaggcatgcgtgtcgaagtgacggcgatggcggccaaggcctgacagccaccgagtatttgcatagtgcgccgcgaaccaaatgtggaggggcttgctcccgagccgccgttaccgcaggaatggatatgtactcggtctgatccaacatcctggtcggccctgaggccgccatcgggagcaagccccctcccacaggtacagcgccataccagaaattgtgtagatacctatagccattggggcaagccccctcccacatttttaccgagtgcagtcaatcagaccgccacgaaatcaagttccctcgtcgcaaattcaggggcacgccagagctgccctccccctgatcgatgccaatgatcaggcggttgacccaagtgattggacgctctgcctgccagcttctaacctgacggcctgcaccatcacagaagcctgccatgatcgttcgtcccaagcccaacctcctgggtatcctgttttccctcaagggctcgattgccaagcgcattgcctggcgcagcctgatggtcacgctgctcgcctcagtgatcgtgctggtggaaaccctgcacccggcgtacttttccaaggtcaacgccacgccgttcaccttgctgggtttgtcattgtcgattttcatgagctttcgcaacaatgcctgctacgaccgctggtgggagggccgcaagcaacttgggcaaatgatcattgaggtgcgctcgctgatccgcgaaacccaggtgctgggcgacaccgtcgagcgtgccggcttgttgcgcggcctctgcggttttgcccacggcttgatcgcccacttgcgccatgaagatgaaacccgtgcgataacaccctggatagcggttcaggcaagccaccccaacctgcctgacagcgtgctgcaaacactcggtgcgcggttttccgtattggcctgccagggtgtgatcagtgagtggcgctacacccaactggaggcccggctggtcagcctgagccaggtgcaggcgtcgtgcgagcgcgtcaagaccacaccactgcccttcccctacaccctgctgctgcaccgtaccatctacctgttctgcatcctgctgccattcgccatggccgagccgctgggatggttgacgccggtgttcaccgctatcgtcagctacaccttctttggcctggatgcgatcggcgacgaattggaggacccgtttggcttcgacgaaaacgacctgccgtgcgatgccatcctgcgcaccctggagcgcgagattctcgcggcccttggcgaagacgacctgccccctgcccttgagccgctggattacgtgctgacctgacgccggtttgacactcgccctgcactgaccgaagcttggggctttgctgctcgagctttcggacacccgcatgtcaaagtcacgccgttattccatcatcggcctgtgtgccctgttgctgattgtgctggtcagctggtttttttcccgcaccgcaccggtcgccgtggcaccggccattgcccatggttactccaaggcattgaagcaggcacacaacggtgaaccgggcgcggcgcgggtgttgtatcaacagttggggcgcccggacctgtcgcctgaacgccgcgccgccttgcacgccgagctgcccaattaccccagccctcaagcccttaagctggcggataaagacttggccaatgaatccccagtggtgcgcgaggctgcgattcacagcatcgtcggcctggtgcccagcggccagcgcaccttgctgctcggcccggtcctggatgatcccgaacagccagtgcgctttgccgccgccaatgccctgctcggcctgtcgccggataccctgggcttgtatttcggccccctgcagcaggtgctcgacgagttcgtgaaaaccctcaaggcccagcccgagaccgccgaaggctggattcaactggcgcgcctgtacatccacagcgccctgttgccggaggcacaaaacgccctggagcaggccatgcgtttgcagccggataacttgcaggcggtcgtgtcgcagatcgaactgctggacaagcaaggcaagagcgacgagtcgcgccagctgttggcgcggcaattggcggcgcatccggagtcggcttacctgcagcatgccttgggcatgtggctgctgcaccatggcgagcgcccgtatgcgctgctcggcctgtccaaggcggtagagcttgagccggacaaccaggattaccgctacgatctggccaccaccctgcatgcccaagacgaagtcgaggcggcccagcgtcaactggaagaaatcgtccagcgtcatccggccaaccgcaaggcccgcgtgctgctggtcaactactggaaagaaaccgggcaactgcaaaacgtccaggtactgctcgcacaactggagcagcagaacccagacgacccggcgctgcaacaaggcctgtaggcacgggcttgctcgcaacgtaattgccggccctgtgcaatttttacgaaacgttgaaccgccactggccactatggtcaagtaaatatggcgcgtccgtctcggcgtgccctttacttgtacgtgacctgagggcacttcttgtctacatccaaagagctgttcagtgaaaaggcggccaccggcatcgaaggtcttgatgacattcttgccggaggcctatcgcgcagccatctgttcctcctggaaggcgaacccggcaccggtaaaaccaccgtggcgttgcacttcctgcaggccggcgcgcaaaacggtgaacgctgcttgtatatcaccctgtcagaaactgagcgcgaattgcgccagggtgccgagtcccatggttgggacctggatgacaatatctttatttttgaattgaccccgcccgaaagcctgctcaacgccgagcaccagcaaagcctgctgtattcctccgacctcgaactgggtgaagccacccgccagatttttgaagtggtggaacgggtcaagccgacccgcgtggtggtcgacagcctctcggaaatccgcctgctggcgcaaagctccctgcgctaccgccggcagatcctggccatcaagcattacttcgtgcgctatgacgcgactgtattactgttggatgacctgaccaccgaatccctggataagactgtgcacagcgtggcccacggagtcattcgccttgaagaactgacccccaactacggcgccgagcgccgccgcgtacgggtggtgaaataccgcggccagaaataccgtggaggctttcatgacttcaccatcatgggcgacggcatccacgtgttcccgcgcctggtggcggctgagcatcgtggcggatacaaccgccagacattgaccagtggcatccaggagctggattcgctgctcggcggcggcattgagaccggttccagcagcctgatccttggcccggcgggtaccggcaagtcgctgatctcgatgatcttcgccgccgccgccgtagcccggggcgaaaaggccgcactgttcatcttcgatgaagaactgggcctgctgttcgagcgtatgaaaaacatgggcatcgatctcgcggcgttgcaagacaccggcaacctgctgatcgagcaggtcgacgccgctgagttgtcgcccggcgaattctcgcaccgggtacgtcgctgcgtggatgaaggcggcatcaagactgtggtcatcgacagtattaacggctaccaggccgccatgccggaagagaacgcgctgatcctgcacatgcatgagctgctgctatacctcaaccgccgcggtgccgcgaccttcatgaccgtggcccagcatgggttggtcggcgatatgcaaacccctgtggacattacctacctggccgataccgtgattctgctgcgctattttgaagccctgggcaaagtccgccgggccatttcaatcatcaagaaaagaaccggctcccatgagtcgaccattcgtgaataccgcatcggtagccgaggcatgacggttggtgagccgctggacaacttccagggtgtactgcgcggcattccgatttacatgggcgccggttccccactactgaaggatgagggctagtgccggctctttctccggtctcagagcgtgtcatcgtcctggcacccatggggcgcgacggttcattggcgctgatgatgctcaatgaagccggctacagtggcatggtggtcagcagcctcaccgcgctgtgcgaagccatggagcaaggcgccggcatgctgatcattgcggccgaggcgttgcgcggcgtcgattttgagccgttactcaattatttgcaccagcagccagcctggtccgacctgcctatcgtgctgatgacccatcacggcggcaaagagcagaacggcacatcgcacttgagtggcttgctgggcaacgtgacattcctggagcggcccttccacccggtcacgctgatcagcctggtcagtacggcgctgcgcggtcgacggcgccaatacgaagcacgcgaccggttgatcgacctgagcgaaagcgaattgcgcctgcaacgcaccttggaaacccttgaacagcaagtcgaagagcgcacggcgcaattgcgcaataacgaagaagcgttgcgccagtcgcagaaaatggaagccgtcggccagttgaccggcggcatcgcccatgacttcaacaatatgctcacggggattatcggtagcctggagctgctgcgcaggcgcgtgtcccgcggcaagctggatgatctggacagcctgatcgacctgggcgtcacctcggcaaaccgtgctgccgccctcacccaccgcctgctggctttctcccggcgccagtctttggattccaaacccgtggagatcaaccagttggtgtcctccatgggcgagttgctgcaacgcagcatcaacgaaagcatcgcactggacatgcgcctgaccagcacgctgtggactgccgaagccgaccccaatcaactggaaagtgccctgctcaatttggtcatcaatgcccgggatgcgatgccaaacggcggcaagttgattgtcgaaacctgcaaccggcacctggatagcgtattcactgcggcctacggcaccttgcagcccggcgattacgtcgagctgagcgtcagcgatactggctgcgggattccggaacatctgatgaaccgcgtgttcgacccgttttttaccaccaaacctatcggccagggcacggggctggggttgtcgatgatctacggcttcgcccgccaatcccacggccatgtgacgattcacagcgaactcggcaaaggcaccacagtaagtttgtttctgccgcgtttcattggcgagatgcagacacaggagccgatcaacccgacattgttgccgtttgccagtgcgggtgagaccgtattgatcgtcgaagacgatcccgcggtccgggtattggtcagcgccgtactcaaagagttgggctatggatttgtcgaagcgtgcgacgcggatacggcggtgccgatcattgagtccgggcaacgcattgacttgatgatcagcgatgtcggcttgcccggcatgaacgggcggcaattggcagaaatcggccggcagattcgcccgacactcaaggtcttgttcattaccggctatgccgaacatgcggcggtgcgcgggggcttcctggaccccgggatgcagttgatcaccaagccgtttacctttgatttattgacggccaaggtgcgggagatgatccaggcgtagagcagctatggcccgcaatgagatgtcaaggtttgaaagtcggcagatggaattgatgcaggtttatttccacatagggttgcgaattacttatgtaaagaaatcaaactacatcgacccggagcatttttgatgattgttgttgctaattcacgtctgcctgaactgtctacgcctgcgctgattaatgcaggctcctccccagcgccattgacacttatcgatacggaagtttcgaggcacgatgttgaaacaccccaggacaagggtgagcgtgccttggccaggttgtatgcccaaggcctgaaagccgcgtcgagcgttggccaggaccctcgaaaggtgagcgttacggacattccgccgtcatcgtctttcggacagctgcgcgcgcggttgggggacatgctcaaaagcccggctttcaaggcttgggcgcaagagaagcagttggatctgtcacagggcgtcacccttgatgccagccgtggcaccatcaccgccaagcgtgccggcagcgccttctcgttttccaccgagactcgtaaccaaactgtggacgttcacagcttttcgggctggccgctgctccagaacgtggctaaagcgcttgcaggctcgggcaacagcatagaattcaagacggcgaccacggcaagagccgctgatatcgctcagttttatggtcacactctgccttttgatccctccctctcgccttcagagcaagacgcatccatcaccgactacatcgccgggtgggagcgcaaaggtacgctcatctctgacacggccagccacccttcccaggctgatctggaacgtcatgcttcgaaacttggcgaccagaacaatcgaggggctgtagttgcggttatacctaagctggcagctgacgccgcgagcagtattgcgcaagatctcgctgccgccgctcgtgaaacccccacccttaccgaagacgaatatctggaggcatccaaccaagccacccgccagcggatgcaggaggcgctggacacgcctatagaaatagaccccacctcgtcctatgctcgggatcacgacctgaagccgggcgtagcggtgaccctgcgcgagtatctggtgggtcatggcttgctggttccaaagaccccttcggagctggcagccattgcaccgtccctggctagtccccccccgctaagccctgagcacggcaatatgggtggagccctttcatggcccacgctgttgagcaataaggatcaacgcacactcagtcgcgtcattgatgatgccttgaaaaatgagccgcaagacaacctgcttgagcacttgacccgtgacctgaacctggatgaaaagaccctcaaggatgacccgggtcgcatcattgacgacatcctcaagtccagcaacgctcaagccataggtcgcgccgccgagcaggcaataggtgagatcgcttcgccagaacctatcaatgactgggttctggcagcgctctatgtgtcgctggacaagcaaagtgtcttcaccgatccgtcattctcaacacgaacccatatcgctggattcgatttgaacagcgtgtctgggcgaagcgcttcctacatacgtaaagcgctggcgcatcacttgatccagacgggactagccacaccgcgaaccgtcgacctcgccgtattcatattgttgtcgcgcaaggcacacagagctcttggtcaaggacatacctgaggcgttggtcaagggctcccacgcatgggtcacttttaccacggcagtggctcgtattgaggcccaagcgcccggctccacccgcttgatgacgtatgagcagatcatgctgcgacatgaactggcccccgtaacactggccgacctgatggttgaagctctggcgcaaactgacggactgaaagactggggccgcaacaacggcttgctcggacgcaacgcagaagataaatactcagaaacgaaaatgaacgacgtacgttttcagtttagtaaacaagtgtctgagttaaataaagcttcgaactactttgcaatggaggcccctgaccttcacaaatgggcgctggcggaaataaaaaagcaaaatccacatttgtctgaagagcaaatcaaagaaaaatccatagacacaaaagacgccggctttttggaatttcctggtccctattcgctgctggacatatttctcaacacacgcgaccatcttaaagacatcgactttaatgactatacctctcgcaatgaatccattgatcttacgacaattgcctttaagcctttttcaagggccgagctgaaatcccgttttggaaacggccttgatttatatttcaaccgtatcgaggcggccgcgcaggcgcaaaccaaatacttgatttcaacactgcccattgaagatcgagaaatcattgagcatggaaaaatctcggtcggcaaagaagtgtcagtcaatacaaataattctggcgcaaccaataaggcaacaacatccggttctctagtggtgcgcagcgaattcaaggacagggacggtaatgaaagcacccatacctatgaaataaatatgacgtccaacaccattaaaaagcgtgatgactggaacgatatagacatcgccccgctgcctgacgagttcagagcgggtatcggttcaacataccttgaacccgttgctcctgaaggcgattacccggaaaacatactgcaggcctcgtcgctctacactgtcaacgacacgcccaacagctacttcagtgataagactgggtacatcgctgacgccatggtaaaaaacctgggtatccagaattttgcaacggagctgcgcggacagacgacgttcgatactgaatctcctttttggacaaaagccgagttgttcgtgcgagcgcttattccaggctataacgccattaataactttattgacggcaagtggcgtgaaggcttggttgatttgtcattcgatgccttaggctttctcctttccggggtcggcggagccgctaaggttgccaacaccggagtgcaagtcggaacgactcttgctcaaggggcgaaaaagctggcgcgtggcgccataggtgcactcaaccccatagaccccgtgggtcttgggctggcaggcgtacaaacaggtttggaagcgctggatcgacattcgcgcacaggcgacaaaaacggctccaggcctgttgtcaaatatgacgtggtcaaaaccttcagggacgtcgacagtgccacaataggcaaagccaacgtgcaaggtgaagtggaagacgtcgccgctacgcagaagaatggcaaatggtatgccctgaaccctgtcaccaagcagccctatggtcttcctttgaaggatttcgtgccttccacataaggtagaaaaacactgccccaggttcttcacggcgtaccgggaagaacctgcgcggccagacattgaatggatggcattgagcggattacgccaacaagcgctggatatgctcctgcaatgtatccaggtcaaacggcttggccaggatcggcgcgttgcgcgtgatcgggctgttgcagtcgagaatttcctgcgggtagccgctgatgaagatcactttcaattccgggcgcaacttgatcgcgggctccgcgatctgcaccccggaaatcccgcccggcaggcgatagtcggtgaccatcaggtccaggtgcggcttggtcgcgaggatctggaaggcctgctccccatcgatcgccttcaagacccggtagcccaagcctgccaggtactcacccagcacaaacataatggattcgtcgtcctcgacgatcagtacgacatcttgcgcatcttcactcatgggaagcctttgtccggtcaattgctgcagttacgaccatggggtcacgcagaggttgcgtcgaggtgacgactgatttcactcgaccgcctcaaggggcagacacacgcgaaacagcgcgccctcgcctatctggctctcgacctcgatagtgccgccgtgggccgcgacgatctgctcggaaataaacaagcccaggcccagtcctgctgtcacatggttggcagagacccgttcgaactgctggaaaatgcgcttctggttctcttcgctgataccgataccatggtcacgtacctctacccgcgcttcgccatgctcgctatatacccgcacttccacggggctcttggccccgtagcgcaaggcattggtcagcaggttggtgatcacctgctcgatccggaactcgtcccaattgccttccaccgcttcgtcggcctgcagttgcatcgaggactcggcggccgccacttgcggtgcaaagttctgcaccaggttgcgcaccagttgggcaaggtcaaagcgggccgggcggatcgacagcttgccggtgcggatacgcgacacgtcgagcatgtcttcgatcaggcggatcaggctctggatctggcgttcatcgcggtcgaccatggcgtgcatcttgtccagagtaaacgcggcggcgttgtccctggccaggtgcatcttgcgcagctgggtctccaggatcagcccgttaaggggcgtgcgcacttcatgcgcgacaatcgacatgaagtcgtcacgcatgcgtaccgcttgctccagttcggcctgggtggcctgcaggcgcgtcagcagcaactcctgctcgcggcggctgcgctccagctcctccaactgcaatttcatcgccttgctctggcggtacaggtcgacgaacacattgaccttgctcttgaccgcgtggatatccagcggcttgtgcaggaagtccacggcgccgctttcatagcccttaaaggcgtaattgagctcacggccggcggcgctgacgaacacaatcgggatgttcttggtcttttcggtgccgcgcatcaattcggccagctcgaaaccgttcatgccgggcatctgcacgtcgaggatcgccatggcgaattcgtgttccagcaacagggacaacgcctcgtcggcactcaatgccttgaacacctggcgatcctcgcgcttgatcagcgcttcgagggccagcaggttttccggcagatcgtcgacgatcagcagtttggcctggacagtacttaacatggatagggttccagggaagccagcaatgagccgatacggctcaaggaaagaatatggtcaggtgtgtgtaacgccagggcagccaagggcatcacggcaatgcgcgcctcctgggggtcctggacgatggtggtgccgcccgattgcttgacatgggccaggccgctcgcgccgtcttggttggcgccggtcaacaggatcgcgagcaggcggggcccatacacgtcagcagctgaggcaaacaggtagtcgatggcgggccgggagtggtgcacgcggtcctcctggctcagggacaggctacggtcatgctccactgacagatgatagccggggccggcaaagtacaaggtgcccgcctccactgcctctttatcccgggcttccttgaccggaatgctcaggcgccgcgcaaagacttccgccagctggctgcgacgctcatccggcaggtggagcacggcaatgatcggcaaggcgaaggtctcgggcagttggccgaaaatagtcagcagcgcctcgacgccgccagcggaagcgccgacgacgatggcttcaatcccgtgaatcggggtgtctggcacatcgctcatgattttcggtagatccgttcctgtttgaccaagggctcgaattgcttgctgtaggcggaaaagtccagggtttccttgctgcccagcaccaggaagccgcgatgacacagcgactcatgaaacaatccaaatgctcgatcctgcaattttttattgaagtaaatcaatacgttgcgacatgaaattaattgagtttccgaaaagacactgtcggtggcaaggctgtggtcggcaaaggtcacgttctcgcgcagggtcttgtcgaagatcgcgtaatcgtaagccgctgtgtaatagtcggcaaatgaacggtgcccgccggcctgctgataattggcggtataggcacgtacgttttccagagagaagataccctgcttggctttgtccagcgacgccgggttgatatccgtggcatagatgatggtgcgctccagcaagccttcttcacgcaacaggatggccatggagtacacctcctcccccgtgctgcaaccggcgatccagatcttgatcgacgggtaggtcttgagcagcggcaccacttcccggcggatcgccaggaaatgcgacgggtcgcgaaacatctcgctcaccgggatggtcagaaattgcagcaactgcatgaacgccgccgggtcgtgcagtacccgctcctgcagtgcggaaatggtcgcgcagtcgaactggcgcaaggcatgggccacccgccgcttgaccgacgcgccggagtagtcgcgaaagtcatagctgtacttgaggtaaatcgcctcgatcaacaggcgcagctcaatatcgctgtttttgtccaaaaaacactgttccacttaaatgcgttccatcttcggtagccatacgcgaatcagtgagaacaggcggtcaaggtcaatcggcttggccaggtagtcattggagcctgctgccaggcaccgttcctgatcgtccttcatggccttggccgttactgcaatgattggcagttttttccagcgcgggtcctggcggatcaaggcggtggcctcgtaaccgtccatttccggcatcatcacgtccatcagtaccaagtcgatatcctcgacttcattgagtttgtcgatggcctcgcgaccgttacgcccgatcaccaccaccgcgcctttgtgctccagggcgctggtcagggcgaagatattgcgtacgtcgtcgtccaccagcaggatcttgcgcccttcgaagaccttgtcgcgactgcgggcagtcttgagcatcttctggcggtcatgggacagctgggattcgactttgtgcagaaagagtgtgacctcgtccagcaagcgctcaggggagcgggcgcccttgatgatgatcgaacgcgagtacttgcgcagttcggcttcttcatcgcgagtcaggttgcgcccggtgtagacgatgaccggcgggaacgagcagatatcctcggtggccatgcgcttgagcagctcgttgccgagcatgtccggcagcttgaggtcgataatcatgcagtcgtagatgttggttcgcagcaggtcgagagcttcgtgggcgaagccgacggccgtgatctcgatgtcatcgtcgccgatcaggcgggcaatgctgtcgcgctgcaggtcatcgtcttccaccagcaacacacgtttgaccttctgcgtcagcttggcttccaggcgcgcgaacacgtccttgagctcttcgcgggtggtgggcttgaccgcataaccgatggcgcccatgtgcatggccgcctcgacgcgatcttccacggaaatcacatgcacgggaatgtggcgggtgttggcgtgttccttgagacgctgcagcaccgtcagcccggaatggtccggcaggcgcatgtccagcaggatcgcgtcggggatgtattcctcagcgaggctgtagccttcgtcggcaccatgggcgaccaggcagtggtaacccagctcatgggccaggtcgaacaggatacgcgcaaagttcggctcgtcctccaccaccaggatgcaccgggtgctgaacggggctttttcacggtcatcggcaaaccgtggaatctgctgggtgtcggcaaccggcagtggcgaaacccgcactggcatgggggccggcaccaccaccgcttgacgcggttgttccacaggtgcggcgtcgtcttcacgctccacgtattgctcaggcaataccagggtaaagatgctgcccttgcccggctcgctggtcacgctgatgtagccgcccagcaaggtggccaggtcgcgggaaatcgacaggcccagaccggtgccgccgtaacggcgattggtggtgccatcagcctggcggaaggcttcgaagatgctttcctgctggtccggggcaatgccgatgccggaatcgcgcacggtaaaggcaatgccctcccctggcgcgcgggacactgtcaggctgacctcgccctgttcggtgaacttgatcgcgttggacaacaggttcttgaggatctgctccaggcgttggcggtcggtaaacagcagggtcggcgagccttcctgcacatccacctggaagcccagcttgcgatccgccgccagcggttcgaacatgacgcgcaagccgtccaccagccgcaccacgctggaattctccgggcgcacttccaacttaccggcctcgaccttggaaatgtccaggatgtcgttgatcaggttgagcaagtcgttgccggccgagtaaatcgactcggcaaacttgacctgctcggcgctgagattttcctgggggttttccgccagcagcttggccaggatcaacgagctgttcagcggtgtacgcagctcgtgggacatgttggcgaggaattcggacttgtatttgctggaacgctgcagttcatcggcgcggtcttccagctcgagctgggcctggttcagttcgacgttcttgcggtccatggcgtcgcgctgctcggccagggtctgggtctgttcggccagttgctcgttggtttgctcaagctcggcctgctgggtttccagatgggcctgggactccttgaggatgcgcgattgttcttccagctcttcgttggcggtcttgagctcttcctgctgcacttgcagctcttcgttgagctgctgggtctcggccagcacttcctgcaaacgctggcgatagcgggcggcttcgatggaggtgccgatattgccggcgatcagctccagcagctcgacatcacgctcatccagcgcacgcaggaaacccagctcgaccacaccattgacgcggtcgtcatcgctggtgggcatcaccagcacgctgcgggtagcgccttcgcccaggccggaactgaccttgaagtaatccactggcacatcgtccaggcgaatcaggcgatccagctgggcagcctggcccacgatgccctcgtcgctgtagatcgactgctcctgtcgttcctgctcgcgggagaagccataagtggccacgcgcttgaggccaccatgttcttcgcgcacgtacagcgccgccacggccgagcccatgtattgggcgaagaactgtaggatattgcgcccaagcatattcagggtcagttggccgaggacttgttcagccagctcagtctggccattgcgcagccaggcttgctgttccaggcgccgtgcaatcttctgttgggacttgaggtttgcgctgtaactttctgaaagtgagactaaattttttcttccgacatatgctagaaaaccgctcaacccgagtacgaataccaagtatagggtgacgctgatcaccgtcgtgcgggtgacttcttcgttacgggtgatacggaattgctgttccatcgccaccgcatcgtcgtactccttgcggatttcgtccgtcaggcgcttgccacggccggccttgaccgcattgcggtagtctccgttctggcgctgcatatcaatcatcgactgggcgtagttgttccattcgacctgcaaggcttccagacgcttgaggcggtcgacctgctggggattgtctgccaccagctcctgcagattgcgtagatcggcaatgatccgcggcttggccacttcataggggtcgaggaaatgctcgtcgccggtgatcaggaagccgcgcatgccggtttccaggtctaccgtcagcttggacgactcattgaggttattgataacccggtcggtgtgctccacccactggatcaccgagagcaaataggtaatcaggcagacgaaaaacaccgcgctgagcacgcccacgcccaagggtagggccacgtttcggctcaacagggtacggaagctcttttcatcgacggacgacgcgggagtcatgggcatgccttggccaagtgcggaaaaaccgggagtttgccccaaagtgacgcctgaacgctatttttctgcgggggacgagggcaagaaacatcggcgatgggcaaaaaggacgccatacagctagctggcgggacattcgctcgcccagcgttcacaatgccatcaattgcttcggaacttgctggcattgccgtcactcacaatcaagttgcctttaagccctacgctctcacttttcaggaatacccaccatgtctgcacccgcctccaccatcctcgtagtcgaagacgacgccatcgtgcgcatgctgatcgtcgatgtgctggaagaattggagttcaaggtggttgaggccgctgacgctgcagaggcgctcacagcggtgcaaaacaccgagcaggtgatcgacctgatgatgaccgatgtcggccttccggacatggacggcaaggaactggcgaaaaaagtccgtgaattacgccccgccctgcccatcctgtttgccagcggctacgccgataacattgatgtaccggccgggatgcaggtcatcgccaagccgttctcgattgatcaattgcgtgacaaggtcaaatccatgctgcccgaggcctgatttctcccttacaaccccgaccttctgtgagtaagcgcccgacgaggctgaaagcgtcgcagggattaacgtgacgtgcggccaataaaactggaaactcagcgccttgccccctcgcccccttaaaagcactctggaaggacgctacaacatgattggaaaaccgacgcgcctgctgttggcgagcctctcgatagtcatcagtaccggcgcctgggccgacttcactgccagccccagtgaagcccgtgccatcgccaaggaagcctacctttacgggttcccggtggtgcagatgtacaagacgctctacacccaggccgttgataaaggtggcgccaacttcaaagcgccattcaaccatatcggccataccgcccagttgctcacgcccaaagacgcaacgttcgcaaccccgaacgccgacacgccctactccttcgtgtggatggacttgcgcagagagccgctggtactgactctgcccaaggtcgaagacgatcgctactactcggtacagctggtcgacctctacacccagaacctcgcctacctgggcacccgtagcaccgggaataacggcggccattacatgatcgcggggcctgactggaaaggtcagcaaccggtcgacattgaccgcgtgatctacagtgaaagcaatatcgcctatgccctgtaccgcacgcagttgttcgatgacaaggacctgggcaaggtcaagcagatccagagcggttataaagtgcagcccctgagcggctacgtgaagcaacctgcccctgccaaggcgcctaagatcgaatggcccaagccaacggcgaccatgaccgaaggcccacaactgtttcgctacctgaactttatgttggccttcaccgtcccccaggacagcgaaaaagacttgctcgcgcgttttgccaagatcggtatcgccccgggtgcgccgttcaaggtcaaccagttgagcacggagcagcgcaaagccctggaagaaggcatcgccgatgcccgcgccgaatttgccgcgttcaagaaggacaaggtcgacacccaccaggtgtcccgcagcgatttgtacggcagtcgcgaccgcctgcaaaacaactacctgtaccgctacgccggcaccgaaatgggcatttttggcaactccagcgatgaagcggcctacctgacctacctcctcgacaacgaaggcaagccagccaatggtgcgcgccacagctataccgtgcactttgccaaagatcagttgccaccggccgatgcgttctggtcgctgacgatgtatgacggcaagaccaaactgctggtgcccaaccacaagaagcgttacctgatcaactcgcggatgctaccggctctcaagcgcgacgccgacggtgggctgaccctggcgttgcaacaccacgagccgccgaaggcggaacagaacaattggttgccggccccgcccggcccgttctatgcgatcttgcgcatctacctgcccaagcccgaggtgggtaacggccagtggaagctgcccccgctgacaccgcttaagtaacaccacgggccggctgggatcagcgctttttcaggcgcagataggattggtgcaggtccgaggcccagccatcaatcacgctctttacatcgtcggccttcatcacctgcgagtcattggccaatggcttgccggtgcctttgcgcaccacttgggccactactttattgctggcgccatcgaggaactgcgcctcggtgcccaaggtggtttcctggtcacgaatcccggtgccggtactcaccgccgccgcaaccagggctacgggcacgaactcatagggtttgaggctctcggtcttgctgctgacggcggtgatcgccgcacgcaccaccatcaccccggggccgggagcgttggccaagggcagcgacttggccagctcgcgcttgagggtctggttgaagtaatcgttgataccgcgcagggtgctgtctggaatcttcgtggtggcctggggcttggggtagaactgggtgggttcgatatacaccgaggtgtaccggctcaggtccagttgcggatcaacccagcgcatcacctccgcccccgacggtgacttggcctcctttagctggctgtagttggaaaggaaccctgaatactcgtccggttgcggcaccttgctcgtgcaaccggccatgccgagtgaggcgacgcacagcgtgctgatcattagccctagcttcatcgtggaactccctggcgaccatcatcgtgatgaatgagttgtaggtatagccaatgcttggcaaatacacctaatttaacgcgtcgccagtcatgagttatttacctgcgattaaagcgtgcaggtcaggctcgctcgcgtgggatcaggctctgcaactgcgaggccaggaagttggcatcgaaaccgaaggtgtcggggtctttaaggccgttggttttcttccatagccaatcgttcttatcggccggcagtaccaacgacacgctgccatggcgcgcagcggtgagccccattaccgctaccgaaatcaaaccgccggcgcccatgacatccggtacgaactcaacgcttttgccggtgatatgcacgctgagtttttcgctcttgaagggcgagctctccaccggcacgctcgggccgctggcggtgtaggcctcacgctgtacttccagtaaacccacagtctttaccggctccagccattgttcgatctgctggaacaactcactgagcttctgcgcccaacgcgccgactgcaggtcaaattgctgttttttatgcgcttcgctatcggcgtagtgacgaagcatctcgcccagttgctgtacatcgtccattgcggatttccttgggtgagccaggttgcgaagcgtgatcatggcagatgccgcggcctggcgtatggctaaacatcagcccatgcttcaaagggaatgtaaggcaggtgtgtcgaacgaagggtactcagatagaaggcgacgccactgcattcgaaaccagggtgtgaattgcgcttcggacgctgacagctgggctgatacttcagcgcgggtcagccatttgatctcgctgacttcatcggcatcgggtgaggccaccgcgtcagattgggccaccaacacatgacaaagttcgtgctccgcaccgatcgaaccaaagcgggcatggtattcaaaactgtatagggcgcggcaggcagcccgaacgcctaattcttcgcgcagacgacgactcgcggcatcctcgataatctcgccaggtgccggatgactgcagcacgcattcgaccagaaaccgggccagagcattttaccggctgcacgacgctgaagcagatgacgcccctggctatcgatcagatgcactgaaaatgcacgatgcagacggcccgctcccaggtgtgcctcgcgtttatcacacactccgatgtgcacgtcctgcgcgtcaactaacattacatcattgctcattctgtattcccttcagtgtcgccacgcgcacctcacccatatttgacggtgtgcgagggtggcgttacgcccttctagtcaaccccgggcttgtccccaggcgctgactaatgtcaacgctgcgtcgctgaaccctggatcggcacgtaggttggccatggcatccaggtcgttctgggtgagcaacccgagtttcagcagtgccggggctgcctgggcagtcgtggcagcccagaaggtatcggctgcgctgttgtcgccgatacggccttcaacagttcgatgcccgacgttggagagtccccgctcacgcaatcgtcccgcaagagtgtcggcccagagcatgtcggacccaatggactgttccagcagactgatcccggcctcggccactttgcggaacaatgggttagcggttttcaagctcggttgcagactcacgtcctcgatcaccaaccagcctcccgggcgcacccaggtggcggcgcgcgtcaatatcttttcgcgttcggtgaggtggcacagaagcgcccgagcgtgcactacgtcaaaggaggctgcaggaaaatcgtcggtcgaggcattgtgggtcatcacccgaatgccaggaatatcggtcaggaatcgggtgtcgatgtcggtggcggtgacagtcgcgtcgggatatcgcttgctcagccaggcggcgagtgatccggcaccggcaccaagatcaaggatggctggcttgcccgaaaggtccaactgctcaaaaaccgcttggctcaacccgtcaaaggcgcgctccagggtacgcaaccgcgccaattgaccggcgtgctgatccgcgagatagctgctggtgtagccgggcgcttcggtggtgtcaggcgtggtcacagtgcaacctccagttgctcagggcagcgattgaggaatccccgttcgatgggcttgaagcccggagcccagcgcaggtttggaaaggtctggagcagcatgcgggcgctggtggtgatttccatccgggccagcatggaccccaggcagaagtggcgtcccgcgccgaaagcgaaatgactggtcgcctgttcagtgcgcgacatattgaaggtatccggatcggcgaactggtccgggtcacgattggccgaaccgataagacaggccagggtcgcaccggcggggatcgttcccgatggcaggtgcagcggttcacgggcttcgcgcagtaccaattgcaagggcggattgcgtcgcagggtttcggtgagcgcgttatccatcaagcctgggtcagccagcaccgcctctttgacgccaggctcgttcagcaggttgacgatcaggttcgccagggcaccgtgactggtctcgctacccgcagtcatcaggatcgcgcagtaggagcgcacgaacgactcggataacggttgaccgtcaatccgggccgtcaggagcagggagatcaaatcgtcggtgggttcagcacggcgagcgtcgatgtagggctggatgaagtcatagaaactgtcgcggttggataacccgccggtcagcagcgccggatcctgtcgatagttgcccatgtaggcaaagccgatggcgcaccaacgcttgagccgttccaccgcctcgggggtttcggccgggagacccagcgcatgagccatcacccgcaccggcagcgccgcggtgaaatcggcgatgaggtccacctgggatcggccgtgcatgcgcgccaaaaggtctgtagtcaccgagatgatggatgtttcaagcgctgcgagggccttgctgcgaaacgaagggctgagcaatgcgcgatgctgcgcgtgctcacagccatccatagtgacaatcgtgtgccccagcaacggtccgatctgccaagtgtaattgttgttgcttgcctcagggtgggtcaatgcggctttgacatccacatgccggctgaccagccatacatcggtgggctcgtcgtaggcgatcggtagcgtggtacgcaaaagttcatacaaggggtatgggtcgatttcgaactgcctggatttaagcgtcggcggggtaagtttcaggtccacctgccggtgattctgtggcgtagagtcggcggcatgcaggtgatagcgagaaacgctctggtgccaatcgcccgctgcccgcaaaacctgccgcagccggtccgggtcggtggcggcgcacgcccgctgacctacccgctgggcggcgatcgcagtgaagtccgcaactgccgaattcaccatttgatgggcggactcaagcgcactcggccagtccataccggcggtgtccgcgagtatcgataccaggttgtaacgctcaccacacaccacatccttggcaagcgaatggatatcgttggtccaggcaatgatatcggcagcgtgttcacgcagcgtgttccaccattcaatgtgcgcttgctgctcgtatgggtcgagcgtttcggccgcatcgataagatcgaagaagaacagtgcaccaaacgaatcccgtcgcaacggcagatactcagccagcgtgagcgccgagtcggtttcgcgcacccgtaccaacgccgcctgcgcgcgcagatgctggatcaaatggccgaccaacctgtgccgccaccccgcccctccccagcgctgggtctggggccacagatcatcgaccagaacagcgagcatcgggtcttcaatgctgctggtttctcctgcaggatcagcaccgtcgctctcggtcacaacctgcacggtgctgataaaccgctccaacgcgccgttctccgcccatggtccatcatcaatgcggtcatcaagggtgagcgcccacaggtaccagcacaccagcgtctgcgctcgctgtgtgggcgccctgccgcacaacgccattcccagctcgagcagtggcgtggtgctcaaccgatgtgcaccgcggcggccgatcaggtgatatcgctgcgcccaggcgagagcatgtgcgcgtaactgttcattgtcggaacgcggtggcggagcggcgaaaggaagtcggatctggggaatagtgagcgatatcggcggtaaatgagcgctgtcgcgggtgttgagttcgctttcacggaacggcgggggcatgttggtccttttgaattaattccttcaactgccgaccttatttgaaaacttagatccaaaggcatgagaactgtctgaaacgatgcgggaaatctcgcataggcggtcataagccgccatgccaaacaccttttgtggacatatgtacgatcggacaggcgtagttgaactgctccggtgaatttgctggcaactgcctgtgaccaaccggccttcattggttaaggtgaagccacatccattgtcctggagtatcagatgcgcaccatcggccttatcggcggcatgagctgggagtccagcgccgagtattaccgcctcatcaaccagcgcgtgcgcgaccagctcggcccgctacgttcggcgcagatcctgatgtacagcgtggacttcggcccggtggaacaggcccagcatgccggacgctgggacgataccgcgctgatcctggaagacgccgcgcgccgtttgcaggcagggggggcggagtgtgtggtgctatgcaccaacaccatgcacttggtggcgccgcgtattgaagcggcggtgtcgattccattcctgcatattgccgacgccacggcgggcgcggccattgaggccggtaccttgacagtgggtctgctcggcacggcgttcaccatggagcaggacttcctaaagtcccgcctcgccgcccagggcctgaccgtgctggtgccggacgcggatgagcgcaaggaggtgcaccgaatcatctatgaagagttgtgcgtgggcactatcagtgacgcctctcggcgggtttaccagcgtgtgatcaaaggcctggccgttcgtggcgcccaggcaatcatcctgggctgtaccgaaatctgccttcttatccagcccgaacacagcgacctgcctctgctggacaccaccgcgctgcatgcgcaggccgcggtggcgtttgctttgcaggattaaggcttcagtgggtcaggcctggatatcggtgagttcgattttcccattcacgctgatcatcacgtcgatgtctttatcgccatttgtatcaaatcggagccacgttatatttgccgcggggaaatattccatgtgcgcttcgccgccacgaccggagaactcagaaacaacattgatctggtcgcggccactcgcagctttaagcgctgacacatccaacttatcccgaccactgacaaagtcctgcaattcgatcagattcgtttcagccgcggggtcgcccgcgccaatgacaaaggtattattacccgcgccaccccataactggttataaccggagttggcctcgacgtagagcgtgtcgtcgccgtcgttaccaaacaattcgttatcggctgcgttgccaataataatatcgttgccgtgcccacccttggcgatttcaatcatggcgcccggagcaatggaaacattgcccacgccgccgcctacattagagaagctgcccggcgtcaaattaatgacctggttatccttatactcagaaaagtcgaaagtatcctcgcccccaccgtcccacacagaaaataacggaaaatcattctccgaagttaagttgaacatgtcgcgatcagcagttgaattgaacccataaatcgtatcccccgagcgcgtttgattattcgcgccgtggagtttttggagcgtggaaatatcatccatcatcggtgcgctggaatatttattctccaaaggacgcttccaaaactgcatgtttgagcgtgcttccaacttgggactgcgcagcgaatacgccagggagtcttctgcatattcggttcctggcgccacactggccgtcgaaggaagccccagtttaaaagccgcagccttggcaacgacgtggctgccgtagttattgggttgctccagctcttgcgcgtgacgctgcaacaaaggcacctgcgacggcgccccttcttcattgtttgagggtacataaaatggatctttccaatcaaaacgactgtcatcaattttgaattgcatatggttggacgtggccatggcgccctctttgaactgtactctcgccacatcgctgaaatgcgtgagggtttcccgaatggtgtttttctggctttcggagaactggcttacggtattgccgtcggcatccggctgcgttgcgttggcgaaatcatacgtgaccacagcatcgtcccccgcaggtaaagagtgtggatgcccacccgcacggatggatgcctcgacaacctgttcggaggacaatgtaggttttccatccttgaacccgtcacctcgacggtttttatcgagaatatctgcaatattcctgtgcacaagattggtgaggtggtgttttgcataggtaatatttaaattcgtgttcacgactttgcagcccacatagttaagttgaatttgaattggcaagccagcgacatcactcatgtgcttatcttaatgtcaggcgcaggcgctcagttccagtgttcactgcaagtaactattgggcggttaatgcgtatgcgcaccacagcttttaggatttcgcttatttaactaatgcgtggtggctgttcgagacgtggcattacactggaggggccagtttcgcttgtttacccccgcgcctgcgggtgcaggtcgcgcaggcgcgtggttttacaggcttataccgaatggcgcagtcgcgccatgctcaaggcgtcgacaaatacaccatcacgcagggcgtaatcgcgcaacgtcccctccacttcgaagccgaacttgcggtacaggttatgcgccgcttcgttgtcggcgtagaccgtcagctccacgcggtgcaggttcatccagttgtcggccacatccagcgcggcagtcaacagccgagagcctacacccttgccctgccaggcagtcgccacgcccataccaaacgaacccacgtgactctggcgtacgcgcaggtactgctccagccccagctgaccaatgacctcaccgccgtgcaacgccaccaactgcagccgacgctcgttgtccatcaccaggcgtttgcgccaggcttccaccgattgaaaaggcatttgcagcacctgacggcacacggccggttcgttgtagagcgcggtgacgccctcgaggtgagcctcggtaaagcgctggatcacgatatggggttcaggtgcgtgcattgcgtttcatcctatgaaagacaagtggccggccagtgtagaggcaaagttgcccgactgacgagcctcaagtcttcccgcaaatcaacccgcgtcatacaggttcagcgaccagcagcgaggcgccacacccgtgcgatatccgcggcccgctcacgcaacaaacgcggcgcttcgctgcacgcctgctccaggctcatcggccccgatggcaaggcaaatgctgcatccacaccgtgagcgtacatctgctcgtaaccgtcgcccaatatgccggcgatcacaatgaccggcacgccatgccgctgggcgacacgcgccaccccaaacggggtcttgccgcgtagggtctgggcgtcgaagcggccctcaccggtgatgaccaggtcggcgccgcgtacggcgtcatcgaggccgaccagttcggccaccacctccacccctgggcggaaccgtgcaccgagaaaggccttggcggcaaaacccaggccaccggcggcgccgctgccgggttggtcgcgcacgtcgttggccagcacttgggcgcagtgatcggcgaagtggccgagtgcggcgtccagttgggcgacttgctcggggctcgcacctttttgcgggccgaaaatcgccgaggcgccgtgggggccacacagcgggttgttgacgtcggcagcaatctcaaagcgcacctgtgccaggcgtgggtccaatgattcgaggctgatatgcgacaggcgcgtcaacgccagcccacctggaggcagtggctgactggctgcgtcaagaagttgcacaccaagggcctgcatcgcccccgccccgccatcattggtggcactgccgccaatcgccaggatgatgcgttgggccccggcgtccagggcggcacggatcaattcaccggtaccgtaagtggtgctggaacacgcgtcgcgctgctccggcgcgaccaattgcaagccgctggcctcggccatttcgatcatcgcggtgtggctgtcggccaaccagccccaccgcgcctcaacggtgacacccaatggcccttgcaccaattgccgacgcaactggccgttacaagcggcaagcactgcgtccaccgttccttcccccccatcggccatagggcactcgaccaactgcgcatccggccagacttgagccaacccttcggcaatggcctgggcagtgcctgcggcactgaggctgtccttgaatgagtcgggagcgatgatgatcttcatgatgggctttctccggtttttataatgcccatgctgccagttggctgggctaatgacgccggtcaattgcacagatgcggacagggtttgttggtcatttctacaaagtctggggcaacaactgcacccccaggtacaaggccagcatgccatcgagcgtcaaagggtccacgccgctgagttcagcaatgcgttccatgcgataacgcaggctattgcgatgaatgcccagcgcgtctgcgcaggcctggctttgcccgtcgtgttcgcaccaactgcgcagagtggcgagcagttgcccgttgctgtccttggccagcactttacgcaaagggttgagcagttcgtccagggcatcgtcattgcggtgacgccagagcatgaccggcagacgataacggttgagggtcaacagccgcatgtgcgggaggatatcgcggccatacgcaagtagatcgcccacccggcgataacaacggcgcagccccgccaagccctccgcttgcccaccaatggcaacgcgcaggatgttccagcccaggccgtcgagcttttccagcaagcgggggttgtcgacctgcaacgcggcggatcggcaccacagcagggaaaactgcgcggggctgacacaccaactgtccgggtaacggctggtcagccatgtactcaagtcttgcgccgtttggcccgtacccagttcgaacaggtacggcgtgcgcgacagctgcggcttgagccccagttgccgggcttcgtccaccaggcgtggtgagtcgccactgtcggccagcagcaaggccagcagatcatcgcagcgctggcgccgccattgctgttcggcttgctgatggcggtggctgaccagcatttcagcggtcatacgcaccagctcggcataggtgcgcagcccgtccggttcaccggtgatgcccagcacaccgatcaggcgttgatcatgcagcaacggtagattgatgcccggctgcacgcccttgagatgtttggcagtctgcccatcgatctccaccacccggccattggccaggaccagttgcgcgccttcgtggcgggtattgatgcgttccggctcgccgctgccaaggatcaagccctgactgtccatgacgttgacgttatagggcaggatggtcatggtgcgatcgacaatctcctgggccaaggcgtgatcgagctcgaacatggggctaatttcctaaaacagttgttcactggcacagcgcaaagcctgcttgactgtgcgccagcacaaagacagtcgcccatcacgtcatcgagactgtcggggcggtcaacgttaacctcgcaccgcgaaaaatcataataaagagagattcccatgtcacagagcgccactgccgcactggccagcgatgacgataaaaacgccatctacaagcgcatcaccctgcgcctgatccccttcatctttatctgctacctgttcaactacctggaccgggtaaacgttggctttgccaagctgcagatgctcgatgcgttgaagttcagcgaaaccgtatacggcctgggggccgggattttctttatcggctacgtgctgtgtggcgtgccgagcaacctggcgctgaccaagttcggcccacggcgctggatcgcgttgatgatgatcgtgtggggcacgctgtctacctgcctgctgtttgtgaccacgccgacgcatttctacacgttgcgcctgtttaccggtgccgctgaagccggtttcttccccggtgtggtgctttacctctcgcagtggttcccgaccttccgccgtgggcggatcatggcgcttttcatgtcggcgatcccggtgtccggcttgctcggcagccccttctccggctggattctcaaccactttgctgccggtcaaggtggcctggcgggctggcagtggatgttcctgctgcaaggcatcccgaccgtgatcctcggcgccctcgcctacttcctgctcagtgacagcttcgccaacgccaagtggctcgcgccccacgagcgcgcagtgctggaagccgaccaggccacggacctggcgaacaagcctaaaaccaccagcgactccctggccgaagtgttcaagaacccggcgatctgggcatttggcctgatctacttctgcatccagagcggcgtgtatgcgatcaacttctggctgccatcgatcatcaagaacctgggtttcagcgataacctggtgattggctggctcagtgcgatcccgtatctgttggcggcagtgttcatgttgctggtaggccgctcggccgacttgcgcaaggaacgtcgatggcacctggtggtaccaatgctgatgggtgccatcggcctggtgatcgcggtgaacttcgccaccacacccgccatcgccatcatcggcctgaccatcgctaccatgggcgcccttactggcctgccgatgttctggccggtgcctaccgccatgctcagcgcaggtgccgcggcgggtggcctggcattgatcaactccatggggcagatggcgggttttctcagcccatatatcgtggggtttgtgaaagacgccaccgggtccacggatgtggcgctgtatctgctggcggccgtgattgtcgccggtagtgtgctggcgttgcgcatgacgcggaccttgaaggcataagacggtccaatgtgagaggggccttgctcccgatgatttagtgtcagtgagcgcatctgtgactgaaccaccgccatcgggggcaagtcccctcccacactttggcctgtgtctacagcaagccgccgccatcgatatcgatgacggcgccggtcatgaagccgttctccatggccaatacataccccgccgccacttcttcggcctgccctacccggccaactggcaatgcctcgccggtcttggcaaacatcgccaaacgctgctcttcggccaacccggcataggctggggtgtcgatcacgccggggctgatgacattgacgcgacgcggcgccagctccttggccagctgcttgcccaaggcttcggtcgcggcattgatgccggtcttgatgaactgtcctgctgccagcttgcgccccagttgaccggaagtcaggctgatgctgccgtgctcacccaggaatggcagcgcctgttgaatcgcacgtagcgcgccccagagtttcacattgaaattgtcctgggcttcgtcaaggtcggtttcgatcagcgtcttggcccgtaccgcaggccctgaggtgtagaccaagtggtcaaagtgccccaccgtttcgaacaagcgctgcaacgacgcgctgtcggtgacgtccaccggctcgctgcgtacaccgttgtcgctgccggagttcaagcgccgcccggccagcaccacgtgcgcaccgcgagcggtggctgcctgtgccactgcggcgccgatgccgctgctgccgccaatcacgatgatggttttaccgctgagggaagatgtcatgggagaactacctgggtgagaaagccagcgttcatcttcccagcttggcaatcagcaaaaaatcccggtaaaacgacaagatctttaaaggatttttaataatgagctcaattctcgatcttgaagtctttgtgcgcagtgccgacaccggtagcctgacagctgccgcccgtgggcttggcttgaccccggcagcggccagcattgccctcaagcgcctggaaacccggctcggtatccgcttgctcgcccgttccacccgcagcatgcgcctgaccgaagaaggccggcgttatctggacagcgtgcgggtggcgctggaagcgttgtcggagggcgaacacgccatcaagcaacagggccaaagcctcagcggtttattgcaactggcggcgccctcggatttcggtcgcaatgttttgctgggttggctggatgagttcaaatacgagcaccccaatatccgcctgcaactgttgctcaacgacagcaatgccgatctgtttcgcgacaccgtcgacatcgccctgcgctttggcgtgccgagggactccagcctggtagcgctgccggtggtgcccggccaccagcgcattgcctgcgccagccctgactacctcgcgcgccacggcacaccgcgcacccccgcggacttggcgcagcacagtacgttgcgctacatgcgccgcgggcaggccaatagcacgtggtacttccgccagggcgcgctgctccaggaggtcgacgtcagcggcgattacctcagcgacgatggagaaatcgtccgtcgctgggcgctggcgggccacggcatcgcctataaagccaacctggatattgcccgtgatatccaggccggtcggctggtagtgctgctgcccgactggcagggcgagccgacccctttcaacctgatgtgcccccaccgtctgcaagtgtcggaacgggtgaaagtgctgcatcgttttctacaggcccgctgccagacgttactgggtgcatgaagaaacgcgcccagggcttgttccagaggcgtcgggtctggtattgcagtactcacgtttccctgccatgaggagctctccatgatttaccgcacattgggccagtcaggtttgaaggtcagcgcactgaccctcggcaccatgatgtttggcgaacagaccagtaccgaagactcgctgcgcatcatcgacaaggcctgggaccaaggcatcaactttatcgataccgccgacgtctacacaggcgggcgctccgaagagatcgtcggcgaagccattgcgcgtaaccgccaggactggatagtggccagtaaggtcggcttcggccctgccgatggtttgcccaaccgtagtggtttgaaccgcaagcgtatcttcaacgccgtggaagccagccttgggcgcctggagaccgattacctggacatctactacctgcaccgtgaagaccatgacacgccgttggaagtgaccgtgtcggctatcggcgacctgatccgccaaggcaagatccgctattggggcctgtccaactaccgtggttggcgtatcgccgaggtgattcgggtggccgagcgcctgggggtggataaacccatcatcagtcaaccgctctacaacatcgtcaatcgccaagctgaagtcgagcaaatcaccgcggcggctgcctacgggttgggcgtggtgccttatagcccgctggcccgaggggtgctcagcggcaaatatgcaccggacgttacgcccgaacccggcagccgggccgcacggcaggacaagcgcatcctggaaaccgaatggcggacggagtcgttgcgcatcgcccagcagatccagcaatacacccaagggcgtggcgtgggcatggtggagtttgccattgcctgggtgttgaacaatgccgcagtgagttccgcgattgtcgggccgcgcaccgaggcgcagtgggatgcgtacaccggggcgctggcggtggagatcactgctgaagatgaggcatttattgattcgttggtcacgcccgggcattcatccacaccagggttcaatgatgtcggccatttcgtctcaggccgtgtggcgtggcgcgttggctgaaatctacatgatgcactcagattaatgtgggagggagcctgctccccgatagcggtgttgcaatcggctcatctgtcgctgacacactgctatcggcgccaggtcgaatcgtcgtaccgctcctccaatattttatttctcgcaaaaaccgccatactccggccctggaccggatatgatcaggcaaactattattttgaggaaactattaagccaatcgaatatttttggcctcttcagttgagggccttggtgcagctaaggcgattattccgtaaaatcaattttcaagggagtgaagatgaacgaaaaaaatcagttgaacggcttacaaggctggctgttgttggtaatgattggattgtttttgagtcccttgcgtatagcgtatgaattatttccatcgtactatcatttctttacaacacctggcgcgatcgaatacataagcactcctggcgcaggcgaataccacccctacttactcacgtttatgatgtcagaaatatcattcaatattctgatggttatagcccaagtgtatttaatatatttgtttttctcaaagcattacctttttccaaagctatacataaccgtggttattgtttcgtttgtttttgttatttccgatgcctggattggctctcttgtgtacccgaaaatatcaatgtttaaccccgagaccaacaaagaaataacaaggtcattatgcgccatcctaatcctggtcccctatatgctcatatccaaaagagttaaagcaacatttatagagggtaagaaaagctaattggatgggaagagcatggtctttttttgctatccgagagtcactcggtaaataatatcacttgctaatgaatcggctttcgcgagggcagcgtgtctaaaggtgtagtgttatcggtattggcctcggtgttgtttgccgtgatgtattacttcacgtcgctgctcacgcccttgagcggcctggagattttcggctggcgcatgctgctgaccgtaccatgcatgaccgtgttcatgatcgtcagcggtgaatggcgaagggtgttggaactgctgcgcatgcttgcgaccaagccacgtctggtcggcggtgtgttggcctcttcggccttgctgggcgtgcaattgtggctgttcatgtgggcgccgctgaatggacgcagcctggatgtatcggtggggtatttcctgttgccgttgaccatggtgctgacggggcgcttggtgtacggcgaacgcttgtcgcggctgcagcagattgcggtggtgctggccgcgcttggcgttttgaatgagctgtatcaggccggcggtttttcctgggcaaccctggtagtgatcatcggttacccggtgtacttcgtggtgcgcaagtacctgaccaccgatcatttgggtggcttgtggctggacatggcgctgatgctgccagtggcttggtggtttgtgcagagtggcgaacagggatttgccgtgctcgatgtgcacccaaggctgtatgcattgattccgatgctgggtttgatcagtgcctcggcgctggtgagctatatcatcgccagtcgcttgctcgcattcagcttgttcgggctgctcagttacgtagagccggtgttactgctggtggtggcgctattgctgggagaaggcatcaagggtggccaatggctgacttacattcccatctggctggcggtgatggtgctggtatatgagggtttcaagcatttggtgcgtcaacgtcgggtttgagtaaaagaatgggaatgggtgccggttgcgggggtatccgtaccccttctgtactgcagggggatggcctcaggtcattacctgagtcggggactcttcgggcgtaccgaccacgtcctcgatgaagtcggctgcggtattcaggttttccctcgctgtgccgtagcggggaatattgctctggacctcattaccgaaactttccaagtattgatccataatctctctctcaacaccaaacacattgccgagccgattgtcgtggttcagctcaagcagcgttcctgtgacggggtttttcacgatttcttcgatggaattggctatatcgtcaggaacaccaaactgttccaatgcagtccctagaccgtgccctgggtttctgagctgcttgacgaggtaggcccagaagtcactcaggtcattaggtcctgctttttccatagtctggcgcgcgacatgctgtttggcgaactcttcggcggactctgaattgggatcgccgagcggttctttactgttcagcccgtctttcacgaaataaaaaccgtcctcactgccaccacgaaagttcccataagcatcgtaatcatatacgacatattttccatcctcccgtgtaccgacataggtcgctttgccatcggaagcgaggttgttaagcctggtgttgaatagtccgttgacctccactggcggaaccgttaaatccctgttcaaacgcgcgaaaatatcatcgcgttctcgaccaaaactccccaccgcaacgctggattgttcatcctcgccaaaatcctttagtttctccctgacccgctcctcctgcccgggagcttcagggtgagagaagtgcccggctaatcggtctagttcggcagggtcttgggccatattcctaacccattcagtcatctcttcagcggtttcgaacgtgtggaacgacatgacttcatcctccggcatatacacgatgaaattagtcatcccctccgttacaggcacgcgcttgatcaccatcatgtcttgggattgagcgccatcgacggcaaaagtcgagacactcacgaaaggtgcccccggtttgtctggattcaccaccgcctttatcaactgatgctcgtcggcagttaaatcaccattgaggtgctgtaattcaccttcgtcgagaaaacgctttcgcgccacatcgatcgggtccccttcatcggtcgagcggacattgcgaatggggccagcctgttgcggcgggatcggatcacctaaccttggcagaagagtaggagtatgcacagtcgtcatatgagggcctcatctagattagggtgcagggtttttcctacgcccggcccttatgtgatacttgatgaaacatctgttcccgtttgaccgtcgctaaattgcaactcaatgcaacacacacgaaaaagcccggtataaagccccgggctttttgcttatccagtgggtcagtcggcggtcaatacaccacgacgcacttgatcacgctcaatcgactcgaaaagcgccttgaagttgccctcgccgaacccatcgtcgcctttgcgctggatgaattcaaagaacaccggccccatcagggtttccgagaaaatctgcagcagcaggcgtttgtcgcccgcaatcgatgagccatccagcagaatgccacgtgattgcagttgctcgacaggctcaccgtggttcggcaggcggccttcaagcatttcgtagtaggtgtccggcggtgccgtcatgaagcgcatgccgatcttcttcaaggcgtcccaagtcttgaccaggtcgtcggtgaggaacgccacgtgctggatgccctcgccgttgaactgcatcaggaactcttcgatctgcccggcgcccttggaggattcttcgttcaacgggatgcggatcttgccgtctggcgcgctcatggccttggaggtcaggccggtgtattcgcccttgatatcgaagtaacgggcttcgcggaagttgaacagcttctcgtagaaattggcccagtagatcatgcgtccgcggtagacgttgtgggtcaggtggtcgataaccttgagaccggcgccgaccgggttgcgatcaacaccttcgaggtagacgaagtcgatatcgtagatcgagttgccctcgccaaaacggtcgatcaggtacaacggcgaaccgccgatacctttgattgccggcaggttcagctccatcgggccggtttcaatgtggatcggctgggcacccagctccagggcacggttgtaggcctgttgcgagtccttgacgcgaaacgccatgccgcacaccgacgggccgtgctcggcggcgaagtaggccgccaggctgcccggttcgttgttgaggatcaggttgatctcgccctggcgatacaggtgcacgtctttggagcggtgggtcgccactttggtgaagcccatgatctcgaagatcggctccagcgtacccggggtgggcgaggcgaattcgatgaattcaaagcccatcaagcccattgggttttcgtattggtcggtcatgttcgtgcctcatcattcttgtgggtagcaatcgtctatttgcaagcaaggatgaggtctgagggtggcgcgcaggaaaggcctcgcacgctgcgggcgaggaagtcaccaaagatgaggggagagccaagtagcttcatggtgtcatcagtctctgacggccgaggcttgcgtgagcgcaagtccatattcttgtatgcgtaaatcgattctacacagcgtaaaccaatttgtccgtactcttatcaaatcgccgttgccctgccctgtgcaaggggtttattgcacaagtagatgcccagcaggatcaccgcgccacctgccagcatcggcgtggtcaaggcttcgtccaacagcaatgcgccacatatcaccgctgtcagcgggttgagggcgatgaacacaccggagcgggtcgcgccgattcgccgaatgccctcgtagtaaccaatataggccagcgccgaacccagcacacccagatacagcaggctgtaccactgcgccagctgcagcgcggcgaaaccttgcaacgtcagccgaccggtggcgagggtcgtcagggtcaacatcagcgtgccccacagcaccgaccaagtgactgtttgcaccggtcccaacgcctggttgagttcccgggacagcagcgaataggcgccccaggccattacgcagcccaggatcaacaggtcaccgatccaggcgttgcgcgccccctgcatgaggttgggattgcggctcacgatcaccactgccgcccccagcaggcacagcccgatacccagccacttgacccggcccaggcgctccttgaacaacaaccaggacgccaggccaatcactgccgggttcaatgccacgatcaaggacgcccgcgacgcattgatgtagtgcaggccatagaaaaaacacaggttgtagaaaaagatgccgcatagccccagcagcaccagccgcgccatttgccccgtagttggacgcgccagtgggatccgcgcacaggccaggaacagcagcaacgccaggctggccagcataaatcgcaggcaggctgcgagcagagggtcgacctggtcagccaggaagcgcccggcaacaaaggtacccccccagatcatggtgacagcggccagcttcaggtaagtaagtccttcgcgagcgtgatgcatcaggatgtgctcaatgtgagagaagatcggggtattctttgactaatgattagtcatcgtaaaatgaggtattactcatgaccctgacccagttggaaatcttctccctggtcgccgaactgcgaggtttcaccagcacggcgcatcggctgggcatcagccagtcggcggtatcccatgcgatcaaggctctggagcaggaactgggtgtggagttgtttcgccggcaccagaccctggtggaactgagcgatatcggcgagcagttgctcgggcgcgcacggggcatgttggggctggccaacaccttgcaacaggaagccgccgatgcccgcgggatgaagcgcggcacattgcgcataggttcgttcggccccaccgcttcgaaccgtttgctaccgaccattctcagccacttccgaagggactatccgggtatcgaggtacacgtagacgaggggccggaccggcaggtcatccaatggctggaccaacgccgggtggatgtgggcttcgtggtattggagcaggaacgcttcgacaccgttgccctgctcgaagaccaactcgtggcgctgataccggtcggccatgccttggcggcaagcgtggcggtacccttgcacgcgttgtgcgatgacccgttcatcctaaccgaggcaggctccgcagagctggtcacgcgtttgttcggtgaagcgcagttgcagcctaaagtgcggtatcgctgcacccagttgctcagcactttggaggcggtcagtcgcggcgagggcctgagtatcgtggcccagggctcactgccggccaatgccgacccgcgctacattgcccggtccctgttgcccagcgtaacgcggcgcataggcctggcggtactggatcgacgccaggcctctcccgctaccctggcgtttatcgcactggcgcaaacgctgtaccccgatccaggtattcaccggtaactcagggtaaacgaggccaggccgttggcggttccgggcttgatggtcgacgcagttttcacatagcgggaagtcagcgtaattgtcagggtgccgttggcagtactaccgacctgccattggttcgggttacccacgccagaggagtcggggccatagctgattaactgggcgccattgagcagttgcagggccacgccacgggcagtcgaagtgcgggtcagggacaattggtcgctgcgattgccgggctccgtctggtcggtcaccgtgatccatacatccaggatgccaccgttaccgccgccgcattccagggtgatgttgcgactgacgctgccggcatggctgcctatatccttgaaatctcgactgggtacctgccccagtggcatcgatatcgacggtgtggatacgcggcaagtcggtttttgcggcggcattatcaccgtgtcgccgaagttgatcgaggcatggccggggccttcaatattgacattgctcagcacatacctgccgattgtgcttgcgctgatcgggcccgtcgcaaccagatacacgcgcccttgcagtgtccaggccgtgggcttgttgtgcttggtgtccaccaacgtcgtgccggtgtgggtaatcacgcgcagaggctgggacggatccccggccatcatggcgaaccctacgccggggtaaggagtggcgtagaccggcatcgacaagccgttggcattgaacgtcatgccggtcgccgcagcattgaccacactcaggctcgccgacactggatgcggcaataaccagtcggtgtatcgacactgcatcacagcgccattgcttgcgaagtcatacccgcctggatagccaattgcctcgcccactttcaggtcgcctggcaaggtaatcggcgggaaggaaagcgtcacgggcgcctgggggacgcaggcgcctgcattgaaatgggcatgcgcgtccatcgcggacatgcaggcccccaggcacgcgccgacctgtagaagcctggtcgtaaactgccggacgctgttcatatcgccaaatccttaccgcggcctaaagacagagaatgttcgtgcgtcatgccatgatcatccagcacggtaaaacgcagcaaggccggcccttcccctggcagcgcccgccccttcaacgcgatgctgactaccgaatgtggcgacagcatgggcgggtcatcattgcggtactcgacgccactgacggtcagccggacgctggacaggctcacatgaaaggcactggggttacgcacccgcaacaccgggccgtcacctttgcgctgccactgcagcaattgaatcgcctcctgcgcctggcccgacaagccgtcggggcgcagaaacagcttgatccgtgtgcgaaaggcaaattgcagctggttgccggtatccacagacggacggatccccagcacattcagccagtacacggattcctggggcgcggccagggccttgttttgggtcgcgtggtacatcacccgcaatgcgcggtgcttgccggcatccaggcgcaggatcggcggggtcaccgtaaagggcacatcactcgactcaggcgcgatctgcgggtcgcccgcatcgatccacacttggaccaatcgcgggccgtcggcctcattgtgcaggttgaccgttacccccggggcgctggccgtgtaaatgatacgtgtgcggtcaatgacgatttccccatgggccaatactgtctgcaccgccagggccaggccaagcaccgcgttgaacaatcgatgagtcatcagctgcgctcctcgtccacatcgccatggtcggcacattgactgaccaactggtccgcgttttcctgacgttgctcgggcctgcgcggcggcaaacggtaatggatgaagcattggtcacccgcccctgcattccagcgcaccgtcaaccgtccctggtcggcaaccccgcgcacaaaagccttgccagcctggccgatcacgccgatttcgacgccgcgttcgtcaaacacctgggcggcaaatggcaacggcttgccattcatatgagtggccttgatcaccacggctcggccactgacggtctcgaacctgaccagtgagaccgcccccagcgtcggcaccacggcgtgactcgactccttgagttccacatccatgggcatgccctcgggatcgatatctacttcattgcgctgataagccctgagggctggcagcaccgcatagccttgcttatcgatacgcgccccgctgctgcccagccgggcaccttgtgcatccggcgcatacaccagggccgaggcttcaccgaggttctgcgcgaaggtcaggccatgcccgtgggcaatcagcccgccatcggcgctcatggaaagttgtgagctgtcgcgggcctgggcatagccggcccgcaggctcgcagcgcggctgcgatagccggcgtaggcattgaagctggagccttgctggtggcccgtgccacggctgccggtcagcccgtagctggcttcaccggcgtcacccagcaaaccattgacccccacctgatgctggctgccgcgcgaatcgccagcatcgtgcgacaagctgctgctcagggtcggcgcacgcgttcctgcgcccaatggcatggacagtgtcagcaccaggtgattatccacgcgcccggcctgcgccgaccggccaaaaaagatctcgtcgctgcgctcgtgatcgttcaactgatgggtttcactgacacgcgagcgctgcgccgagaggttccagttgagtgacttccaattagctgcataactgagggtgaaggaggtctggcgcccttggcggcctgcccagtagtcgatggagctgccataaaggctcagcgagcctgcgcccaactgctggctgattgtcaggtcgaggcggcttttctgcctggcgtaactgttgatacttccgccttggcgggccagttcccgcacattgagcgcatcaggcaggttcaggtatccggccgtggagaaacgataggcgcccaacgcaaagtgcgttcccgagaacggcaggttcttgttataggccaggccccagctttgcccgccgactacccctagcccctgtacctgggtgcgcgagtgggtgctgtcgagggagagcgcgccaatcggagtactcatcgccaggccggccttggcctggccgtagccttgggaaaacgtgctgccaccataggcgctcagacgatcgcccaggccatgctgcagcgtaccctggaagatcagcgggctggcgtcgctgacaccgtattgctgcaactgccccaaggtcgcgctgtagtggctggcaccgtcacgcagcagataaggcgccacggagtaaggcaccacgaagctgctgcgccggccgtcgacctcggtaacactgacgtgcaggtcgccgccgtacccggtggggtacaggtcatcgatgacaaacggccccggggccacggtggtttcgtaaagggtgtagccgttctggcgcactgtcaccgttgcattgctgtcggcaatgccccgcacctgaggcgcatagccttgttgcgactgggcaagcatgcggtcatcggtggccagggtgatgccgcgtacacgcacaccgtcgaggatctgaccactgctgaagctgtcgccgaaggtcagttgtgagcgccacgcggcaagggaccgctgcaggtaggtggcggtgtgttgataaggcgccaggccacgaccggatgcccatgcctgcccaccctgatggcgtaaccgccagtcgcccaggttgagaccgccgttgaggcccaggtagccacgatcctcaccggcgcccgctgtcgccgtcgcggcactgaagttgtagttgagcagcgcggcgtcaatgccattgtcccactcagacgggtcaatgtagccgcgcgcggaacggttgatatagacctgggggatgctgacgtccagggtcagggtctcgatatcgacgcggctgctggccatgggtatccactcggcaaaatcccggcaggcatgctcggtgttatccgccagcgcctgcacagaaacccccagttggccaagctcggcagcgttcaagcaaggctgggcgtcgtcctgcccggcaaggggggcgaaggtgacctcgcggcgtcccatcgattgcccgttgagcatcacatccacgcgatagacaccaggcgccaacacgttgctggtattgaagcgcgagatatctgccgaagaggacaggccgctggcgaacgcctcgatgtcaaacaacagtggcgcggcctctgccgacatcaataaggtactgagcaggcccagccatagcagcaacctggggttggcaaacagccaggcagtgaagcggtgaatgggtatttgcagtaaggcatgcatggtcagaacttcaggggagcacgctgcggcgcggagaatgcgccgtaatcattgatgtatttgaaatgcacctgggcgtccgcgggtaatgcctttacgccatccctgacgggcagcttcaggctgccaccggggggcaccatgccctctcccgcgggtaacaggcgagcacccgggcccgagcccatggccaaggcaacttcattgaaggtcacgtgataagccgatgggttatgcacttccagtagcggtccctgggtactccggtgcagggtccagcgtagttgggtgggcgcctcgtccgccgaacccggcaatcgggccgggcggaaaaacactttggtgcggatacgaaaagcgaactgcaggtggttcgaagaggcctcttgcgggctgcccggtgccacgttgaccttgggcggtatctccagggcgttgagccaaaacaacgattcgcggtcatccggcagtgggtcctgggtatagaccagtcgcactacctggcttttgcccgcgtccatgcgaaacactggcggcgaaagactgaaaggcacctcgctgccggaggggtcttgcgccgggtcgccctggtccagccacacttggaccaggcgcggcgcccgctgatcgtcattggtcaggcgcagcgtgacttctcgacgctgctgcggatagatgtgccgcgtgccgtcgatcactacgccggcgtgagcgacggatagcaacccgacactgatcagcagggggttcatcaatagcaatgttcgggcaagcatttgtctgtccttgcctggcgcacggccaggcaaccgggcctcgatcaggggaacgtcaccgaatacagcacttgggagctgaccgggcctggcgtagcggtgcccgtggcgatgtattgggcggcaaacggcagcgacacctggccgctttccgggactttcgcggggctggagttctggcccaggcgcaaatccatgggctggtgggtgacgccatccacgagttgcacctcaacgaaagtggcaggcgccggcttggcgggtgcctggttgaccaggttaccggtcgccgggttgatcgcggggctgctgctctcatacatcacggcgacggtcgtatccttggggcaggaaccgacatggatgtaatagggtttcgccccggcagtctggcctggcgccttgagcgcactggcctggaccttgttgagtggtaccgaaaagtccgggctggtgccgtgggccgagcccgtgccgccgctgatgctgcaggtggtgccggtgatttcaccggtcaaggtgatcttgccgtctgcggcaacagcaggcagagcggcaacgctggtgaccgccagaaatacaacggccaatgcgatagttttcattacaaatacttcctagtgaatgtcattaaaagtgttgcaagccatgaatcgtcaatcgaagggcgagacgtaaccgtcccgccaaaatcgggctgcgtggctgtgaaagaggctgtaggggttaagtgctactgagtctcttacgttttgcaacgaagtttatgttgccaagttgaagagcccgccacaactgaccgaacggctaggtcagtaggcgttaaacaagtgagcagccccgtgcaatgccatctatcatcggcagagaccactctcttttttcacgattgattgcccctatgcccctgaccgccaaaggtccaagaagccgagctgcccgctatttcatcagcaccctctgcgggctgctgcccgttctgctggggtttgcaattctttactggcaagccgagcgcacgcttgagcaaagcacggcccaaaccgctcaagaagcggtgcgccagttcgacctgatgctcgacaataccgccctcgccgcccaggctttgttgccttgggcgggtaagccatgtgacagcgaggcgcaactggcgctgcgcgaacaggtgacgcgccggccgtttgtacgcgccaccaccctgtcctggcagaaaaacatttattgcagctcgctgttcggcggcaactctcagtcaccggtcaacccggacgactacgtgaatggccggttgtggctgatgaatggcaaccccgtcacgccggataccgcgctgttggtctatcgcctggtggaaggcgaccagggcgcgttcgcctcgattgacagctaccacctcaccaacgccttacgcttgatcagccgttacgcccacctggttttgcaagtcggcccccattggctcgatgccgacggcaaggtgcatgaccgcgcggtaccggaatttgccgtggcccatcatcatctggcgtccgagcgttatgactacagcgtcgaggcgggtatgccggagggggaaacctggcgttatatgcaggcccgctatccggcgttgttcagcctggtggtgttcttcggtgtactggccagcatccttgcgcattggctgcaaaaacgctcgtccgccccgacccaggaattgcagcgtgcattgagtgccaacgaattcatcccgtatttccagccagtggtacgcggagacacgcgtcaatgggcaggctgtgaagtactgatgcgctggaaacacccgaaagagggcctggtgcggccggacctgtttattcccctggccgaagactcgggcctgatcgtgccgatgacccgcgccttgctgcgtcagaccgctgcgcaactggcgccccacgccgcgcgtttcagccccggcttccatattggcgtgaatatcaccgcgcgccattgccaggacctggccctggtggaggattgccgggagttccttgccgccttcgcgcctggccaggtcagcctggtgctggagctgaccgagcgcgagctgatcgagcccaccgatatcacccgccagctgttcgatgccctgcaccagctgggtgtactgatcgcgatcgatgactttggaacaggccattcgagcctggcttacttgcgcaacttcaacgtcgattacttgaagattgaccaaagctttgtcgccatgatcggtgcggatgcgctgtcagggcatatcctggacagcatcatagaactgtccggcaagctggaccttggcattgttgccgaaggcgtggaaacagcacaacagtgtgaataccttgtcgcccaaggcgtggacttcttgcaaggttatctgttcggccgaccgttaccctgtgatgaattcattaattcgttgggcaacccgtgaatacccctgcgctaccgttgatgaaagattgttcttttgctggcagacatgatttactcgagatgaattaactactacaatttttcctacctgtgcagaactcgcagagggggctatttcgttgagttaccttaacgttcctggcttatagctgtgtctgcagttgatatcagcaactacactattggagtacagattttgtccagactcgccgaatttcgcgcagcagaaaaagcccttcaagagcagcttgcgcagctggaatccttgaagaacgacgcaggcctgaagaaagaaatcgaattcgaagaaaagctcaagaagctgatggacagctacggtaaaagcctgcgcgacgtcatcgccattcttgacccaaccccacgcaaagctggcgcgtcagttgccactgcgcctaaacagcggcgtgcacgggtcgtcaaggtttaccacaacccgcataccggcgagttgatcgagaccaaaggcggcaaccaccgcggccttaaagcctggaaagaagagtacggcgccgccactgtagattcctggcttcgcggctgatcaacaggcactaagaacagaaccccgcatcgcggggttctgttgctttataggttcgaaagcgaactttcccaccctcctattttgttcagattcgctcaacttggccgggtcataatttcaggctattgcgtaccgaactcacttcatccttgctcgcttcataggcttgcacctggcctgcgtatgaaaagacataggctttatcaatatccacagcaccgactaaagtttgtgacagaacgtgccggccattctcggtaatcacgcaagtagtttcgagcgcttcaaggcgactcaatgtgctggggtgcatcttgctgcacacgctttgataaccgcttcgggcaaaatccttctggatggatttgcgcatctccagcaatacgcctggaagattaactttatgtccagcttcaatcggtgtaccggtcaactccataaccatcagcgtcgcgccattttcatcattcttgatcgcacgctggcgcgacactgcttgaggcttggcgggtgtttcgccgtcaggcacgacttcctcgacctgccaaccactgggccagtgaatctccgggtcggcggccagcacccacggactggacagaaacccacacacagcgctcaacagcagtctacgaaactcgatcattgcaaaagacacccaaagttcaagcagcaaagtttgcggcccagccggtgcgggtcgcaagggctgcctgtgctttttcatttggcgcagcgggcaggccttgcgtatcatggtccggctgcacggaggctgccgcaagccaagggaccgctttgccccatttttctggagggcccatgagcctgcacgaactgaatactttcccgggcgtcaccgcccagcctgataccgcgacgacgaacttcgtgttcaaccacaccatgctgcgggtcaaggacattacccagtcactggatttctacacccgtgtcctggggttctcactggttgaaaagcgcgacttcccggaagccgagttcagcctgtacttcctggccttggtggacaaggcccagatcccggccgacgccgccgagcgcacccagtggatgaagtcgatcccgggcatcctggaactgacccacaaccatggcactgaaaacgatgccgactttgcctaccataacggcaacactgaccctcgcggctttggccatatctgcatctcggtgccggatattgtcgcggcatgcgagcgttttgaagcactgggctgcgacttccagaagcgcctgacagatggccgcatgaagagcctcgccttcatcaaggacccggatggctactgggtcgagattatccagccagcgccgatgtaatcctcggacgacagaaaacaaaaagccccacgagcaatcatggggctttttttcaagggctcggttatgccggagctgacgtacgaatcaagtgatcaaaggcgctcaacgaagccttggccccctcacccaccgcgatcacaatctgcttgtaaggcacggtagtgacgtcaccggcggcaaacacgcctggcaatgaggtctcgccacgggcatcgacgatgatctcgccgcgcggagtcagctctacagtgcccttgagccaatcggtgttgggcagcaagccgatctgaacaaatataccttccaggtcgatggtcttgaactcgccgctgtcgcgatccttgtaggcaagaccggtgactttctggccgtcgcccttgacttcactggtcagcgcgctggtaatcacatccacgttcggcaaactatagagcttgcgttgcaataccgcatcagcgcgcaacttgctgtcgaactcgagcagcgtgacatggctgacgagcccggccaggtcaatggcagcctcaacaccggagttaccgccgccgatcaccgccacgcgcttgcccttgaacaatgggccgtcgcagtgcgggcagaagcatacgcccttggccttgtattcctgctcgcccggaacgcccatctctctccagcgggcgccagtagccaggatcacggtcttggacttgagggtcgcgccgctttcgaagcgaatttcgtgcaactcaccaggatttttcgccggcaccaggctactggcacgttgcagattcatgatgtccacgtcgtactggcgcacatgcgcttccaacgcactggccagcttcggcccttcggtttcctgtaccgagataaagttctcgatcgacatggtatccagtacctggccaccaaaacgttcggcggcaactccggtacgaatgcctttgcgcgccgcatagatggctgccgaagaaccggccgggccaccgccgacgacgaggacgtcaaaggcgtctttggcgctgatcttttccgcggctttttcgataccgctggtgtcgagcttggcaaggatttcttccaggcccatacggccctggccgaagttgaccccgttcaagtagacactcggcaccgccatgatctggcgctcgtcgacctcggcctggaacagcgcaccgtcgatggcgacgtggcggatgttcgggttcagcacggccatcaggttcaaggcctgtaccacgtccgggcagttctggcacgacagcgagaagtaagtctcgaagctgaactcgcctttgagggcacaaatctgttcaatcacctcgacactggccttcgacgggtggccaccgacttgcagcagggccagcaccaacgaagtgaattcatgacccatggggatgccggcgaagcgcaggctgatatcggcacccgggcggttgatggagaacgacggcctgcgcgcatcatcgccatcggttttcagggtaatcagcgtggtgaggctgatgacgtcctgtaaaagagcaagcatttcctgggatttcgcgccgtcgtcgagggaggcgacgatctcgatcggctgggtgacccgttccaggtatgacttcaactgagctttaagattggcgtccaacatacgggcgatttcctgttcattcggtttattgcagacaaaaaaacgcccgagcgaatctcgcccgggcgttttgagggcggatgcagcttacttaagtgcggattcccgcccttgatacgtcttcacagacttagatcttaccgaccaggtccagggacggagccagagtggcctcgccttctttccacttggctgggcagacttcgcctgggtgggcagcgacatattgagcagccttgatcttgcgcagcagctcggaagcgtcacggccaacaccgccgtcgttcagttcaacaatcttgatctgaccttctgggttgatcacgaaagtaccgcggtctgccaggccggcttcttcgatcagtacgtcgaagttgcgcgagatggtcagggttgggtcgccgatcatggtgtactggatcttgccgatggctggcgaagtgttatgccaggcagcgtgggcaaagtgggtgtcggtggaaacgctgtagatctcgacgcccagtttctggaattcggcgtagttgtcagccaggtcttccagttcggttgggcagacgaaggtgaagtcggctgggtagaagaacaccaccgaccacttgcctttcaggtcagcgtcggtcacatcgacgaagctgccgtttttgaaagcggtggctttaaacggttttacttggctgttgatgataggcatcgttgactctccgtcaggggttagtaagttgatgaagtgaatcctaccggctctctcggtcgatggctcattggcaaacctgatgttggcgattggctttctctatcaggcaacagtattaatagaagaatcttacaacagcggttgagtagccagggtcataccaagaaacggcgtcgcttcaacatagcgcatggcggatttcatgtcgctccaaccgacgtaactcatcagtgacttcaaatcccagccactgcgatgcgcccaggtagcgaagcctcggcgcagggaatgactggtgtattgctcagccgcaatgcctgcgcgttcaagggcctggcgcaataaggggatcacactgttggggtgcaagccctcctcgcccagattgccccagcggtcaatgccgcgaaagaccgggccgcgcacgagggccgagacgctgagccactcgctataggcctgcactgggcacaggcgcagcagcgctggggtctggtaagtcttgccgagattgtcccggtcgtttttgctgcgcggcaggtagaggctgatgccggcacccggcactgcctggacatgctcgatactcaaccgacacagttcatcactgcgaaaaccgcgccagaagcccagcaggatcagcgcggtgtcgcgcttggcgcgtagcaatcgagggatgtcctgatcagcagcggcctgcctcgcctcactttccagggacgcgactacctgctccaggtgcttgagctgcaagggctcggcctgtctttctcgcgccgggtgcaccgcacggatccccttgagcaccttgcgcaccaccggcgccttggtcgggtctgcaaagccttggctgagatgccactgcgacaaagccgagagccgcagcttcaaggtgttcactgccaacactccggcatgcgctgccaggtaacgcgccacgctgtcgctggtggcgggcaggaacccgccccatgtcacttcgaaatgctcgatggcagcccgatagctgcggcgcgtgttgtcgcgggtggcggcgttgagatatcggtccaggtcgctcatgggcgtctttcgtactgttggcgggtggagtggcaattaaaactgccgtgacacgggataatacgccaatatcccgcctgttaaatcatgaatttctacgattttttagacatgctatagtacgtatatacataatacgtaccacattatcaaatcgacggagaccccatggctcgcggcggcataaacaaagcagtagttcagacggcacgcctggcaatccttgcccgaggcgaaaaccccagcatcgatgccgtacgcatcgagatgggcaataccggctcgaaaaccactattcatcgctatttgaaggagttggacgagagcgagacccgccaggcgatcacccaggcgccgattgacgacgagctgggcgaactggtcgcgcgcctggcccaacgcctgaaagagaaagctcaagagccgattgacctggccctggcccaattcgaacaacagaaagccgccctgctcgcccaggttgaaaccctggaagaggcgcatgcccagcttaagcagcaatttgatatccaggccgcggccctgacggaagaaagcgccgccctgcaaaccgccagcaccagcctgcaggccgaacagacccgcaacgccgggctgagccaggcgtgcagcgattacgagctgaggatcagcgacaaggacgagcagattcgctcactggaagaaaagcacctgcatgctcgggatgcgcttgagcattaccgcaatgcaatcaaggaacagcgtgaacaggagcagcgccgccatgaaggccagttgcaacagatccaggccgagctgcgccaggcccagcaaaacgcactggtgcgccaggatgaaatcacccagctgcatcgggacaatgaacgcctgctgattgagcagcgtgtgacggtcaaggaactcaatacgctgcaagagcaggtccgcaaggatcaagccgcacaactcaaactgaacgagcagctcagccggatcgacagcgagcgcaccctgctccaggaacgcttgcgtgttgccatgcaggacagccagtcgcgccatgaggcgctgcttgagcaccaacggcacaacaaggcgctggaactggacctgatcaaggcccaggcgagtatcgacgcgttgcgcctggcggccgtcgttgcgacggcgccagaggcaacggagccaacctgatcagtcggccacaggcgtgcgcatggtgacgaattcttccgccgccgtagggtgcacgccgatggtctcgtcgaaatgctgcttggtcgcgcccgccttgagcgcgatcgccaggccttgcacgatctcaccggcatccgggccaaccatgtggcaacccagcactttgtcggtgtcggcgtcgaccaccagcttcatcagggtcttttcctgacagtccgtgagggtcagcttcatcggccggaaccggctttcgaaaatctgcaccttgtggcctttggcacgcgcatcctcttcgctcaggcctacggtgccgatcgtcggctggctgaacaccgccgttgcgatattggcgtaatccaccgcacggtattgctcgggcttgaacaagcgccgcgccacggccatgccctcggccaatgccacgggcgtcagttgcacacgaccaatgacatcgccaatggccaggatcgacggctcggcagtctggtacagctcatccacggcgacaaaaccacgctcatccaacttgaccccggtattttccaggcccaggttgtccagcatcgggcggcgaccggtggcatagaacacgcaatcggcctccagcacacgcccatccttaagagtggccttgaggctgccgtcggcttgcttgtcgatgcgctcgatgtcggtattgaattgcaggtccaagccgcgcttggtcagctcttcctgcaagtgcttgcgcaccgagccatcaaagccgcgcaggaacaggtcgccgcggtatagcaatgacgtctgcgcgcccaagccgtggaaaatgccagcgaactcaaccgcaatgtaaccaccgcccaccaccagcacacgcttaggcagctctttgaggaagaacgcctcattggaaccaatggcgtgttcgcgccctggaatctccgggatctgcggccagccaccggtggcgatcaggatatgcttggcggtaaaccgctcgccattgatctccacctgatgggcatcaaccaggcgtgcatgcccttcatgcaaggtcacgccactgttgaccagcaggttgcgataaatgccgttgaggcgattgatctcgcgatccttgttggcgatcagggtcgcccaatcaaagttcgcctcccccaacgaccagccgaaaccgctggcctgttcgaagtcttcggcgaagtgcgcgccgtataccaacagctttttcggcacgcagccgacattcacgcaggtgccacccagatagcggctttcagccacggccaccttggcgccaaagcccgcggcaaagcgcgccgcgcgaacaccgccggaaccggcgccaattacatacaggtcaaaatcataggccatttcattctcctcggcaggacgccagcatatcgacttacatggggccgaaaaacgaaaaagccacccgaaggtggctttctgttgaaacagatgggcaagcgtgaatcagtaagccttgccagtcttgtagaagtgctcgaagcagaagttggtcgcttcgatgtaaccttcagcaccgccgcagtcaaaacgttggcctttgaacttgtaggcaatcacgcagccatctttggcctgcttcatcagcgcgtcggtgatctggatctcgccgcccttgcctggctcggtttcttcgatcagcttgaagatatccggggtcaggatgtagcgaccgatgattgccaggttcgacggcgcgtcttccggtgctggcttctcgaccatgtcgcgcacgcgaatcaggccatcaccaatatcgtcaccggcgatcacgccgtacttgttggtctgagatggatcaacttccatcaccgcaacgatggtgcagcgatacttctggtagagcttgaccatctgggtcagcacgccatcgccgtccaggttcacacacaggtcatcggccagcacgactgcgaacggctcgtcgccgatcagcggtcgaccggtgaggatggcgtggccaaggcctttcatctgggtctggcgggtgtaggagaacgagcactcgtcgagcaacttacgaataccgaccaggtatttttccttgtcggtgcccttgatctggttttccaactcgtagctgatgtcgaagtggtcttccagggcgcgcttaccacgaccggtcacgatggagatttcgttcaagccggcatccagggcctcttcgacgccgtactggatcagtggcttgttcaccaccggcagcatctctttgggcatggccttggtcgctggcaagaagcgagtgccgtaaccggctgctgggaacaagcatttcttgatcatatgagtccttacaaagggctgtgcgtacggaattcggcgcagtctaatcaggccgcagtcaccttacaatgggggctgctggcgttgcgatgtcatcatagagaaaaaatgtcggcgtaagttccgctgatcttacaaagggcttcaccaatggccaggcaaaaaacgcccatcccctttatttaaaaggctgccaaccgttttagcacgctttcagccgccgggcactgacctgcaacatcttgcccgcccccagggtatttggcgctatcatgggcagcttgaacccgaccacgagattgccaatagatgtcagaaccaaaaggtgtaaacggctacctgatcacagagcgagcggacggctggcacttgatcaatttccacggcgacagcgttgccgggacatttgccaccgaaagccaggcgattgcggtcgccgaagtgtttgtggatgaagcgggccatgcatcgagcaaaaggccgaaaggcaagtaagcctctcctgcagcacaagaagccccggttaacggggcttttttgtgcgcaccgatcctggtagtgcattgaaaccatctctaagttgctcacctcgcctggacgctgttatttttcaggcgttgtaatccccttcttacagtctcgtatctaactaaaacattctcattaagtcgcatgtagtccatctcttacagcttaaatttaagttttggcatattgccataatcctcctatagcacgtgataccgcgcagctacacgacttagcgaatcaggcgacttacttacacagggcgagcgtggacaatcacctcgcctcaaatgtgacgcgaaattgcaatgcaagtagttggaaaaacactttcttgactacaactcggcagacgcttgatcgggttttccgcgagccacttttgaagcgaagaagtaagtcccgcacacaccgtggcgaggctcaatcaatgacatcttttatgtaggcatctgcaaatgaaaactaaatttaaaactgcgctgttgaccatcgggttgttcgcgggttcgatctccgctgcccatgcggcggatggaacagttacttttttgggatcggtccactcgggtgcctgctcaatcaagcctgaatccatcgatcagaccgtcaatcttggcgctatcgcaaagcatcaactgcaggcaggcggcaagtctgaggcccgcagcgtgaaaatcgaactggaaggctgcgacctgaccgatctcaccgataacacggtgaccaccacgttcaccgccgctccctccagcgatgtgccgggcgcgatcggcaccgttggtggcgctggtcgcatcggcatcatgatgacccatggcggcaggcccgttgagctgggtgtcgccaccaccccgcaagcgatttccacgggcgataacaccctggaattcggtgcctacgttcaaggcgccgctaccggcgacatcgtccccggtgatttcagcgcagtcaccaacttcaccctggcttatcagtaaggctttccccccgccatcgatgggtggcggggggaactggtgggagataacggtgaaaagattcttaagtctcgcagtcacctccacattgacgatgtgcatcagcccctgggtgtttgcccaggaaccgtcgcaaggcgaaggcgtcgtcaccctaggtggagagatcgtcgactctgcgtgcgggctggaactgaccagtgccgaccagtccatcgagatgacgcccgagcccataggcaggctgctgcgcaatgcgctgggggagccgcacccgtttgagttgcgtctggtcaattgcaccctgacgcgcccggacccttcgcgccccggcgccaccttgcctgactgggagcatctgcgggtgacgtttgacggccctcgcgacagggacggccgctcctttgctgccttcggtgactcacagggagtggccttccatatctgggattcggctggacaggagagcgtgccaggcgagccgatggctccgcaccccctggccgagggtgacatcacacttcactacacgctccgcctggtcggcaacgggctgccactggcgccaggtgctcaccgtgtcgcggtgcggttcaagttggaatacttttgaacattgatgggttgctttcatgctgaatgcgtcgaagatcaaaaatacacttcgccccgggctggttggcgggctgatgtcactggcaggcactgccttgggtgccggcgatatcgaattcaataccgacgttcttgatctgaatgatcgcagcaatattgatttgtcccggtttgcgcgaggcggtttcattctgcccggcacctacacaatgttcgtgcagatcaatggccaaccaatttccgagcaagcggtggcgttctacccccccgaagatgatcccaagggaagccaggcttgcgtgtcccccacactggtggaacagctgggcctgaaggcatccgatgccgccaggctcaccgcgtggaaagacggcgaatgcctggacctccaaggcctgccgggggcgcaggtcagtgcggacctggcgacctccacgctggacatcaacctgccccatgcctatctcgagtacagcgcacttaactgggatccacccgcgcgctgggatgagggagtgccggggttgctggttgactacaacctgacggcgcagtccaacgcccagaaaaacgagcgcacgcgcaatcacctcagcggtaacggcacactgggggccaatgccggggcctggcgcctgcgcgccgattggcaggggcgtgtcgacagcgcaagggatcggtccgccggcgaacagaagctggaatggagccgctactacgcctaccgcgccattccgtcattgaaggcgcgactggtggttggcgaaaactacctgtattcggacctgttcgacagcttccgctttaccggtgccgcgttgaattcggacgaaagccaactgccaccgaacttgcgcggctatgcgccggaagttgtcggggtggccaagaccaatgccagggtggtggtcagccagcaagggcgtgtgctgtatgaaaccctggtggctgccggcccctttcgcatccaggacctcaatgatgcggtgaccgggacgctggatgtgcgcgtggaagagcaggatggttcagtacagaccttcaagctcaacaccgcaggtgttccctacctgacgcgccctgggcaagttcgatacaagctggcgactgggcggccttctgatcttcagtatggagccgacggtaacttcttcggtaccggggagttctcctggggtatcagcaatggctggtcgttgttcggtggcgccatcaccgataacaactaccgtgcggccactgtcggtgcgggtcgtgacctgctggtgctgggcgcgttatccctggacgtcacccagtcccacgcaaacgtgtggaatcaaacactctcgggtaagtcctatcgcctgcaatattcgaagaactttgaacaatatgacagccaagtaacctttgccggttatcgcttttccgataagaacttcctgagcatgagtgaatacctggatgcgcgtcactacggcatgaacggcgaactcgcaggacgcggcaagtacgatgagttcggtcaatacgccggcgaattcaaaccgattggcggcagcaaggcgctgtatacggcgaccgtcaacaagcagtttcgtgacctgggcgccacggtgtacgccagctataacaaacaaacttactggtcgcggccagccagccagcgctggaacttgtcagtgtctcgttacttcaatgtcggcactgtcaagaacatgagcctgtccctcaacgtttatcgctctcaggactacaactataaggataacggcatggcactgaccgtcagcctgccgctgggacgcagtggcaccctgtcgctggatgccaaccgggccgcaggcaagaatggcttttcaacgcgctacagcgatcgcctggatgagcgcaacagttaccagctcagtgccagcgacaattccgccagtggttacctgagccacaccggtgagcaggctgacctgacactcgctgccagtcgccagcaaggcaacaccagcctgagcatgtcggctcgcggcggcggtacgctcacgcgccacggcgcagcactgcatcgcaccggcagcatgggcggcacgcgcttaatggtcgataccagcagtgtagccgatgtgccagtgcgcggttacggcacgccgacgcgcagcaatgcctttggcaaagcagtaattgccgatctgagcagctaccagcgtacggcggccagcgtggatctggagcgtctgccgaagaacgtcgaggccactcaatcggtcactcaggtgaccctcaccgaaggcgccatcggctaccggtccctggaagtgatttccggtgagaaagccatggctgtgctgcgcctatcagacggcagtgcgccgcccttcggcgcgcaggtcaagaacgccaagcagcaagataccggcattgtgaatgatggcggcagcgtctacctgagcggtatccaggccggcgagcagatgttcgtcagctggggcgaacgctcacgctgcgtcctcacgctgccgcaggccttgccggctgatggcctgtcccatgccctgcaactggactgccggatggtagccactgaacaaaccttgtccgcgccggcagagctgtccggcaagcccaccgccacggagcacacatcctcatgagccttaacacccgccttaccctttcgtccctcgcattgcttgccatcggcatgtgccaaggcgccaatgctgctatcgcgctggaccgtacccgcgtgatcttcgatggcggcaaggacgccaccagcgtgaacatcaccaacaacaacacccagttgccgtacctggcccagggctggattgaagatgaacaaggccagaaaatcaccgcgccgctgatcgtgctgccaccggtgcagcgcgtggagcctggaaaacagagccaggtgaaagtccaggcgctgcccgcggccaaatccttgcctcaggatcgagagacggtctactacttcaacctgcgggaaattccgccacgcagcgataaagccaacaccctgcaaatcgcgctgcagacccggatcaagttgttctaccgaccgcaagccatcaccccgagccagcaagacctgtccaacccctggcaggaaaaactgaccctttcccggcagggcgaacattaccaggtgaacaacccgacgccgtacttcgtgaccctggtggatgcgcgcagcaccaaggatggcaagaccgtgcccggtttcgagccgctgatggtgccccccaaaggctcgctggccctgggcccgacggccaaggcactcggcaccgccccttacctggcctacgtgaatgactacggcggacgtccgctgctggcgttcacctgcagcggcgagacttgcaaggtgaacccgcaagcagccccgctcacacagtaacgaccgccggagtcagtgatgaaatcgcattatgtgaaggtcttgggcggcctgctactggccgttgtcggcagcgcacaggcccaggacgaagacgatatagaaggcatgagcggacggctgaatatttccgggtccatgcatgaaaccccatgcagcctggagatgacctcgctgcatcagaccattgacctgggcgatgtttctaccagccagttgcgccggcccggtgaccaggcaagggcggtgcctttccaactgcgctttaccgattgcaaccgcatcgccggcagcatccgtagcgagcgcacggggaacctgacctggagtgcctttcaaccggtgctgtcggtggcgttcctggcaccggccgatgctgatgatccacgcctggtgaaggtgcaaggcatcaccgggatgggcctgcagttgaccgatgtgcttgggcgggatgtcaacctgggccaacggggcgaacctttgttcctgcccctgggcggcaacacacagacctggaaggttcggcccacgcgcacctccgcgccgttgaccagcggggcattccgagccgtggtggatttcaggctcaattatgagtaagggcagaataatggctaagtcaaacggcccatgggccgtgtttatgggcggcctgctgtgggccgccagccaggcggtgcaggccgagaccagcctgaccatccgcgcagtgatcattgcaccgccgccgtgtgtcatcaacagcggcagtacgctcaacgtgccgtttggcgatgacctgctgacctcacggatcgacggggtcaactaccgccgcggtgtgccctacaccgtcacctgtgatgcgccgtacagcaatgcactgacactggagctcaagggcaccggcgccgcgttcgacaatcgggtgctggtgacgcgcaagcccgatctcggggtgaagctgttcgtcaatggcgctgactggcctttgaacacagcagtgaactttacctaccccaacttcccggtggtgcaggccgtgccggtcaaacgcccaggcagcaaattgaccggtggcgccttcgatgcgaccgccaccctggtggtggattaccaatgaagccgatcaaccatgaagagaaacgcaccatgactttttggccgcagagaacgttgctcgccctgtgtgccatcggcctgtgcaatgtcgcctcggccaacctgacgttcagcggcacattgaacgagccgccgccctgcaccatcgatgccggtaacaccattgaagtggattttggcgatgtgggggtaaaacgtgtcgacggtgtgaaataccgccagggcctgagctacaccatcagctgtggcaccgacaccctgccctgggcgctgaagttgagcgtcaacggcaccgcgacaacgttcgacggcgcagccgtgcagaccagtgtgccggcgctgggcatccgggtgttccagaacaacctgccgtttgccctcaatacgccgcttgaaatcagcctgtcgtcgccgccggtattggaagtggtgccggtcaagcaacccggtgcaaccctggcccccgcccgatttaccgcggtggccacgctgttggccgaataccagtaggagttggaaaaccatgggacatacacctacccacaagggttggaccttcgccgcgctggtacttggtgtgggcctgatggccgacgtcgaggctgcggacaacctcagtttcaaaggcaacctggttgaagaagcttgcaccattcgtcccggggacgaggccattaccctggaactctgggacctgaccagcaagtacctgtacctcaacacgcgatcattgggcaaggccttcaagcttcacttggtggactgcgacaccacggtgggcaacaccatcacgatcaccttcggtggcagggagaacccggcactgcccgggctgctcgcccttgatggcggcagcggcgccaccggcatcggcgtgggcatcgagacactggctaacaagcctctgccccttaatacggtgagcgacagacaggcgttgagcgatggcaacaatgtgatcgaactcaaggcctatgtgcagggagagccgcgggccatccaggaccagactatcgggcatggcgcctacacggtgacgtccacgttcacgctggactatccgtagtcattcccaggctgagaacagcctgggaaaccttcgaatctcttccgggcggcgcaacacgggattgcacgggattggttgcctgtggccgctgttcggatagaagagcaacgagagataaccatgaaacgactctacggcgctattttgcttctcgtcctgctgagtgctgccaccaccgtgcgagcagctgattgccgcgtgaatggcggaagatggcaatacgtaggcgacggtgggattctgaatctggaagtccccgttaccgtccgcgtaggttcggacagtacccgcctgatccttgaaggggcatggttggagtgccgattcaccccctcgcctgcccaccctacgcgcattgactattggggaacatccgcgcaagccggtcccccttgggtacccggtccgaaattttccctgcaaggtaccggcttgcgcataaacggcacgttttacaacacgcctgtgccgtttaacatccggatcgcgaccatgcctaataacggcgcggggtatttgatcaatgtagccccctatatcttgctgcgaaacgaccctagcaaccctatcgatgttcgaataggcgatatcctgggcgcgttgaacctccaccagaccaacaattacagttcgggaagtacgaggctcgtactgacgtacaccgccgcaaacaacttcgacatctccccctcaacctgcaccatcaacaataacaaccccatcgaaatcaacttcggcgacgtacagcagcgggcgatcggcagcgatcccctgacaagtgccatccgcaccaaccgcaggcttacctacgcttgcccggatggcggcatcaccacccctataaccattacctacaaaggcatcccgtcgtcgttcgacaaccggttgctgaccatgaccaatccggacgtggggaccgccttggtccgtgcgggggccgcggttcaagtcaacggttcattccgtacccagattaccaacagcgtgggcggcgacgatgtgacgttcgccctggttcgccgcgcgggatcactccccacggcaggggcaataagcggcagcggcgtgctggtgatgggtgtgccatgaaacaggcaaaagaagtgggaataccgatagtggagcaacgagagaacacaatgaaacgattgcatggagccgctgggcttctcatcttcatgggtacgatatcgaacgcgctggccgtcgattgccgggtcaatggtggcaactggcagacgggtaatcccaacttgcgcgttccggttatggtgaccttaagctcggaccgtcagaggatcatgatggagggtgccaggttggaatgcatgtattcccctggccagggccctgcctggggggaggattactgggcaacggggaacgcctcagggacaccctggacccccggccctcttttcggtaacgaaagggccggtttgcgtatcaacggatcgtttctgaacaatccggtgccgtcgggtatccgcgtggcgacaatgcccaataaccgtgtcgtttaccccatcaatatcaccccgtacattctgatgcgcaacagtccgtccaacccgatcaacgtcgtcgccaatgacctactcggtatgttgcgcatcagcagctcgaacaactgggacaacacccgaccgcaagtgaccgttacctatatcgctgccaacaacttcaccgtgtcgccgtcgacctgcacgatcaacaataacaacccgatcgagatcaacttcggcgacgtccctcagcgcgccttgggcagcgatcccctgaccacccccattcgcgtcaaccgcaggctcaactactcgtgcccggatggcggaatcgactcgcccatcaccattacctacaaaggcatacagtcgtcgttcgacaatcgactgctgatgatgaccaatccgaacgtgggtacagccatggtgcgtgggggggccgcggtgcgggtgaacggttcattcctgacccggatcaccaacagcgtaggcggcgatgacgtgacgttttcactggttcggcgtgcgggttccctacccgccaccggggccacaagcggcagtggagtactggtgatgggggtgccatgacgcaccggtggggctgaggaaaaaaggggcgcgggcgaagatcttgtatcagggactgtgcacttggtggcagttcgctataatccgcgccaacgccccacgacagtgtcagcgcccaccacttctcttaacgatgacccactatgaacaagatcctggcactgactgcggtactggcgctggccggttgcaccaccacatccgacaccctgctgaaaaatggcgaacaaggcctgaccatcgactgttcgggcgaggccaactcttgggccagttgctacgagaaagccgacgcgtcctgcgcgggcaccggctaccgtatcgtcggcaccaatggcacgcctgccctcaaggagagtgacaagactttgggtcaggatgtgggcaatttcaagggccgtagcgtcgtggtggtctgcaaataagccggcgtgctacagatgcacttcggcgaacttgatccccaggccacgcagtatttcgatcaggtcatccaggcgcgggaatgactcgacttcatcctggtcgtccaccaggaagtagctgcgaccgccgcttttcttgaagaatacaatccactcgcccaggtcggcggggttctggatgacatgggtcgccgcaatctgaccttcagcatggcgggctttgacgagttcgcgtttcataacaggctttccagaaaaaacaaatgccgctcaaacccaaggtctgagcggcatctttatagtgaatgcccaacagtttaacggatgccctgccccaaatgcatgtcgccactgacgggtgatggcttttttatcggctccggtgcgcaggataggcctggggctcagccagaaatgcagtcttccccggctttcttcacgtcgccagggcgaatcggtacattggacatgctttcatagagcttgatgctgctcccactggagcggtcttcgattacgaagatcgccgaaggatccgccgagaatttctgcggcacaatcacctggatcccgtctttatggggctcgatctgcggtggccggcgggtcgcctccaatttacgcactacacaggccgcatattcctgcggcttcttgcctgagatgaccaccaatgttggcggggtctgcttgatatctgcaaccgaagcacacccacctattgccaaggccagcaccaacacactccacttcatacaaaaacctccgataaagaccctacgacagcggggatggtaaatttctcccaccaacgtaggatttatctctgattacagggtaaataactgttttaaattgtcgatgtcgtcgacgacggcccgataataaacgcgctggggctgataaactccatcttaacctacgtatcgttctgatttttcagaaaaagcccttctggagacaccccatgaaattcatccaccagcgtgagcacctcaacgagggagacattgtcgtcatcgaatgctcgcagacctgcaacattcgcctgatgagcgacgcgaacttccgcagcttcaaaaatggtggtcgccatacctatcacggtggcgcattcgataagttcccagccaagatcaccgcgcccagcactgggttctggaacatcaccctcgatgtggtgacccgtcgcgccatcagcgtgacccgcaagccggcgctgtcccacaagattcgcatcgttcgtcgcaccagcaccaagttgagctgatccgaacacctgaaaggaagaaagctgtgacccctacgaccaaatacgtcatcaagtacaaactcaacggcgagcgccgctttgaatttgcccaattgcaaaccgacagcgtcgaagaagccaagcaagccctggcgaaaattcatgatgccagtgacgaaatcaccgacatcaatgtgagcaaggcgctgtaagacatgtcggggccgactgccgatttattcgccgatagtgccctgcaacaacccgcggggcgcgagcagattggcgacgagtcctacgtactccggggctacgccctgccctggattgaccggttgctgcccgagctgcggcgtatcctggcccaatctccgtttcggcagatggtcacacccggtggtttcaccatgtcggcggcgctgagcagttgcggcgacctgggctggaccaccgacacccgcggctatcgctacagccccctcgacccgcgcaaccaacagccatggcccgccatgccaaacgcgttgcggcagctggcggtgtcggcggcagccgaggccggtttcagcggctttttacctgacgcctgcctgatcaatcgctacgtgcctggagcaaagatgtcactgcatcaggacaaaaatgagcgttgctacagcgcccccgtagtctcggtatccctgggcctgccggctattttcctgtttggcggccatcagcgcagtgacaaaacgcagaaggtctcgctgttccatggcgatgtggtggtctggggcggcgttgatcgcctgcgctttcatggggtgatgccaatcaaggaaggcgagcatcccgtcatgggcccgcaacgcatcaacctgacctttcgcactgccggctgatttgaccgcaagcttcggagtgtcatgggcaaccgacacggttaatctgctggtgaaccgtcaagagtgcaggccatgaacaacgaacacgatccgcgctgggccgccatcattgcccgcgatgccaaggccgacgccctgtttgtctacggcgtgaaaaccaccggcgtatattgccggcccagcagcgcttcgcgtttacctcgcccggaaaatatcgaattcttcgacaccccggcgcaggccgaagccgcgggttatcgtgcgagcaagcgtgccgcgggcgatcaaactcaactggccgcccatcatgcgcggttagtcgccaatgcctgccggcagatcgaacaggcagaaacggccccgagcctggaagcactcgcgcaccaggccggattgagcccgtttcactttcatcgtgtgttcaaagccagcaccggcctgacccccaagggctacgcccgggccctgcgttcgcgcaaggttcgcgacggcctcaagggccagcactcggtgaccgatacgctgtatgacgcaggtttcaactccaacagccgcttctacgaagccgccgatcaattgctcggcatgaagccccgcgattacaaaagcggcggtgccaataacaccattcgctttgccgtgggccaatgctcgctgggggcgattctggtggcccagagccaacgtggcgtgtgcgcgattttgctcggggacgatccggacaaactggtgcgcgacctgcaagaccagtttcccaaggccgaactggtcggcgcggatcgaggcttcgaacagctgatcgcccaagtcgtggggtttgtcgaagcccctgccctgggcctggatctgcccctggacctgcgcggcacggcctttcaggagcgcgtgtggcaggctttgcgcgagattccggtgggcagcaccgccagctatgcgcagatagccgagcgtatcggcgcgcccaaatcctttcgcgccgtggcccaggcctgtggtgccaaccacctggcggtggcgataccctgtcaccgcgtagtgcgcagcgatggccaattgtcgggctaccgctggggcgtggagcgcaagcgccaattgctggagcgcgagacaccgagctgaaccccggccccataaaacgctgcattcgtccagtgaataaaacagactggccgactgccaggtgcgctgttaaaacagcgaaacgccctactaaagctggagacgcatcccatgagcacctggccagataaccgtattctcgacttgctcggcattgacgtaccgatcatccaggcaccaatggccggggcaacgaccactgccatggtgattgccgcccagcaagccggcgcgctgggctccatgcccgccgccgcgctgagtatcgagcaattgcgcaaagccctgaccattatccgccaagccagtacgcgccctctgaacctgaatttcttttgccaccagccgcctgacgccgatgacgcgcgtgaccgccgctggaaggatttgctgcaaccctactaccttgaactgggcgctgattttgacgcgccgacgccggcgtccaatcgcgcaccattcaacgaggccgcttgccaagtggttgaggagtttcgccctgaggttgtgagttttcacttcggcctgccggagaagtccttgctggagcgggtaaaagccaccggggcgaaagtgctgtcatcggcgaccaccgtcgaggaagctctttggctgcaagaaaaaggctgcgacgcgatcatcgccatgggcattgaagccggtgggcaccgtggcctgtttctaagtgacgatctcaacagccagatcggcttgatggccctggtgccgcagattgtcgatgcagtcagggtgccggtgattgcggcaggcggcatcggcgatccgcggggcattgtcgccgccatggctctgggcgcctcggcggtacaaattggcacagtgtatctgttcacgcccgaggccagcgtcacggcttcccaccaccacgcgctacgccatgcacaggccagtgagaccgcgctgaccaacctgttcaccggccgcccggcgcggggcatcgtcaaccgcgtgatgcgtgaactcggcgcaatcaacccggccgcaccggcgttcccaaaagccggcggtgcattgatgccgctcaaggccaaggatgaagcgggtttcagcaacctgtgggcgggccaggccctgaggcttggcaaaaattgctccacctatgacctgacccgcgagctggccgagcaggcactggccaggctcacgcgtaactgagtcaggcataaatatgtgggaggggcggtgcgacgattcgacttgctcccgatggcggagggtcaatcgctgatgtatttcactggcactccctcatcgggagcaagccccctcccacattttcaccgagtaacccccaagtggtgtaggtaacgatgcttgaacggcaacttggcactgtaccagcaatggtcgaccgctatatattcccatacatagcgtttaaaccttctacccgaccacgccgtccatcccaaggagttgctccatgatcacccgcgtctcacgcctggcccccctgcttgccgtatttgccttgggttcggcccacgctgatgaagtgcaggtggcggtggctgccaacttcaccgcaccgatccaggccattgccgccgatttcgaaaaagacaccggccacaaactggtcgccgcctacggcgccaccgggcagttctacacccagatcaagaacggcgcgccgttcgaagtgttcctcagcgccgatgacaccaccgcgcaaaaactcgaagccgaaggcgataccgtcaagggctcgcgcttcacgtacgctgtcggcaccctggcgctgtggtcggcaaagggaggctacgtggatgccaagggtgacgtgctgaaaaaaaaccaattccagcacctgtccatcgccaaccccaaagccgcgccctacggcctggccgccacccaggtgctggccaggcaaggcttgaccgaacaggtcaaggacaagctcgtcgagggccagaatatcacccaggcctatcagttcgtgtccaccggcaatgccgagctgggctttgttgccttgtcgcagatctataaggacggcaaagtcacccgcggttcagcgtggcttgttccggcatcgatgcatgacccgatcaaacaggacgccgtgatcctcaacaagggcaaggacagcgccgccgccaaggccctggttgactacctgaaagggccgaaagcagcggctgtgatcaaatcctacggttacgagctgtaaatgcccctctcgagtgctgatttttccgcgatctggttgaccatcaagctggcatcactgaccaccgtgatcctgttgatgatcggcactccgattgcgctgtggctgtcgcgcaccacctcgtggtggcgtggccccatcggtgcagtggtcgcattaccgctggtgctgccgcccacggtcatcgggttctacttgttgctgagcatggggcccaacggctatttcggccagttcacccagtggctgggcctgggcaccctcacgttcagcttcgccgggctggtaatcggctcagtgatctattccatgcccttcgtagtgcagccgttgcagaacgccttctccgccatcggcacccgcccattggaggtggctgcgaccttgcgcgccaatccgtgggacacgtttttcacagtgatcctgcccctggcgcgcccggggtttatcaccgcatcgatcctcggctttgcccataccgtcggcgagttcggcgtggtgctgatgatcggcggcaatatcccggacaagacccgggtggtttcggtgcagatctacgatcacgttgaagccatggaatatgcccaggctcattggctggccggtgccatggtggtgttcgcgttcctcgtgttgctggcgctgtactccagccgcaaaaccaagatgggctggagctgatcgcgatgattgatatacgcctgcgcttgaaatactcagcctttgccctggacgtcgacctgcaattgcccggccgcggcgtgaccgcgctatacgggcattccggttccggcaagaccacctgcctgcgctgcgtcgccggtttggagcgcgccgaagaggcttttgtgcagatcaacgatgaggtctggcaagacagccacaaagggctgtttgtgcctgcgcataaacgcgccttgggttatgtgttccaggaagccagcttgtttccccacctatcggtacgggccaatctggcgttcggcctcaagcgcattccacgccagcaacggcgcgtggacatggcccaggccagcgagctgctgggcatcggccacctacttgagcgtcagccgcaacacctgtccggcggcgagcgccaacgcatcggcatcgcccgcgccttgctgaccagccccaggttgctgttgatggatgagccgctggcggccctggacagcaaacgtaaaagcgagattttgccttacctcgaacgccttcacgacgagctggatataccggtgctgtacgtcagccacgctcaggatgaggtcgcgcgactggccgaccatatcgtcttgctcagcgaaggccaagccttggccagcggacccatcggcgaaaccctggcacggctcgacctgcccctggccctgggtgacgatgccggcgtagtgattgccggccacgtgattgcctacgacgcccactatcagttactcaccctgcaactccccaactgcccactgcagatccgcgtggcccatgcaccactggcggtgggccaacagctgcgggtcaaggtgcaggcacgggatgtgagcttgagcctgcaggcggaggaacacagcagcatcctcaatcggctccccgtcaccgtcacccaggacattggcgcggataacagcgcccatgtactggtgcgcctggatgcaggcggcacgccgttgctggcccgcatcacgcgcttctcccgcgaccaactgcacctgcatccgggccaggcattgtgggcgcaaatcaaggcggtggcagtgctggcgtaaccaattggcacgaccgaaagatgctgcggtcaatcagacataccggcctgatttgttgtcaaggaacccgcaccatgcctgattcttcgttgcccgccgacctgccccgcgacctgcattacgttgacgacacccagcctggcattcgccgcaaaaaggtgaggggcaagttccagtacctggacgccaaaggcgagcgcatcaccgatgccgatgaaatcaaacgcctgaacgccctggccgtgccgcccgcctacaccgatgtgtggatctgcgccgaccctcgcggccacctgcaggccaccggccgcgatgcccgtggccgcaagcaataccgctaccacccacgctggcgcgaagtgcgtgacagcgacaagtactcgcgcttgcaggccttcggcaacgccttgccgaaattgcgcaaacagctggaagcacagatcgccgagtcggggtttacccgcgaaaaggtcctggcgacggtggtgatgttgctcgatgccacgctgattcgcgtcggcaatacacagtacgcccgcgagaataaatcctacggtctgactaccctgcgcaaccgccatgtggatatcaagggcaacgagatccagtttcagtttcgtggcaagagcggtgtcgagcaccaggtcagcgtcaaggaccggcgcctggccagtgtggtcaagcgctgtatggagttgcccgggcagaacctgttccagtacctggacgaagacggtgaacgccataccgtcagttcccacgacgtcaacgcctacctgcatgaactgaccggcgaagactttaccgccaaggactatcgcacctgggccggcacggccatggcgttggcggtattacgcgagttggcgtggcagccggagtccgacgccaaacggcatgtggtggcgatggtcaaggacgttgccaggcagttgggcaacacgcctgcggtgtgccgcaaatgttacatccaccctgcggtgcttgagcatttcagcctcggtgaattgtcgaagctgcctaagccccgggtgcgcaagggcctgaaagccgaggaagtggccctggcgatgttccttgagaaattggccgagggcttgccgcataaagccaaggtgggttagcctctgcgtcccttctgattaacgggatgaccgccgacgtgaacaactaagccttccaaaatgtatctgcaacgagccgcctggtgcgcttgttggcctgttcgacatttttttggaggtgctgatgactgacgtcacccggctgcccgtgcttgtttccctgcaacatgtgtctttccagttcgccaatggcgaaaacttgctggaggacatgaacctgtccattgatcacacgcccaccggtatcgtcgggcgcaatgggcgtggcaaaagtatcctggcgaagttgctggccggggtactgctgccctcctccggcaccttgaaaaaaccgtccagtgtcgtctatgtgccccaggcgctgacggttcaagcaggtgcaacggtcgcccatatcaccgccactgagcctgccttggcggcccttgaacgtatggcgcgaggtgaggcccgtgtaggtgacctggaactgatcgacgatcgctgggacctggccgagcgcttgcgcctggcactggatgcggcgggtttgccaaccctcagcgccggcacccgggctgatcaactcagcggcggccagttggctcgggtcgccctgatcggtgcgctactggcggcgccgcagttgctgattctggacgaacccagcaaccacctcgacagtgccgggcgcgcttggctgcgacgggtgctggccgattggcgcggcggcctggtggtggtcagccatgatcgacagctactcaacgccatggggcgcatcatcgaattgtcaccccttggtgtccaggtttacggcggcaactacgatgcctatcaccagcaacgggagacgcagcagcaggccgccatcgcggcgtgggaacatgcgcgccagacacgtagccgtgagcgccgacgcctgcaaaaagaccatgacagcctgcagcgcaacgccgcacgctcgcgtaaaaacgccgagaccgccaacgtcgaccgtttcaccaaggcgcgctggaaaggcgccgccacggagattgtcagcactgtgcgcagcgctcatcacgcgcacaaaaaccagctggatgaacaggtgcgtcaagcctacgaacgcgtggtggacgaagcgcccaccctgcttgccttgccaggctcgacggtgcccaacggccggcaagtgctgacgctggagggtgcgcagttgccctggctcgatccgctggcaccctccagctatctgaccattaatctggcggggcccgtgcgcgttgccgtgcgcgggcctaacggttgcggtaaatccaccctgctcaaattactcgccggccaatggcaggtcgcgagtggcgagtgccaggtggcggtgtccagcgcttatctcgatcagcacctggcgctgctggatgatcggcgttgcatcatcgaacacctcaacctgctcgacaccccgctggctgaagctgagctgcgtacgcgcctggcgctgcttcaactggatgcgttgcgggtcacccaaccggtggcgcaactcagcggcggcgaacgcctgaaagccgcaatggcgattgccttgtggcgtgctacccccgcacaactgctgctattggatgaacccaccaatcacctggacctggaatcggtgctcgcctttgaacaggccttgaaaggctttagcggcgcgatgctggcggtgtcccatgacgaggcctttctacaggcgattgagccgactcatcatttgacgtggcacagcgccggctggcaactggagcatgcctgaggtcattgcacccgcacgcaaagcgtcctacggtagtggccggataatctcaccgaggaaaccggccccatgctgccttcgtcccgcaagccttacaccaacgttacgctagcccatcgacagcgctggcgtgggcgggtgggcatgatgctggtggcttgcctgtcggtactggccggcatgaccgatgccattggctttatggccagcggcgattttgtctcgttcatgagcggtaacaccacgcggttggcggtggccatcagcgctggcgacctcgggctcaccgggcgcctggtgctgttgatcgcgacctttgtgctcggtaatgccttgggcgtaatggtcagccgtttcagcaagcgccacgcgttgccgctcttgctgtgcatcggcgccttgctctgcggtgcggcgctgtggccatcgacagagaccctgccggccctgctggcagcgattatcgccatgggcatgctcaacgcggccgttgaggaagtgaatggcttaccggtggggctgacctatgtcaccggcgcactttcacgttttggccgcggcctgggacgctggttattgggcgaacgccgcaatggctggcgcgtgcagttgattccatgggccgggatgtttatcggtgcggtgatcggcgcgctgctggaacagcagatgggcctgcgtgcgctgtgggtcagcggtgcattggcagggctattggggctggtgacactgatgattccgcggcgctggcacctgggtttcatgccgcgttgaggcgggacaaagaggtgctcgcccgacgttcaggcctcgacatccgtgtaccggtaaagagccataacgtcgagcgagcgagtgaatcataagacaatgccaggcggctgtcccgccgggcgtttcggaatatgactagggcaacgtattacagacaagtagcgagcgcagccagtcgacgtttggctggcatgttgtcttcggctgcatagtacttgacgctagaacccgcaccggtgctctgtacatcgacaaagtagtcgccacctgtggtgtagaccgtgaaaccaccggcctcggtggcctccttgaaaccgccggcgtcgacgccaaacacactttcatcctgccagccgaactggatgcattgggcaaccaccagggtggccttgtccgatgccagggtcttgtaggggctgcctgtgcgcgcctctttcatcttcgagcccgcgcaaccggccagtgcggccagtaccaatgcgccaattaccagcttgtgcatgccattgcttccttggaaaaaccgtgactctaccattgtgccggtgccaactgacgcgcccatgaactttgtttcactgtgaagggcaacctcgccgcctatagtggccaagctcattttcaagaagcctcccttgtgcccgccctcccgcgggcgtttttttgcctgggtatcagagccaccaacgaaacagatagaacaacgccatgctcgacaacacggtgatcaatacgctgcgcgtccagaacatcaacgccacggcgcagacggcggccagcaagtaggggttggtcgggctcaggttgagctgatggtccgccaggaaaataatcggcccgcagattgctgtgagcatgcccggcacggcgaaccccaggaactcacgggcgccgcgattgagccgcacgggcaggcgcggttcgagaaacacatagcgattgaaaaacaccaccaggcccatggccacaatcatcaagtagatcatcgttgccttactcccaggcgcttgcaggcaaaccctgcgctcatccccaatacccccgagaccaccaccgccgattcccagtgcagataactcagccacaccgaacacagcagcgaaatcgccacgcacaccaccgtgggcacatcgcgcaccacgggggtaatcaaggcgatgaaggtggcggcaatcgagaactccagccccaactggtccaggccgggaatgctcttgcccagcacaatgccggccagggtgaagaggttccagatgatataaaacgtcaggccgacgcccagggcgtaccagcgattgaaggtctcacggtcgtagtggttgaccagggcgaagaactcatcggtcaacaagaaccccaggctcatgcgccagcgggtattgagcgcagacaacgtggggcgcatgtgcatgccgtagagcaggtgctgggaggtcagcagcaaggtggtcagcacgatggaaatcaggctggcaccgctcttgaccatgccgatggcgaccaactgcgccgcaccggcaaacacgatggcagacaagccctgggcttgcagcggggtaaattgcgcgtcgatggccattgagccggcgagcaacccccagggcgcgcaggccagggacaagggaataacggcgatggcgccgcgggtgaaggcgtaatgaggtattgcagtgggcatggaaacggctcatcgacagacagtcgacaagcatgccagcgcaatcaggggcttgtcttgaacgatcttgctcaggcgagcttcaccgaaaccagctccaccgaatcccgcgcttcgcgcaattcgtaagcatcctggttgagtcggtggatggtgttgagcaagcgttggcgcaggacttcatcgccgagtttttccacggcgcgcatcaggtcgaacgccgcggtttcgttattttccgcgacggaatccagggtcttacgcaggttgcgagtggcacgggtcacgcgggttcttccttcatcggcaatgggcaggcactttaggacctttgtgtttcattttaatttcaatcagttgtggctgtttcccggtcatttgatccatatcaaatgaaacaaggtttgaccggaacatatggaaatacgtatattcgaataaccatatgtataggcattggtcatgtccgatttcctctctcctcccaccctattcaaatgcctggctgacgccactcgcgcacgtctggcgttattgatcctgcgcgaaggcgaactttgtgtgtgcgaactgatccatgccttggacgatagccagcccaagatctcccgtcatctggcgcaactgcgcagttgcgggctgctgctggaccgccgtcaagggcaatggatctactaccgcatcaatccggcactgcccgcctgggtgactcaggtgctggacaccaccttgcaagccaaccagccatggttgcagaacgacgcactgcgtctggatgcaatgggcaacagaccacaacgggcaagcacctgctgctaagccatcggagcctttattcatgcttgtcgcaattgcgattttcctcgtcaccatcgtgctggtcatctggcagcccaaaggcctcggcgtgggctggagcgccaccctgggggcgatcctggccctggcctttggggtaatcagcctggcggacatcccggtggtgtggcacatcatttggaacgccaccggtacctttgtcgcgttgatcatcatcagcctgttgctcgacgaagccgggttctttgcctgggccgccctgcatgtggcgcgttggggccgtggccgcgggcggcgcttgtttgcctatatggtgctgctcggtgcgctggtgtcggcgctgtttgccaatgacggcgcggcgctgatcctcacccccatcgtaatgtcgatgttgctggccttgcgtttttctccggcggcaaccctggcatttgtcatgggcgccgggttcatcgccgatacggcgagcctgccgctggtggtgtcgaatttggtcaacatcgtctcggcggactatttcaagatcggcttcaacgaatatgccgcggtgatggtgccggtgaacctggtcagcgtcgctgctaccctggcagtgctgctgtggtttttccgccgcgatattccagaggtctacgacccggccgatcttgcagaccctgccagtgccatccatgaccgagcgacctttcgcgccggctggtgggtgctgggcatcctgctggtcggctgttttgccctggagccgctgggcattcccatcagtgcgatttccgcggtatgcgcggtactgctgctggtgattgccgccaagggtcacaagatttccacgcgcaaggtcctcaaggaagcgccctggcagatcgtgatcttttccctgggcatgtacctggtggtgtatggcctgcgcaatgccggcctgaccgactacctggcgacctggctcgacaccttcgccacctacggtgtgtggggcgccgccatgggcaccggcgtgctgacggcactgctctcatcggcgatgaataacctgccgacagtactgatcggcgcgctgtccattgaatccagccatgccgtgggcgtggtcaaggacgcgatgatctacgccaacgtgatcggcagcgacctgggcccgaaaatcacccccatcggcagcctggcgaccttgctgtggctgcacatcctggcgcgcaaaggcatcaccatcacctggggctactacttcaaggtcggcatcgtgctgaccttgccggtgctgctgattaccctcgccgccctcgccctgcgcctgagcgtctgaaggagcctgcaatgaaagtgctgttcatgtgtaccgccaacagttgccgcagcattttgtccgaagccatgttcaatcacatggcgcctgaaggtttcgaggccatcagctccggcagttttcccaagggccaggttttgccccgcagcctgacgacgctgcaggcggcgggcatccgtattgaaggcttgtacagcaagggcaatgacgccttcgaagacagcccgccggatgtggtcatcacagtgtgcgataaagcagccggtgaagcgtgcccggtgtatttcggcccggcgctgaaggcgcattggggcttggcagacccttccgaggtgcagggtgatgaggcgcaagtagacgctgcattcaaggccaccctcgacattatcgccgcacgctgcgaggcgttttttgcgctgccctttgcaaatttagcgccggatgaattgaaggctgagctcgaccgcattgcctcaacgccgcagcttgtgtaggagcgagcttgctcgcgaaaaattcacaggcaccgcgttcatccagcaaacacgcgttatcgttgacgtttttcgcgagcaagctcgctcctacagaggacgtggtatccccctcccggactgacgtatgctttcgcactttctcgaaaggaactgagcatgctgtcgatctttgtctacgcgctggtattcggttttgtgttttgcctgtctcccggcgccgtgctggctgagaccctgcgtcgcggcttgctgcatggtttcacaccggcgctgatggtgcagtttggttccctcgtaggcgatgccgtctgggcggtgatcggcctcaccggtatcgcactgctgattcagcatgatgcggtgcgagtgccactgacgatcgtctgtgcgctgtacctggcctggctgggcatccgcagcctgattgatgcctggcagttacccgcaaccgacaacttccctgccagttcaggcaaaaatgcgttggccgtaggcgcggcgatttccctggccaacccgaagaatattgtctactggggcgccctggggagcgccctgtcgggcatcgtcggcgcaacccccagccacgggcagaccctgatgttttttgccggattcatgctggcgtcggtgctctcgtgttttctcaccgccgcgttggtgaatctgctgcgcaagaatgcatcaccgacctggcaacgcgtgagttatgcggcgtgcggtttagtattgatctatctggcgatactcgccgcgcaaggtatataaagttatccggccagtaactttcacatgcctcttgtctgaacaaactctgaacgcgggctgatttaattaatcatgcgttgacattctgtaacgctctgagtagattgcccgtgcccgcaacaggggccttttttaaacctcacaaaagaagccaatggacacagtatctagtcgctgtccgagcaccgcatccgcgggcatcgggcgccaaacccagaatatgacaggactcgccttccaggtccggtaagctgcgctagagctcgatgctccaccgtaactgcctcaccggtcgcgtgtccggtcccgaggtgtgttatgaccttccaactcattgctttgcccgatgtaagcaccctggctgctgccctgcgcgccaagctgcgccgcgagcccgtaggcttttcacctacccgctcaacctttgcggcaccctcccctcaagcccgcccggcaccgccgttggcgcactggcgtatctgccctgacagcggccaactggtgcagcactgggaccacgccgaccctcaagacccgcagagacccaaggtttccagcctggcgcaagccagcttgatgctcggtctttatgtgagcgctcgcgccgcctgacctggctggaaactgcaactttcttattaataccctggagttctttatgaacaagtccagtagtagcccgctgcgcgcatattaactaacgtgctgttagcgggcactctagaagctatctgaacacattatttaaaccgatcgcgaagtccgcggctcggcatgctttcgctcgcctctatgcaggtaagtaccgggtatgttttgtcgagaattggcgacaggagtacagacaatgagcgccgtaaaaaacccgcctctgcacaagaaaaatggcaccgctaccgacaccaaactgtcgatgcgcgccgcccgtgaagcccagaacggcctggcggctaccctcgccaacgtacgtgccacccaggacggcctgaccgaactggacgcctcggcgcgtctgcaacgcgaaggctacaacgaagtcgcccacgacaagccgccacacgccatcgtccagttcctgcaggcgctgaacaaccctttcatctacgtactgctcaccctgggcggcatcagctttgtcaccgactgctggctgccgatgcaggcaggcgaagaggccgacccgaccaaggtcatcattatcatgaccatggtgctgctcagcagcctgctgcgcttctggcaggagcaccgttcggccaaatccgccgaggcgctcaaagccatggtgcgcaccacggccaccgtgctacgccgcgagcaggtcggtgcccaacctaccctgcgcgaggtgccgatgcgcgagttggtggccggcgatatcgtgcagctgtcggccggtgacatgatccctgccgacatccgcctgatcgaatcccgcgacttgtttatcagccaggccgtactgaccggtgaagccttgccggtggagaagtacgacaccctcggtgatgtcacgcaaaaatccgcctccagcctggccgccgatcagggcaatctgctggacctgccgaacatctgcttcatgggtacgaacgtggtcagcggccgcgccaaggccgtcgtggtcgccaccgggccgcgcacgtattttggctccctggccaagacgattgtcggttcgcgggtgcaaaccgccttcgaccgtggtgtgaacagcgtcagttggttgctgatccgcttcatgctggtgatggtgcccatcgtgttcttcctcaacggtttctccaaaggcgactggggtgatgcctttctgtttgccttggcagtcgccgtcggcctcaccccggaaatgctgccgatgattgtcagcgccaacctggccaagggcgccacggccatggctaaacgcaaagtggtggtcaagcgcctcaatgcgatccagaacttcggctcgatggacgtgctgtgcaccgacaagaccggcaccctgacccaggacaagatcatcctcgagcatcacgtcaacgccttcggccagcgcgatgatgcagtgttgtccctggcgtggctgaacagctttcaccagagcggcatgaagaacctgatggaccaggccgttgtgcagtttgcgcaacagaaccccaagtttcaggtgccatttgcctacagcaaggtcgatgaattgccgttcgactttgtacgccgtcgcctgtccatcgtggtcaaggacgctgccggtgatcatctattggtgtgcaagggcgccgtggaagagatgttgagcatttccacccacaccctggaagacggcgccgccgtgcccctggatgatcgccgccgtcaggagctgctcgcactggctaatgactacaacgaagacggttttcgcgtgctggtggtggcgactcgtaatattcccaaggcattggcacgccagcagtacaccaccaccgatgaacgcaacctggtgatccagggcttcctgaccttcctggatccaccgaaggaaaccgcaggcccggcgattgccgcactgcaacaaattggcgtggcagtcaaggtgttgaccggcgacaacgccgtggtcaccagcaagatctgccgtcaggtcggcctggaaccaggcgagccgctgctgggtgtggaaatcgaagcgatggacgacgccaccctgctgcgccgcgtggaagaacgcacggtgttcgccaagctcacgccgctgcaaaagtcgcgggtactcaaggcgctgcaagccaacggccacaccgtcggcttcctcggcgacggtatcaacgatgcgccggcgctgcgggatgccgacgtgggtatctcggtggacagcggtacggatatcgccaaggaatcagccgacatcatcctgctggaaaagagcctgatggtgctggaagaaggcgtactcaagggccgcgagaccttcggcaatatcatgaagtacctgaacatgacggccagctccaacttcggcaatgtgttctcggtgctggtagccagtgcgttcattccattcatgccgatgctggcgatccacctgctgctgcaaaacctgatgtacgacatctcccagctggccctgccgtgggacaagatggacaaggaatacctggccaagccgcgcaagtgggatgcgaaaaacatcggccgcttcatgatctggatcggacctacctcctcgatcttcgacatcaccaccttcgcgctgatgtggtacgtgttcgcggccaacagtgtggaaatgcagaccctgttccagtccggctggtttatcgaggggctgctctcgcaaaccctggtggtgcatatgctgcgcacccgcaagatcccgttcttccagagcacggctgcctggccggtgctgatgatgacctgcatcgtcatcgccctgggtatctatgtgccgttctcgccactgggcaccctggtaggcctgcaaccgctgccgatggcgtatttcccatggctggtgggcaccctgctggcgtactgctgcgtggcccaactgatgaagacgatctacatccgccgcttcaagcagtggtactgatcaccccgccgttcaaacggtggcggtcgcccggccgtcaccgtgcaatacaaggatgctccctatgcgcgtcttgatctgtgcaggtcgtcattacgccgacaccaagaagtcccgccatgtgctggacgcttaccaccgcctgcgcccggtgcaggtattgattcacggcggcaaccagttcctcggcagcgagatcgaggaatgggcgcgggacatcggcatcgacgtggtgcgttacccatccaattggcaacgccacggcaaacaggcggaacgccagcgcaaccacttcatgctggccgacagccgccccgacgtgatcatcgccctgcccggtggcgacgacaccttggagctggtgtcccaggccaaagcccgcggcatttcggtgctgactgtagaaagctgaattcaaacgaggtgcatcatgcacaaacaacacaccccaaagcggcaggacggctttgccaaataccgtgcgcgccactatcgcggtgcccgccacaccttgctgttgttgccaccggccaagcgccgtgcattgcagcgcaacctgatttttatcggcgtgagcctgggcgcggtgttgctcatcgcgctgttttccaaggcccatgccgccggcggtgcttatgtggtcgatgacggcgccgtcaatgccccgggagaatgcaatgtcgatgcctggtacagcgccaatcgacacgcgggcagcacccataacaccactctgtcgccggcgtgtacgttcagcgccatgcccaccgtgcaatggggcgccgtgttgtctcgcgctaccaccgcaggcaaaggcgagacgcagatcagcccgcaggtaaaggcgcaggtgttgtcacgggaagacgtggggcttgagctggcgattgccgccggggcgcatatggccctggatcgccagcacgggtttgacggggccgatttgaatgtcccgttgacctggcagcctctggcgccattgcgcctgaacctgaacgttggctggtgccacgcctataacgacggtgatcaacagcatcgcctgacctggggcacggggttcgaatatcagttggcggagggactgaccctgatcgccgaacgctacggccaggaaggcggtgagcaagcgtggcaggccgggccgcgattccacatcctcaaactgttcgatgtggacgtggtggtcgggcgcagcctgattggggaacgcgcccagtggctgaccactggggcgacgctgaggttctaggcttttgcctgctgttccaggtgcagctgcaactgcggatcgatttgcagctgcccggccagatcgtcgaggtaattgcgctcggcgtcctgctgatcattgaccagcatcacgctggccaggtaaatctccgcggcgagcgccgggtcatgggcatactcggcaaaatccgaggcatccaggggcttggcgacttcagcgtcgagccactgctgcaactgggggtcgtcggtatgacggccgatctcggcagagatcatctgctgctcttgcgcatcgatagccccatcggccttggccgccgcgatcagcgcacgtaatacgccatggctatgggcttcggcttgcgccccttcaagctggtcaacggtctggatggcctgctgtggggctgtggcctgctggcgttgccaggcttgataggcctggaaagccgccatccccagggacgccagcgccgcgtaattcatcccgccgcttttacgcgcctgagtgccgccgccggccggtgcaccgcccaacaagccacccaggccacccagcaacccacccaagccaccgccagctgcagcaccaccggcactggtgcccttcaataaaccaccgagcaacccgcccaggccgccgcccgaagcgccgccgccttgctgccctgcacgcaacagttgttccaacagatcgctggtattcatggtgtcgccctccccggacgcaaaagtggcgttaatcaaacatagtccgcctgcgatggaacaccatgaccgccgggcgggcaagctttatgatggcgccactacaccgccaagggagaaaatatcggtgaaccgcatcgagcagatcgcgctgatggccaactacaaccagtggatgaaccgcaaggtctatgacgccgccggcacgttgaccgacgcgcaattaatcctggaccggcaggcgttcttcggctcgatcctcggcaccttgaaccacctgatgctgggcgacacggtctggctcaagcgctttgccgagcacccggctgacttttcggcactggcgccgttgagtgccatcgctacccccgccgacctcaaacaactggcctttgccgatctaagtgaactctcggcccatcgcgcctggctggaccaactgatcgtcgagtgggcccacagcctgcacgagtcccatctggaccagcatctgcgttaccacaacatgcgcggtgcggccgccgaaaaaacccttcttcgggctgctggtgcatttcttcaaccaccagacccaccaccgggggcaggtgacaacactgctgacccaggcgggggtggacgtaggtactaccgacctgctggcgctgattgactgagcgcggcgtagcttgccctaatgccgatcagtcaggcttgtgagtacacacccgcaacggcccgaaacggccaggtcacttcaccttgttgctcaacgtctcaacgctgcgtttcagatcatccaggctgcgtttaaggccgtcgatctcgcctttctgccggtctatggtatttttctgctcatccactgtgcgcttgagactcgacagctgactgtcactgctgcttgaactcgacccgtccttacgcttgaactcgtcaaatgctcgatcctgaccatccactttggttttcaggctttgcagctcgctttcgctacgcttttgcgccgcttgcaacgcctcgatatcgccgacggaaatactcgacgacttcagcacataggtattgcccgcctctaccgaggcgcccgtcaatctgtctgtcgacgatgcactgaactctccccaacgcaccgcacccgccgcctgcgcctggccgaccatggccacacccaacaagcccgctacaccaaaagccatcatccaagaatgcttacggacactgagcatcaattgattcctttgcaatttgccgggatggcatatcgctatgactgtcatttatgaggcttgttcctgcgccgcataaattcatcaggacttaactcggcgaacatgtagatgactgatctgccacgctttttcacgcatatctttgtgcaggaaagcgcgtttcgaggttgcgccgaagcgacaggatctatatattcccaaccctgctacaccgcgctaccgcccgaatggcgaaactggtagacgcatgggacttaaaatcccccgctcgtaagggcgtcccggttcgattccgggttcgggcaccatagatatcaagggcttgccagggaaacctgagcaggcccttatcttttccgctccgcaattttagaagccgctccgcaattcccttcctccggcgtcctgccgaccgatctcccaactcaataatttgcctgctacgctgttcgctccacggaggaacaacgatgccgaactcagacctaatcccttccctgctttccaaactctacgaaaaccaacttgccctcgaagcgtccatcctggagctgtcaaattgggttgagcaacgtggctccgccgaggtggcagacaatgtgcgaggcgcccttttcacaatcggccacaatgaagaattcatcaaaatgtcgctggctgtccttatgacggaggaatgagcactacttgcaggccaccgtccagagttggtccagcttagtggtatagctctggctcatcatctctcgacgcataccccagtcggggttggtaggtacgctggcagatcgaagcgttccctttccccaacgttcattgatctgatcaaggacagtcatgacctgggttgcctcggtcggctgcgatattgcaaaaagatcatcggtgtattcgcctggctggcacaggttgagcagcattacctcggccttgctgtatttgaaacccggccggaaaattctgtcgagcgcatcgacggcggctttcgtgagcaagcgcacgtcatcggtggggtacggcatatcgaccaccacgccgttggcatacttcccctcctcggggttgaacatgcctgtgcggatgcagacgcggacctttttacaaagtgagttttgggcgcgaagcttttctgaggcgcgcatcatgtaggtggccaccgcctccttgatcggcggcagatcggtcagccgtttgccgaacatccggctgcagcatatttcttgcttgggcgggtcgggctcgtcaagttccagacacgatgtgccggccagctcccgcgccgtcttttcgatcactacgctgaatttcttacggagcgtccgaggatctgccctggccaggtccatcgctgactttatgcccatggcgtcgaagtggagcttcattttgcggcctacgccccacacttcgcagatgtcagtattacgcaggacccaatcgcgcttgaccggatcggtgatgttcaccacaccaccggtttgagcttgcaatcgctttgccgtgtggttggccagcttggccaaggtcttggtgctcgctattccaactcccaccggtatgctagtgcagcgcaatacccgcgcccggatctgacgccccaaagcatccagctcggaaatacccgacaggtcagcaaacgcctcatcgatactgtaaatctcaacggcaggaaccatcgattcgatcagggtcatcactcgctcgctcatgtcgccatagagcgcgtagttggatgagaaaggaacgatcccatgctgtttcagcttatgtttgatttggaaatacggctcgcccatcttgatgaaaggcttggcgtcgtaactccgggcaatgacgcaaccgtcgttattgctcaacaccacaatgggcacctttgccagatccggacggaagacacgctcgcaacttgcatagaagctattgcagtcaatcagtgcgaagacctgcgcgttagacatgactgcgcaccgtgcttgtgatcacaccccagatcgatagctcgtcaccctccaatacataccgcgctgggtatttcggattttcagataagagaatcacctctttgccgcgcttgcacaggcgcttgcagacaggatcgttgttcaaaagagctacaacgacgtgtccgtgggccggctcaattgaccgatccacaactgccaggtctccctcaaaaatccccgcaccctgcatactttcgccagtaatcgcgatcagatagacgtgtggcgccctgatatttaggacctcatccaatgagatgtgctgctcgatgtgatcggctgccggtgatgggaacccagcaggtacacgaaacgagcagaaaggcagcttcgtgccgccctcggatataggacctaaaatggtaaagctcatgatgcagtcttctacaaacactgtacgaatgtacagttaactttgcagccggcttgcggtcaatttttctgtagggatttcgacagacggagcggtgcctatgtgcgcaaggctttcacaatgtagcgacatggtgctgcatcagggcgagccaaccgaggtattcgagtggttcaaggtcaatacggccgtgggcaacgtgatatctttctgacacgccggtttttattgacggatggggtgggaataaaaatcccgaaaatcaggcgagttcgggttttcgactggtcatggcgatagtgcgaaaatgattaggggccgcggccgcctcccaaaaaaacagccctactgcgattgaaatggaaaagtgataatgagtaacttatatcgtagcctgctaatgaataaaacagcctcagcgccaataaaatatttagtaggcctttcagccttattcataagcagtttaatgtatgcgaacgccagcgcatcgttgactgatgacaacctcgatatgtacgacgccccaaaactcatagagcagggaaagtacaacgaggcaagaaccctactactaagagaagaaaaaaccataaccgatattagcaaactatgctctatctacagctcaatgctaggcctggcctcaataagcgacaataaggaagaaggagcaaaatacgctagcttatttcaaaaatgctataaagaaaacagtaacccttatgcttttcttggtgccacgaccctctactttaaaggagagcacgaaaaagcaataggcattatggacaaactcttagtcaagataaaccatgagctttccgaagggaaacaatcagaattccaagtttttgcggacaagaatttaatctctgccatttataggcttaaagcctccgacctcctgagccgccaagacccacaaaaagtaaaacctatgattatttcgttcgcggaaaaatcttacgaagccacaccatttggtgaagctgaagctttcttagctgccatctataaactgtatggcgatactcagcgttcaaaatcaattatagaaaaaagtgacggaagaactactgaggcacacactgttgacgtaatattaaactcgatcaagcagaaaacaaataatgcttcagtctcgccttaggacggttgaccaagcaggtatcaactgaaacccacacgtgccgctcttacccgatccgctgccgccgctctgctagcacagcccgaaccttaactgccaagctgtcggatgtcttgagcccggcggctgcccaaggccgcacctccacccgtacagtgcgtaccgccggttcgctcccgcaatagctgatggctgccgcgcagtcgggctggacccctcttgccggtggtttgtgtaacgctatcagttctttggcttctgggagatcccaatgcccatgaagacaataccagggatccagaaaccggggatcgaggtggcagggcctacggctagcagtgacgcgcccacaatgaacattggtcgtttgattgtgttgtccataactcacaccctccattaagaattcccaccatttaaccatgagtcagccgctatgaccctaagtcgggggctatgggcaaaaatccccgaggctatcccgcgcaatttgaacagcatattcaagcaattcaaggggaacacttggctcaaatagggtgacctcgaaacgcagcgtttcgtcattccggaagatctcgaacatctgagccctctggccttcccagcactctaaagccaagccgtcatgacctatgacgacgcttgaagcacggcaaaaacggtattcaataccatgtacgaccacatctcacctccatttctaaggaggcaacgatacctctgcgctcgatgaatttgatagccgctatagcggcaaggacgaagtcatgcctgaagaaaacacaatccccgacgaaacctggtcagtcaatgaagagctggtcaattgcgacagttttgatgagctactggccgagaacgacgaccttgaagtcggggcaaccgtttggaagggagagagattcccggtagaccgacctccagaaacgcaaaagccccgcattcgcggggctttcgtgtaaatcttggcggaaaaccagggattcgaatcctgggaacgctattaacgttcgccggttttcaagaccgctatgcaaatccaagcaggcaagggctttaaaggcctgcggggttccattactaaggaaaagtgatcgggctacagaccgcattctacaaggggtgcggctttagttttggaactctttttcacccctctccggcgtcctgccgaccgcaaatcccccctcaaggcgaccactgctaagctgtgcactccaccagaggaactccgatgcccaactcagaccttctcccctccctactctccaagctctacgaaaaccagctggccctcgaggcttccatcatggagttatcgaactgggtggagcagcgtggctccgcggatgtggccgagaatattcgcggcgcgctgcacaccatcgacgagaacgaagagttcatcaagctgactctagcagtcctcatgtcgcccgactgatcgtcgggtaaccctgcagttcgtcgcttcaaaccttccacctgaccaaatccagattactgtacgcacatacagcatctgagattcatgctatgaacgttgacatggacaccgatgattggctcggctgccccactccactggagatgtaccagcaccagtgctcacttctcgtagaagaactggtcgagaccgaacgcatgctgcgcagagctcgagccaatatcgccgggctggtgcaaatgaatgacctgctcatgacaggaaaggccgaggccgaaggaaagcttgccgatgcgctggaaaagataagtatgctggaacaccagcagtcgtttggctcggtgcaaagcgtgaagattgttaccgagcagagggactatctgttcagggaaaatcagcggctgctggcagagctaaaagcactgcatgaacttcacccaagctcatccgcgtaggctgctacggcttcctcggtaagctcccgccactcgttatcatcaattaggccctgctgcttcaagtcatccgccagggccagccgcgtttcgtagcgttcctcaggagtgaccgatatgaatgcgggatcattgcgtagcgcaaaccacgcctccattgcggtgacttgttcaatgttgatcgccatgacgaatgcctcgagccagtgtctacagtgtagagattggccggggaccggctgttcattagcgccgacgagcggagatgcttatgtgcggacgactatcacagtacagcggtatccacgacttcgttgcggcgctgagcatgcccaacgctctggcgaactctgtgggcgatcaaccaattgaacggtataacgtggcaccgacaacagcggttgcgctgctacacctgcagggcgatcttctacacgccgacccggtgcgctggggatggcgaccgcactgggccaaggatcacgctgctccgatcaacgcccgcgtcgagaaagtcgcccacggcccgttcttccgggcgatctggcctcaccgtgcaataacgccgatcaataactggtttgaatgggtcgacgaaggcggaccgaagaagcagccttacctcatccgccggcgggatagtgcaccgatattctgtgctgccatcggccagctacctgatgcagacgaaggcccgggtgagcatgacggcttcgtcatcatcacagccgacagcgccgggggcatggtggacattcacgaccggcggcccgtggtgctgacgccagacctggcccgggaatggttggatccagccacacccatggagcgagccgagcaaatggtgcttcaccagggtgaaccgtccgaggtgttcgagtggttcaaggtcgatacggccgtggataatgcacggaacaagggaccagagctgatccagtctactagccgaaacgggtacaaaatttagtggatcagttccttagctttctcaagacattccgtcgcactatcgagagcctccacagcttttgcagaatctgcgttgccgttttgactacgctccccggtgatgacaaacaatatgtctacgccggctttcgcgactgcagctaaataatctgcccgaggaacacgaatgccgctttcgtagcgcccctgcgcatttacctcaattccgccgatgctaccaacagcagattgtgacaaccctaacctcaatcgctctgacttcaatctcgcgccaaggctcataatacctatccaaatgagtggatgtagtatttcagaggcaaagggcattcaataagttcagtcatcaggtgagacgggttaagcgccaaaaaaaacatcacccctatgaccgcaaccacccatcccagggtaagcagaaatgaaagacctgcaagccgcttgtccatagtgctctgtccatatccaaaaatgacctccatacgaaagcatgtctggagagtcctgctatgtgctgtgcttgtactgctcgcctatagcatggcacgtcccggacgtcccgcagccaaaactggtgagccgtacgtagcgagcgcacacaatattatttagcgcgcaattatttagcacgtctatcattccaatacatttttttgcataccgcgttttaggtatatgcctgcaagctgcagctggaagtcagtgtgccgcatgaaaatgctgccttcgttcatgatccttgaaatgacgtggaaaagccacgctactaaatccggccctcggaggcctaaatgaaattaagatccttaagtatcgcgcgacgagctttcgtctgttttggcttaatcaccctcctactgatcagcttggcaggcttctcttatctgcaaattgatcggctgcgcgctgcagaacaggacattgagcaaaactccctcccaagcattcaggtcattgacgatattcagatcgccctccttcacgcccgccttgaaagtatccgcatgctctcaagcaccacggcagaggtgcatgatttctcgctgtcaaaggtcgaagaagctatacagacacttcaggtgaaaactgatttctatcgtgcacatttgatgtctggagagcaggacgaaatccagtttgcgaaggcgaatcaggctatgggtgcttacgtcgacggcctcaaaaaagtaatcgctttgtattcatctgatcatgatcaggctgtgaattttgccaacacagagcaggcacaaagagctacggcttatcaagagcagctgacactactgcgagagcaaaatgcacgccaggccgtggtgtctggagtagacgcgaccgacgtatataaccatagtgtaaaagtcctggtagcagtgctgattgttgcatttgtgttaaccatagcactggcgatcttgttcactaggagcatcgtaagtccaatcagttcatcacttaaattggcggaaaatatcgctgctggcgaccttacccatgatcttgatataacaggttcagatgaagcttcgcgattgatgcatgcgctgaatcttatgcagaaaaatttgcgacgcacaattttagaaatctcgggagcttcaacccagctaagtaccgcggccgtcgaaatgacttcgatcactgaaagcgctgatcgcacacttcagcagcaaaatagcgaaatcgagcaagctgctaccgcagtaactgaaatgagcgcggctgttgaagaggttgcacggaacgccaattccacatctgaagcagcgatgcaatcaagcatatctgcagatctcgggaatcaaaaagtcactgagaccttgacagcgatgcgcggcctgacaggcttggtagaggtatcatcagatcaggtgaaagaactcgcgggccaggctcaagacattactaaagttttgagcgtgatcagggcgattgctgagcaaaccaacctactcgctttgaacgccgcgatagaagcggctcgtgcaggagaacagggtcgcggtttcgcagtagtcgcagacgaagttcgtgcgctggcacaccgaacacaaacatcgacgcaagaaattgaacagatgatatccacgattcaagccggctcttctgccgcggttgaatctatgcaaaagagcacatccgaggtctacagcacgcgagatactgcagaacaagcgggccagtcgctgcggcaaattattaattccgtgctcgaaattaacgatcggaatatccaaattgcaaccgcatccgaggaacaagctcatgtcgcgcgggatgttgatcgtagtctgataagcatccgcgaccttgcagtgcagagtagtgaaggcacccgccagacacttacagcgagcaacgagctttctcgcttggccgttaacctaaacgatttggttcttcgattcaggacgtagtaaatcggccaaacgcaattttcggctgatcgtaggatctcagacgccaacgcggcgcgcccaattaaaaacgcacaggtggaatatgaataggcctgaaatcagcttgcactctgttctgaatttaaacgagcgttcagcgttggctgagatggaagctatcactagtattttaaaacttgtaacacgccttactggaatgcgatttgccgggatcgcgaagttcaccgaaacagactggatcgtctgctcagcttacgacccgatgcatatggggatagaggcaggtgacacactagagctggaaatcacgctttgcagcgagctccgcagagatcctaaggcgctttttattcctaaaatcagtgaagacggtagatactcgagtcgtgcggtggttaaacggtatgcgatagaaagctatgcaggtgttcccatcttccttcctgatgggcagctatatggtgctctatgcgccctagattcgcgctcgatattatttgaagacccggagttggaagagacgttagctttatttgcaacgttgatcggatgcgtttttttcacgatcccgctgctgaatgaatccgaatgatatgccttatctcacattcggatttttgagtttcaatgcgagtggttgatagctcggacgtaatcttggcatgctcgtaacgctatcaatccgttatcaccttcatcagttatggcgataattcgttgagcatgcgctgggtcaagttgggctcgacgggccgcatgaaccacgccgacggcgccggtggtggtaggcacgttgcagctactggctggatcctcggcaaggaggactgacagccgcacatcagcagtagcaagctggtcacgcaggcgagcttggttgcgttgagcatcggagagttccttggaatgttgttggtcctggcctgcgagctgctgctccaaggccaggcgcttgtcctgctcggcctgggcctgggcggaagccttattgctgatcgcggccagctccttctcaaactgcccggcctgctcagccagcttttcgcccattcgccaatcctgaacctgccacgccccgccgaacccgatggccagcgctagcaggatcgcgccaaggatctgcccgggcgtcattacggcacgtccttaaagaagacgtggtgaccgaggcgcagcgtctgtgtggccttcgccgcccaggccggggccctgggcattgtggttgcgtagtagtgcgtggcgccgtcggttggatccgctaccgcgccagacatcaccaggtcagcagcgcgttggacctgggcgaactgcgcggccgggatctgcttggcaccgctcaggtatgcgtagttcgggtcgttctggttccagcaactgaactgccacggcttcaggcacacaccagcgtagccctccccccaccatgatttggctttgccgtcgaatacacggttgcggatggtccaggccacggcgatctggcctgccaatccttcgccgcgggcctcgccccacagcgtgcgcgccaggatgtctcggtctttttcggtagtggtcatgcttttctccaggcgaaaaaaacccgctcaaggcgggcatcggtcagctaacggcaatcacgccggggcacttggccactcgatagcgtccgggtactgctcctgttcggggactcggttcagcgcaacgcggtatttcttccagcctttgagcaggacaacctctgcatccgtggcctcgtcgccatccaccgcatcttgtaggggcgcaacggcgtaatccgcgatggcccgcagacgctgaatctcggcctgagcaacgcccagtggattggtcgtgatcggcggcgtcgggggtatatcttcgtgtggcagatctggcactaaaatgtgcagtgtgatcatcgtgttcaggtcgtagggctcaccatccattgtgaccgtgacagtcaatagaccatcactgaaaacgacatccacctgggcagtattctccgatgggtgtaacgagtatccccacccctgatccactggcggaaatgggaccatcccttcggtgccggtgacgcaatacacgcccacgctttctcggtaactgtcgacgtccttgccgcccagcgacgtgatatcaaacaaagcacctgtctggcccacgatattgattgctgctcttgccatagtcatatcgccttcaaagtgccgtcttgggcacgagtggtattgccggtgtgatacaactcaatttcaggagtgaagcccccgttgtagatcgatcgcagcttgatagtgccagtgttgcccgcaacgccatacggccaggcaatcatcagccggttaccagtggtgccaaactgaatggtttgacggtagtaaagccccgtgcctccttgagggtttccagcaaaatcagccgatgcgaaaactttattatcgatgccggggttgacctcagccgtccatgacacagttgactgactgccgacgaagccaatcatttccgttgtcggtacattacctggcgcccggcccgtgtttagtggtgccaccgtacccaaaccaagtcccgttcttgcggctgcctgagttgtggcgccagtgccgccctttgcaactggcaccacgttctcggttgaaacggtgcccaggccggccagcgtagagccccactgctgaaccatcagattaaccgcatcagccaaagcctttgggtagccattaacaggcacgatgccgtaggcggcgcctgcggaggtggcgccacgatatgcaggcgagatcgagatggatgtgtcgctcgaaggattgatcacctgatagatgccgttatctggaccgacaaacatgtcgccggatcggcagttagaaaactttgtaccgacaccagttacaacggcgttgccgttcgtaacggtaacggtcccttctgaaaaccaagaagccatgtttttctccaatcaaaatttataacagaaggattaacctcaagagtcacgcttgcattttcgcgaacacagcaggtatataaagagtgttttgtggtgttacccctatagtaatcgcccataaccgattcgcggggaaatcccaccaacaatacaaagctgaagcccgaaatgaactaccggcgacatccatgccgaagttattaatcagcatgtactcattactagagaagacaaaaggaacactaaaataaaccatagtctggccttgcgcgtcacttcctgatgtcacgtaactccaagaggccaaagatttgctgaacactgcgctgggagttcctgtgtcaaaaatcaaagactcattctgatcataaagtcggcctccccatagagctgtagggcttgctgagaatgctgctgcaaagtagttacccctgggctgagccgtgttcacgtcatatgctcgaacgtaaaagcctgtccagttgcccggcgacccaagtatgaggaccctacagagaccagcaattattccaacattgtcaggtttgacaaataccaacggtggttcttgagtggttataaccctctcaaagtttgtcgaagagccaagaccagactcttgtgtagggacaaaacgccctttagagagaattgaaagacgcgcatattcagaatcgagaataacgacatcgtcattattcttgaactcaaacccccagctcattatttgtacctcgacactataaggcgctgggtcccagtcccaaaccgtccatcaacagcggtcctgtgccccctccacaccctgatttggtccgtaagtatttcaggttcgtattgaactactgtgtgtaacccggttgtatatggcccaatcggcacaacgatagcgatgcagtttagtggggtcacccctggcacagagaagacctgcgcagcgccggcgccagtgaccggaccagagaaggtgaccagcgttgagaaaacggtgcggagcgtgaaagatgcggggccaagttgctgaaccccgttctcgtcccaggtagccagcccatattcagccatcagttaatcctcccgaacttgcctcgacgcttctcgttcgcatcgaaaaccgagataccgctgttatcgaacaagctcgaaccgtcggtgccttcgccacgcacagtcaccgtgcccgccggaatgttgatttccagcagtggacggcctttcgagtccaccgtcggcgaacgaagcaccatgcccaagatgatttcctggatgatcgccttgctgatgatcgcggtgttgaatacggcctggccgttctcaaggacgaacatcggatcaacctttccgtccacctcgttcaccactgcaaagcgctgagcgaagatcagaaattccgattgctctccgttcgaaccaaaggccagaccagacaccaccctcctaccatccacgatggtctgagccttcatggtggtctgtgccgaaaccttgccgtcgagccgtaccactgtctcgctcaccgtttgaaccgacgcgcttgtctgtccgatgctcgactgcagcgtttccgaaaccttggcctgggcctcgatttcagatgcacgtacctttttctcggtgctgattgccgcggtggactcccacgccttgatcgccccagccagatcaccagagccatcgtcaccacgcacggaagcccgcagcgcctcattgctagacgcctgagaggtgatcttcccgtccaggttggtgacttttgtatcgaggctggtgagcgcctgggcggtaccgttcgccttttgatcgaccgcagacagatcgctgtttagtttggtgatctgtgctgcggacgtctcgcggttcgatgcaacaacctgttccagtacattcagcgacgacttgttgtcgccgacctgcgcgcccagggtaagcagctgctgagccatcgcatcgttttcgctggcacgggttttacgctcgaccgccatatctgccgtcgaagtccagcccttgattgcatcagccaggtcgccggcgccgtcatcaccacgagcagctgagcgcaacgcctcaactgaggtggcggtggccaacaccttgccgtcgatttcctcaatcttcgtttcgatgatctgcacctgggaaaccagtgcatcagtggtctcaaggatggtaccgatatcgatccagtacgtgacgtcgggcggtgttgctcccacaggcacagggcctttcgcttggtagagacgctgatccaaacgcacgatgtcgcccttcagatagggctttgccggatcgtaagctagcgcatcgcttacctgcttaatcagatcctccagttcctgcttggcttcctcgaggcgttcatttactgagcctggcccatcccctgtaatcagctcgatctcttctcgcaagctctggtacagggcgcccttgccgatcttctcggcgtagtacgcctcataatcgctctgcttggtgctggcctggccgttgacggcgccgggcacagggaagaacggacctacgttgcccgtccggtcgaccaggcgcgcccagaagaacagactcgcccccgccaacaggctgtgcatttcgtgcgaggcctgcgggtagctgaagtcgctcagtttgaccgccgtcgtcaagtcgggcgactcgctgtaccagagctccgtccgctgggtgtcctcggcacctggtgggaatccccactggatgccgatgccataaatcaggctggtggtggtcaggaacgacaccgccggcggcaggccggttttgccttccaggttggtcaggttggagcttttccagatcgacgagatttcgaaggcgcttaccgaccgcacccgggccaggtacgcacccgagtagatcccggtgacgtccacgctcgttgagcctgtgcgctgtaccttgatccagttgccgttgtccttacgccactccacctcataagcgacggcaccagttacggcaggccacgagatgttcatggtgctgatggcaataccctggctaaccgcgtagctcgacgtcagcgtgacactgggcggcgccggtaccacggtgatcgggataacgctgatcgggcgatcttccaggcgagcgcctgtgtcgatgtgcgcaaacttgctcggatcgtactgaacagccgatatttcgaagaccccaggctctggccgggccacgctgaccacccggtatagtgggacggccaagtcgtcagtatccaatgcccagaccagttccggctcaggcgtcacggagtaagccacggtaaccgtaacctgccggccactgaccagttgcacggtgcgcccctcgcacttaccgtcaggcaggttgaggatcagtcggtcgccgggcttggcctgggtgtcgcggtccagcttgatgaccttgccgtttaccgctgagatacgcccgccaatggcacggccggccagcagttcgtcagcaatcgggatcacgtagccaggcagtgggatacggccatccaaaccaaccttgaaggttacggcccgatccttggagttggtcagcagcgcccacttaccgcggcgctgggcctccgattcgcgagtgcagccgatagcgctgatctccagcgggttgtcgccgtagcgccgctgtagcttctgatcggtgacagccgtgacgtcggtgtcgtagttgttcagcgggttgtcgtagctgaccagtgcacgggtgtagcgggtgcgctcagacgcgctcgagtaggtgaacttgccgtcgatgacgtttgcccgggtgtaggcaaagtcgaagtccgttgcgcgcggcatatccgagagagtgaacacctggccctgggcccagtacgtcatacctcggtagatcgccgaaatatcgcgcagcagtgaccaggcatcagctttgctctgcaggttcaagttgcagatgaagcgcggttcctggccaccctttccgtccggcaccagttggtcgcagtattgcgagattcggtacagctcccacttgtctaccatccacggcttgatgcgccggccaaggccgaatcggtcagcggtggttatgtcgtaggtcatccagacagggttgtcggtccaggcctgcttaaaggtgccgtcccaaacgccactgtacgagcgcgacacagggtcgtagttgctcggaacctgcatctttttcagcttcgtttcgaccgtcacggccgggatgctgcggaactgctcggcggagaactcgatgtagagcagcgccgtgtttgggtagcgaatcttcgcgtcgatcacctcggtaaatccggcgatctgcatggtgtccgagattttgttgttgttctggttgggggtgatgcgggtgatgcgcatcagccatccggccgtggctttgggtaagtcgatacggcgcgtgcgctcgtacacgctggtggtcttgccatcgacagcttcgctcagcaccggctgataggcgcccccatcagtggccagttcaaccttgtattcgatccgatacccgttgatgttgcccccgccgtcaacggactggagcgcaggccaggcgaagcgtacgcgcacagcggaaagctgggtgttgttgatcgccctaacccatggggtgccgctgcgcagctcggtgctgatggtggtctcgttctctactgatgggatgccctgaatataggtctggtccacggccccggtgcgccactcccacttcacgttcgggaagttcatgttgccctgggggtcttgcaatggagtgttgtcgaggtagatgtccctggctgtcggcgttccttcgaattcaccctcgcccacggcgatcagcatttttgcaatggcaaccgagcgcagactgtccggggcttccgtcggcgtttttggtttctcttcgccgcccttggcgccgtggatatcgatcttgcgtgctgcgcccatgctttcctccaggcgaaaaaaaacccgctcttggcgggcatcccgatttacttagacgctatgcaacgtccagccctaaagtgagctgcagctgatcgcgccaataccccacttcatgaataagccctggttttctccagcggaacttggctagctccttgccgctgagactggcgaccttttgggcgtcgctcagcgtcttgcatgcccgctcaaattgttgcttctcgttgagctctccacgcaacaatgcatcaatgtgtagatcgcaccagacggagaagtccggagagatccagcgagcgaaagcgacggcgagcttcgggtgcagccaggtaccaccccccttgccacgatggcctcgaactaaatccctcggattcgaggtattaagatgtttcgctagcgcctctatgtatgccttggtttcctggttcctcaaccagttatccaatcgcaagccattactagcggcaatttctgtcgcatggatccagccctcgctgttaaagcggatggctcggccttgataattgaatggaatgacgttgttcattcactgctccttccgcctgggaaagatgtgcaggcagaggcgtaggcggagcgaaaccgacccttttcggtagcgaacctagcctgcacggggttatcccctgggggattcacgggcacaaaaaagccccgagacgcgagaggcgttcgaggctttggcatttcttttggcacaaaaaaaagcgctcaaggcgctttagatacaggtattacaacatagagaaatagtgccattttccccatcataatgtctagctggcggggtgaggtgggtttcagcgaacacaaaaaaagcgccgacctggcgccccgcttactaaaatgtccacaatggctgaaaactaccgaattgatgtcaacttgtcaacgatcaggctttatcctcggcatagatcgccgcactgatgatcgcaccacctacccgtcgcttgccgtagcacagcggaaccgggttgccggatgcagtggtgttcttggcgctgccaaaggcatagccgggtgtattctctggcgctgcgctggtcttgagtccgccagcctgggggctgagcatttggatcacgccgccagcgaaaagggcgatacccgcagggacgactgccatgctcgcaccaccagtaaatggcgaaagcagatagcctgctgcaatgagcactgcacctacgattgtttgcagtaagccagcccgcttgctcccagtgattactggaacaattcgaatatccccattaccaccaaacccaagctcatcctcctgaatattttttgatcctcgaaataccgcaaactccaagcctcgttgtctggccgaactgatgaatcgttcaaggcctgggatttgcacacataatgcctttaccgcctccgccggagtgcgaaccgaaagtctgtattcctttccaaactggcgtagaggtccgccaagccgaattgttgtcaatgaagtcatcaaaatctccagacgaaaaaaaaccgcccgtaggcggtcacattttcaatatttataacgatgtggggcgtagctccaaccaagcgctgctatctcccgacaccctgaacttctgcgtctccccggccttaaactctccagctgattctctaaccgcttggccaatttgagcagcgcacaacccaccaccctcggcgtcaccagacaaaccgtagatatggcgtccctcggtcaggtagaaagttgctgtctctcccgtaccaagcctcgcggcaaccttcccatcgatcaaaattgccgtgtagcatccgccgcctgcaaacacacccttatcacgggttactaccatgacggcagacccagccttcgggtcctgaaaggctttaagtctcgctgctggaactcgatcagcctggctcgatggaatcggggtagtcccacaccccgccagcatcgccatcactaccactgctataactattcgcatatcatccctacggaaaattccaacattatggctaaagcaaaataaccaacgacataaacagccaagcaggcccatagaaatggagctttagcccattcacttaaatgctgtcggcgtgatatcaagattattgtaataggttatgcgacgcctaactgtatctccagctttcagatttacctcacgctccaccaacgtactaccgatggtgaccgcgatgatgtgcgtcccggcctttaacccaaaccgcactacttcacccgcttttatttttgcagctaacttgccatcaatcagaacatcaatacggatgccgccttcaccctcgatcaagcctttgtctcgagtaaccaccaatgacgcttcatcctcgccactatatgcatattgtcgatccgaagatattggttttgcctcctgtgcggtgactggtttcattgaacacccaaccaaaatatctgctaacacaacaaaacatatcagcgtggatagcgctttttgctttacattcagcatcaacgaccccaaagcatgtttacagtgatgttggtgagagatcgaatccctgcatagatacagaaattctacgtcttatcgtctgcccaggcaccaattcaatttctgattcgactagcgctgatccatcacttatagcaagaatatgcgttcctcgagtcaaaccaaatctaccaacttcaccttgaccgaaagttgctgccagcgttccgtctatataaaattttaatttcaaccccccttgattcatcccgctatcacgagtaacgactagttcagaatcacctttctgtgtgaaggcgtaaattcggtttgcgggtatagggtcagccttgtcggctgatattggggtgttttcgcaccccgccagcatcgccaccgctaccgctgctatcaaaatccgcatgtcgctccctttttgatttggcaggcctacaacagttacagctgcttaaatcggaccactatggtggatgcgagcatgtctcctaagcgcttccgtgagccaaagaagataaatatccagtcaacaatgctcagaatgggcgtagtgatgtttcgcatgaaggattgatatagattgcaattaaggtggctgcgctcgtcaattactgacatccccaacagttttttacccacgctttgaccgttgggcattgcgtcggagaacaggtaatacgctgcagcagagccgaaagctgagaccgcgaccacatctggagaaaaaccaagaaactcagccgcgcgtccgacgaaaaatagcataaagacgctaattaacgagtcaatccactgccctccgagccgacgccccagtccggctaggttgtctggcttccggtactcgttttgagtggtactcacttccatgcgtttccgctccaatgttatttgatttgaatattaccagatgcaaaagcccagcgcggggcttggtatgttccgtgcctgttaagaatgatcgggctttgcagcaacgtacccattgacctcgttgtggcaatcaaccgccagatcattcagaaaagggcttatctccggatgctccatcagcccgagcagatttgtagctgaatcacggataggctgccaatcctgatgatcgaatatcaaacggtcgtcacaacggaaagcttcttcagaaaggccatcacatagctgccagaggttttggagaccgcgcactacgtcacatggcaaagcgttgccacaaaccgccaaggtctcgtttaacggtagcattgacatggaccaggcttcgcatgcaggacagtccgggattgtttgtcgctgctcatcagcactcatcgccaagaactccagagccggaaacgcttcacaagcggcgagtacccgtctgtactccccctgcccataccactcccagagtgttgctgcgaaccccatcttaacgctccgaaactgccaccgcagctatcaaaatccgtatgtcgttccctctttggtttggcgggactgtagcactggggaacggatgcaaaaagtccagcgcggggctgggctagtaaacatttacgcctccgcactccagaccgccaactcataaccatccgggtcaatgaagtgaaaccttttgcctccaggaaaggagaaaatctccctacttattgtggcccctgctgcaacaagtcggcgctgagtttcctcgagatcatccccgtaaagaatgactagcgggccacccggtttgacaggctctccagttgcgaatcctccggagagcctgccatcgctgaattcggtgtagctgggcccatagtcgacgaaggtccagccaaatgcagcaccatagaactctttgctacgcgcaatatcgctaacgttgaactcgatattgtcgatctgatgatcttttcctcgaacacccatgactcacctccttgttgtggaagcgtcatcatgaccggatcctggccgtgcatccagtgtggatggaatgccagtaaccgcgcgcgtgttcggcgtagtagcgttgcgtcttcacctatagctaccaaggaaaggacatgccaatcagaagcctcgctaaaaatttacctgcggaccccgacaacaaaggccatgtgcttggctggggcgtacgtcgaacagcgacatggcattttgtcgatattttcgcctcaaaagacgcagcggatgctgaagtcgagaggctcggagagggttactccgtggacttcgggtctcatgaactgggaaccgacaactatattggcgggctcaccccgccgaattgaaacctgttgcgggctttgcatgaaagctgatgcggccgggccccgcgacctttctcgcggcaagacctggcttaccgtagtagcttcggctgtagccgcctttactctggcacttgccagagaatttcatgcgatcaatttcgatgccgccatccaaaatggcgacctcggcttcagcgccgtaaatagcaccttcggcaacactgaatagatcataaatggtcagcgtgtagcgttgcgaggtttgcatgctctgctccagcggcaatgccgcgtcatgttcgttgttttgcgtctttgtgcctgagaatcaagcgtgtccggtcatgccagggaccgccgtatacgatgatttctgacggcctgccgtacaggtggtgcaacaggaaggggccagggccaaaggcgcctgactcttctccgggcaatgccagatcagcgcccaggaagatcccggcgtggttagggtgaactgtccgtccgacctgcatgacgatcatgtcgccacgccgggggctgtccacacgctcaaaacccgccgcctcgtagtgctgctcataaagactggcgttctccgcactctcccaccagccatcgacgcgctgaaatgcctcgaactcaatcccccactcacgctggtaccactcttcgcatacagcccaacagtcccacacaccatgcacaaatgggcgctttagcagcggcgtgttgccgcccggggtgacaattcgcaggtcgccctcgggccagctcaagatgtgccagggcaaggccgtggtctcgcacatcgccaggtcgcgcgatgacgggcggctggtggcgtccgggtgagaatggacgatgccgatcacctggccctggtcttccgccgcggcgtagtcctctggatcaagccggaactcttcgttcggctccgtggcaatgttccggcacgggaaatacttctgtgcccggcccacggcaaccaatagaccgcagcactctttcgggtactccgccgccgcgtgcgcctggatggccgcaatgatgtgtttgcgcattcttcagctccgggcaatgagtgacacagcgggaaatccaccgaacgagttttcgttgttttcaccgaagcgcagtttgcaggacgataggcagcccttgcattgatcccgggcgggatcggtcgttgggttgtcctcgtcatcaaacatcgctgtccccgtgtaattacagtcagggcctctgtatcccgccgtcatggcccagtggcagaacgtcgtcatttggcggccaggcagcccgtggttatcgatctcgcccggggaggacagctcccagaccaccgcctcactgtcttcgctggttttctggtcgatgtaccagatctccagcgcttcctgagtcggatcagcagttgggttgccctctgggaagttcgctgcatccaggtactgcgccagcgtctcgcgaacagtcagtttgaacttgagcatgtcctcaaaggccaggcacaacgcagtgacgcgaccgttgacattgccggcggcaaaggttggccgagaagcggtgccgtcgctgctcgaggaaatcccctcaatctgcaccggccaggccgcgtactcttggccctgccagataatcgacttggcaggcaggtcttcttccgaatgctcgtaggccagcagttcctccgccgtgtgcgggatggcgtgaccgtggaagcgcaggtaatcggcgccgtattcggtcccgtcaatttcgaacaggcgaatctcgccgccgggctccagtttctggatgtccgtgatcagtgccatgggcggttttctcagggatgaaaggtttgctggaaagtggcggtgatggcgtagacctggccgccacggtgcactggcttgtagccgttgcacttgtagagaccaagctcacccaggggcggctcccacaggaagcccttcgcccctttgtggcggtcgaggaagtccatgatgtccttgatgcgccccttcaaaccggtgaaggtcaccggccaggattgcgaccgattgttgagaccatcctcgaccgactgctcgtaaccatcgccgaactgcttggatcggacgcgctgggtaatatcaccctctgcgcccttctccgttgcccaggtaaatcgttcgattgccatcagcgccccttgattgctttgttgatgacgccgccctggcgcatatccttcgagcgcagctcttgatacttctgctctacgaaagtcgccagctctttaccgaacaggtcgtagccaggtgcgtcagccgtggacgatgcgtttccatcaccatcgatgtgcacctcgacgttgatttgcgttgcgccagccccgccaccgcccatagccatcacgcccagcttgccgctcgacgttcgggtcaacggcatgatcgcctcttccccggcctcgcccatgacaccggttttgccgttggccataccgaacgctgttggcttgcttacgatcgagttggtgaaggcgccgccgtccgcgaacatctgcacaccacccgaccaggccccgccattggcctgggtaacgccagaccagcccgccaaaacatcagggctgtaccctgccgctgtcgagcctgctgacgtggtagccccgccgccaaagtacgagccagcggcagatataccgagccctacaagtgagccgagaagcccgggggctgcttgccgggtagcaatgcgcgccatgtccgcgagaaccgacttcgtgaagtcggcgaacgagaacttaccagtagtggcgaagttgactactgcatcttccatggagctgaacgcattgccgaatagactcttggtctgccctgctacgttctgcgccgaatccaggtagttggcccaggccgatgtcgcgcccttcgtccagtcgccctgcgctgcctccacatccgcataattctgccggatctggtcagtggcggccttgttcgcttctgcgagcgcctgcgacttacgcttgaactcttcctccgacatgttccgcgacggatcggagcgttggttttccagctcaagcgactgctgagcaaaccggtcttgctggctgttcaactgaccgttcaatgcattctggcgatcaccctggccaacgcccaatacggcacgctgcccggcaagctccaaggcacgctgttgctgacccaacgcctgcacgtacgagctaatcgccctctcctgctttgccagacgcccggtctcattggtcgccagcacttcaagctggctgtcagcgtctttctgcgccttgaccatccctgcgcgcgcgtcagtgatcttctggtcaagctggatactttgcgcggccgatgtcgtcttcttggccttagtagcttctagggccgagatctcggcctcgtaggctgccgtcacctggtcacgctcgttccctatcagcgcctggcgacggagcaggtagtcagcttcggagacaagcccggccttctgcgcggcctccagctccttctggtagttcttgtaggtatcggtgattgcggccaggtcgttcttggcgatgttgaagctggtcaggtcgacctggtttgaggcgcctttcgggtctctgttcttgtcctggagtcctttaaccagcgtgtcgtaagcgccaccagagaacttgctgccgtcgtagttgacaccatcgagcagcggcgacttctgaccggttttctcggcactctcatatagcgcccggaactggtcgttgagcttcttcagtcccgcctggcgctttgccagtgggttgacgttatcgagttgcgcgtccagagctttctgagcatctatggccttctggttcgcatcggtgttttcacccgtggcgattgccagattagcgcttgccgtctgtctggccttgagttcagcaagttttttctcaagcgcctcagttgagtcgtcatgctcaccggtgccaagaccaagagccgagttcaaagaactcagcccgttagagatggcccccgcaaacccgccgcccttgcgcgtatccagcactcgctgagtgatctcgatctgctttgctaggtctgggaatatctccgaccggacttcggcgtaagcgcccttgatggcgttcttgatgttgtcccaatcgcgctctacgtcggataacgactcgcggtaggtcttcaggcgcgtcaaggcggcctgattcaaattttcgctgagcacatccagggcacgctggctgtcgccctggtcatccagccccttgatcacctggtactgctcaagggtcagcagcccgtagtggctgctgatcttgcctgccgcttcagtggccgtttcgccggcagtggctaaggactttgcgagttcgccagcgccctgcccggttacttcactcactgccgctgctgcttcagccagattgcgcatctgcgtgccgctggtagctgctccggatgcaagcgaaacgactgcctcgcgcgccccggacaggttgccggtgacgcgcccagcgccgtcggccatatccttcagacttgcaatagtttgcccggcgccattggtgccgccgttgattgcagcgttgaactcacgcgcctgctccatcgcatcgaagtaggcgtagcccagtgacccgattacagcgaccagaaggccggccggaatcaacatgctggccatgctcttcgcggaagcccctgcaccagcacccagttgagcaatggcgcgcgccccgctcccaagatcacctgattgcagggcattgacgagctgcatgacgttttcttgagcttgacgggtgccgagcttcagcttgtcgaatgtgctggccgcctcggtcagccctgcccgatctttaccaatcttggccagggcctcgttataacgctcggcgtcgatctgcccggctttgtgcaggtcgttaagcgccttctcctgagcttccagcttcgccaacttggcggtcactggatcaataccgttgacggtgcgcttcagtgcctcaatttggcgattctctgcctcgatcagcttttgcttctgcgccagttctttggcttccgccttttcaatcttgtcgtaggcctttcccagttgatcctggtacttcgcctgctcctcgatggtgaccaacccacccttgcgagcgcgctccagcaaaccctcagcctgcaccagcgattcaacgctgtcgatgttacccgtcatcgccttgtcgagttggctgatgacgctgatttccgctactgcgctgtcggccgccttgcggcgtgccccggcctgccgatcgctggctgccgtggatttgtcgatgctttgagcaacatccgcttcggccagggaaaccttcttgccggtgttggccaggccttcgccggttttgccgaggtcatcaatggccttctgggcaccttccgccgaatcgaccagcttatccagatcgtcagcggcctttgcggcctgcgacgactcaaccgcaatgcccagggaagcgaagttcgtgctcatttggtttctctctgttccgccatcacctgcaaagcttcagcctccatccgccggaagtcgctgaaaatggtttgtcgctggctgatcggcacgccgcacatccgaatcacaccggagagaacgctgtagtccatgcctgttgcgccgcacgcgcctgtgcgccactgggtactcatggcctcgaagactttgaaggcgtcccagttgtccggccagatgccgacctccgcgacgtaatcgtccgcggtgaagccgaaggcatccgtgccctctagcgttggctcatagagcgcgcgtgcagcgcttaggagtttcccaggcgggcctcattgaaggcttcggcgtaggcattcagcacggccttgggggccgagttgatcgagttgacaaggatgcgtacgttttcaggcgtgaatttttcctcgatatcccaaccgacgacgacatcaagcagctggtcggcctgcagatcaatctgagcagccgtgaatgccttgaggtccatgtccccgacctgcttgctcaactcgtcgtgccgctcgttccagccggtgtacagctcagcgagcgctgtgcggtccagatacttgaactcgaactccaccttctcggcgctgtaaccggcgcgctggatcatcaccggcgccttgaaggtcggcttctggatcaatttgaacttggccatgaacctttcctttacgacgcgtagcgaatgaatttggcgacgactgcaaacaccgcagtgacggtcatgatgttgttcttgttgagggacggcacgttatcgaacgaggcgtaagcgttgtaaacaatgcaaccgccggcagcgagattgaccttgacggcccgcggcttcttgtcgtcatctgcctcaatcagcacgtcgttgtgcggcaagtcggggtcgtctgccagagtcagcgtgaacgagatcgccgacttggtcgtcgggatctgatgctcgtcatcctcttccagaaaggagtaggttgcgttctgctgatcaccaccggacttcgcggattccgtcacttggctgacaggtacccagtccgtaatctttcgaacagatccggcgccgccgcccgcaacatagcgcgctacgttgagcgtatttgccttttcaaggacaaacgcgtcagcggtagcggttttaacgcgcaaaacgcgattgttcagtcgggcccagccagacgtcacctcgacaaaatcgccagccttcaggccgtgagccgccgccgatacggatgcttcgagagcattggtgatcgcggtgacgacaattggattgccgtagccggatgcgaccacgacggtagagccattgggcagaaaaacggccattggtgtttcctctttcagaaatgacaaaacccgcacagaggcgggtttcggagtgtgcccaacgggcggaattaggcggtgtctgctgggtattcgaacgaaaccggcacggtgaaagtcggtggatcggggatgcccgggccagggtcgaccggtgacatcgtgaccacggtgatgccggccttcgtatctctcgcgtaaagcggaaacagcgcggttaactcaaccacaagcgggttcgtcttggtcttgccggtattggccggagccacaatgctgacctggtagacgccgatgaaagcgcgatggtcgccggcaagcgtgctgcttgcggtgtcgcctggtagcaagaacgcccgcagataggtctcgccgtctgccggatcgtactggacgttctcgaacacaatcttgatcggttctgcccgggccttgctccaggcagtcagcttggcctcgtaaatagacgcaatgatggcgtggctcatacctggttgttccttgtggcttcgtcggcgatctgctggaagcgggccagggtgatccggaccattccgccgggggcctgggtggaatggccatattccaaaggaatagagtacggaagattgttaactatataagccgtttgccctgctgtcagagattgaacctgcgctttgagcacggcgatactgacgttgccgctgacatcgatctgatcaagtacgccatccgctggcgtatcaatcgaaaactgccagttcccgcgaaaccgaccgccgacgtagtccttgcctgtcaccaagccgttcacgttgaagttctggtcgcgctcggtcttggtcaggggcttggcgtacttcacaccctttcgcagttttccggctttgctgaagttcgaatcgttgagattgatgatcgtgttgcgcactgcgaccttgaagtcgtagtcgtcggcagtgcgagtgttcgcctggcggtgtgcaacgttggcagcccatatttccgggttacccaccggcgacatgcgaataacgctgctgccaatctcgatgacgatctcgcggatggtcgcgtcgataccacccttcgcgcgctctgcgaagtcgcggatgttctcggcaaagctgccattcatgctcgcatatttgttcgtcacgaccgcacctgcagctcatacaggatcggcgtgcctgccgggttgacctcttttagcgggggaacgattgaccaggtgcggccctgagcgaccaccttgtcgagcaggccgggcacccaggccaatccctgtgcggcgatcttgagcttcttgtcaccctgccggattaggctgttgttttggaattcttgaccggtgaagtcgagcaggatgccctgggcggtttgttcgactgttgccgtcggcgcctcgccgcccagctcagggtcatactcgcccggatccgacttgctgatggtcacgggctggccgaactcagagatcatctccagcgccatcacggccacatcatcgtagaatgccaaatctacctccaacaaattaggatgagccatgacgaatgctatgcgtgcaggactaatccttgatgcactcaatcaatatattttgcagcctgacaaggcgctttatttccgccagatacttaggtctgcgataagaacagcacttgaacaatccccggatgcacggcgaatagctcaagcacagcgtagatgcgccccctcatggggacctacagaaagtccagtcgatgtcgctgccactaggcatttagcatcgatgatcggttcttcgagcgagtggccaaaagatttgtttgaaaacttggacatgggcgaattgcaaggggatttctaagcccgaatggcgaataaaccgcgcgtctgcaaatagtcagcaaattgtgtggcgctcggtcgatccggcgctgccggcagcagccggttgctggtggacgggatcgccgcgtactgccgcgtcaccgcgccctcaacacgatccagcagcacagcccctttgcgcttctccaccgggtcgatatcgtcctgatgaatctctgcaaccagggccatctgaccgtactggatccgcgccggcaggtagttattgggcttgatctcataatccaaccgcacctcccggcgcggccaagccaggccctgctcgccgctggtcttgcgacccttccaggtcatgccatccatcgccagcgcagcccgccgcaacagcgcttcctgcgcaggtacatcagcagggatgaccacgccgaacttcacggcgtatcgggccaggtcctcggcgctcgcgtagctttcggcgtcaggcttgccggtaccgtcctcgatgatgagtgtcatgcgtcaactcgttggaatggtttgaaggttggccgcagggtcaccggcagccatcagtatcactcgctggacaggtcagctacgagcctttccagtgattctttcgaagcgttggcccggtacggaactttggcttcatcaagcttcgctttcaaagccgcgatttcaccggcctcatcagccggcggcgtgatcggggccttcttcagcgcctcgatctcttcgcgaagcgcgtcgacagtcaacgccaggccgtcacgctcagtggttagctctccagacgaagcatggatggttccgagtacatcaaacaagcgcaacgccagttcgccggactctggacgacggatttcgccagtttccaggccgtcaacaaggatctggatcgatccatgctcagcacgcaaagccgcgatcaccttttccagttcggcttggttgcccgcaccaataatctgcgcccgcttggcttccttcaccgacacatcgatgccggctgcttcgtacgcattgaccacactcggccaatcgccaatcaccagcacgctggtcacacccgcttccggcttatcgaaatgttccggattgcggtaacgcttctccggatcgaagccgctcagctggttgctgtaagtcagttccatgtgtttctccaaggcggccattgctgaccgcgcgttgagtttgaggcttagccgccagtaacaggaggcgttgcggtcagcctgatcattacgccggcagtgactttgttgctgcccgcatgcttgacccagttggcagcggagccaacggcagccagggttggattggagccgccagtggtggccttccagctgtaacccagcacatcgatgtttacggtgccttccgcgcggtagccgatgctcaggttttcttcgtcgttcacttcgtaggaacggaagcccggcgcctgcgactcggtgatggttacggcgtttggcagcaggccgaagatcacatccgccggcgcggtgtcggtcaccagtacaggcttgcccagagtgcccggcaggccaccgtagatcacgacgccagcttcttcgtagatcttgttggtgatggcttcgtcgacgatgtcgaagtaggcggacgagtgcatgacccacagcgcaatccggccgaacttgtcgccgaacttgcgcataccgcgagtcagcgtcttcttgccatcggtttcgatgttggccgagaccaccatgtcagcgttggagccgatggcggcacgcaagccagcagttgcgtactggatgaagccttccagggtcgcatcagcaacgtcggcaccaacgatctgggagaactcctcgaccggacgaccgcggcgcttgaacgcctcttcggtggtctggtacgggccgtacttccatggagccttgactccaacagcttcaccagcgctgatcttcttggctgttaccttgccgtcggagttaacgtcgcggtgttctagggagccgttgagcttgtagagggcgcgcttgcggaagtcgccttcaatcagctcgttgtccaggaccatcgcgccgttggacgatgcgttgaacacatccaggttgtcctggacacgctccaggtatgcggtttgcgcctcatcgttgtagatgatcaggtcgctgttgacggttgtcgccatgggtcaatccccttacttgggcaatgcgagatatgcggtttggccgtgcttgcgctggaaatcgcgcttctgctcggaggtcatttcggagcgcttgaatgcagccttgccgccacccccgcccggggcaaatgtccctgaagcccttggccacagatgaggtgcgctttcgcgcagagattccgcccattcgagcggagtcagaggggtcttgccgtctttgccgaggatgacctggccggattcatcaacggcgactgcatcgccatcttcgttaagggtgaacacgcctttggcgcgcaggatgatatcgtcggttgcttccggcagcgcgccggctttcagtgcggcaccacgtaccgagtcgcccaggactttgccctggaacttggcggcgaaggattcggccttctcggcgcgctcgctgatggccttcaactgcttgtcgtagtcaccgcgcaggcgctcagtgcggcggttgaagacctcgtccaccttgccctcggtcagcagcttggtttcttcgtcctggccggcacgactgagcaggcctttgacggcgtcgatgtcgatgccttcaaactgggtttcgaactgggtcagcttggtggaggtgtccttcagctttcccagcagctctgtattcttggttttcaaaccagaaacggatgcttcaacggcagtcgcgatagcggccttgattgccgggttttccaggtcgatttcgttttcttctgccacgttgatgcacccctcgggtatgtttcgcccgctttgcaggcaacaaaaagccccgacatatgccgaggctgtgattgaatcgaatgtcggtatagagctatccctgtcagtcttttgatccgttaaacgcgatgcgatctccccctagaatcgctaaccccacgtaaccgaatccgttagcttcggctacctccctaactctcttgagcagcttttcaggatcttttgcagcatcaccgattaaagggacactactggttaaccaccggggatctcgcgcaaggcgcagagtgttgagcacaaagtcaacggtgtgatcaaaatcctgttgggactgtgaatgcatggttgccacctctcgttttgggtttacgaaaggctaacatcacaaaaagcatcatttttgcaggggtttgcatgcttttcacacgcccgcctgctcaaatgccagaggctccaaaaccttcatctgggcgagtgttaacggcgcaaagttgcgatcaagctgcagttcggtgaatcgctcgacggttaatccaccctcccggaacagctttgctcgaacaggaccgattgcggaatcctgaaacgctgctggctgctgctgtagccagtggtagtagtcgagactggcgtttacctgcctacctccgtcagcgcctacagatgcccgtgtggcgtccttggcgaaaagctcgctgagcctggtcagcatgatgaacgtggttcggcaattcgggtgaaatggcggccttgggccagactcaacagggaacctgcggccatccagtgagcggcattgctggctggtcttgctgtccagcgttgcaacgatttggatctcggacacgatgtccgtgttcgccttggccacttccattcgcgcctgtgacgacacatgctgaatcgcggtatgcacgaccgtactggcgttgcggttggtgatagccaggatgccgtttttgtaccccgccgccttggtaccgcgaatgttgcgaatgatctggaagttggtttgcccctcgaagaagccttgccggatcgtgccagtgacacgctcacgctcggcgccggtccaccccttaatgaacgccttaagcagctttccgccaccggtgccacgcacactgagcgggttcgtcagcactgcggtacggattgcagcagccgtcggcgcaaccacatccagcgacacaccaaccggcgccgatctggcaaggctggtcgcctcaaactcggcctcgtagttggcaatgtccaccaggtcgaggttcagttgcgcgctgtagcgatcgaagatgcccagcagcaggctgtcgacttccttcagcagtgcctccagacgcttcgtgttgtattccgtcaggtccgactgggtcagccgatcacggatcgaccggtcaatctccttgaggaagggagcaaacttgcccacctccccagccttgagcttttcaagaaagacagcgtgccggatggttgcgtcaagtattgcttggttcgccgccatctattgtgtcctcgtcgtccaggcccaggccatcgccctgctcttccagctcgccgtcgatttgttggtcggtgcgctccggtgcgatcagtccaagcttacgcaggtaagcccgcaagtcggccttggcgaatccgccgttctgccacaagccaaccaaggccgtgatcatctgcggatcagcagtgagctcgacgaactcctgattaacttggtaggcgaccttcttgtcggcgacgcccatgtaagcgcagcaccacatgattgcccgggtgtaggcctcgctgacgttggccacgcagccagccagcaccgaagtcgaagccgactgatcgccgcgggactcggtagcggtcttggtagcaagtgacgcaaccaccatccgggcgcccagctcgatcatcatctggttcttgtcgttcattgcctccctgaccagagtgttcggcagcggttgcgagtattcgaagcggctacccaccggcagaagcatcggcgcccttgagccgacgtagatgccattcttctccatccagtcgcgccagttctcatccaggcctgtgatcgacggctgagcctgcccgcaccagaacacgctgtcttcatagtcagcgctgttccggaaatgcccaaggttgatcatggcgatgtcgtagagcggtgactcgtcgatgctcggatcgttgttctgggcgccgacgaaggtgaatgggatctccttgaggcgaccggttacgccttcgggcttgaactcttcgatgatcgccagcggtcctccgcctttcggaccggatcgacgccagacccggcacacaaagccgtcgccctccaacgcaagctcccggtactgctcagccgtcttgtaaccgaagtcgtcggggatctctggcgactcccgcaagaccaccagcgtcaatacgctgtgaccgttcaccatgccagtacgccagttgatgatgtcttcagcgcaataggaaagaatcaccgagtgcccaccgatgccgtcatcctggtgatagtcgacgtaaagaccgtggcggccagcttcaagcaccttctccagcgtgccctgtgagtgctggtaaatgctcaccccggatccgttggcattgtcctgcaggtattcaagcttcttggggaccgtcagcgtcggatccttgtggaaggccaggcccagcagcccgttacgggtgtgcccagtggcgttcttgaacacagcccgctcgcggtatgcccggttccgatcttcgttctcaggcgacttatcatgcgcgttgatgtaaggcagccgatcgacaacccgatgttgacctgcacagacgtcgcggacagtagcccaacggtccagcacttcccggtattccgctcgcttaaaggagacgtcgttgctcatcgggcgtatcccattttgatagcggtgaccggcttgataatcgggtactcgcggtggatgaaataaccgccggcatcgttcgcgtgatcgatgcctgcggacttgtctggctccccgttcgcgccccacacctgctgctccaggccatcggcgtaggtcgggcaggtaaaagggttgatcaggtagcggcgctcgccctgcgcattgcagaagacggcgttcattgcgttgattcgatctttcaccggcgggtttgccgctggagcgatgaccgagaacccggcctgcttgagcatggcaaggtcggtgatgctggcgttcacggacttgcgtgaatcacccgaggcatccgggtagatcctgatctcgcaggttttcttgaagtcgttgccgtcgtgctgccagtagcgctctttgatgcgccggatcatgtcgggcgtgtcgtaaccgtcgatcaactcatccaccgccctcggcagcccctggtcgcgcttgacgtgggtgatcgccgccatcttcccgacgttgaagtccatcccaatgaacagcggctcgccgggctgcacggtgtcgaagcatccgttgagcttgcggtcgtaggccgtgtagatcgtgccggacgtcaggttgacgaactggccctttaggtacgccatgatcagctgtggcggatacgactccatcagcgaagcgatgtagtcatccggcaggttcagctcgttgtcgaatgtgctggcctgcaccaggccatacatctccttgagcgaaggcttgtcgcgcagctgcttcacgaactgcaggaagacgaacttgaagccttccggcgtcgtcgtgacatccaccccgttcttcagcccgagcaagttgtagcgcatccgggcaatgatcttgcgccaggcctgctgagccttgacagcggtcagcacgtccagctcatccaccaaggcgtgaccgatcttgaaaccgacaatcgtctgcggcttctccatcgacctacatatcacagtgccgcggtactgccggccgctgtagatgtgaacttcgtggttcgcctggttgatcttggtcttcagcccccagtcgtaggccacctcatccatggtcggatagaagatgtcccggatctgcgggtaagtcggtgcgaagtagccagcgttaacgccgggccactccatgaagtgcttgctcagtgccgagcagcccacccaggtcttgcctgagccgaacccggcaacgaacgcgcggaatttgtggggcagcgtgaggaactgagcctgaggaacgttaaggctcggcattcggcttcctcgcatccaccacatcgacctggatacgggtcgggatcactggttcgtcgcccgcctcttccttcttggagcggttgacgtagatgtcaccggtttcttttgcagcctgctcgaggatctgcatggccaggccgatgttcttcatcgactcggccttctccacgaaacgattcattgcgcggaggcggaaggcgcggttagcaatcgggatatctactgtctcttccctgaagcgcttgcggcactcttcaaaaaaagtcttccacttctgtccgaggtcacgaccggaatacttggttgggtcgtatcgctcacacagttggcgggatacttcaatgccgtactgctccttgacggcctgacaaacctgacttggggtatcgaagcaggccagggcttggacaataaaggccttcacctcatctttcagggctgccatagattcgttttccgtcaagggctgtcaaggattaagccagcttgagcagacaggttccgcaggccctcgcaatgttcaatttccctacctcggcaggactgtttgctgcatccaccaacgcttgaacgtcagggcttgcaccgtagcggcggacgacaccgacgaactcttcgacgtcgtgaccctgcagcttgatcttcggtgcaccgtcttgggtgaatgctggttgaccgtacttatccgtggcgtgtgcgatgtggtacagctcatgctctaccagggcacagaagtcggtgtcgctgcactgggcgcagtagtcagctgctaaggtgatgatgaaggccggtacatcgccgaaccaatcacgcatctgctgctccatccgagctttctgccagccaccagcgcggaacgctacctgctcggcttggcccaggactgtgcgaccctgcttctcgaagctcgacgaggcccacatgacccgaatgtctgcatccagtaggtgggcatggtcttcgttgtgaatgctgccggtgtcggcaaggatctcggtttggagccactcccacacctctggcgctggagtgaggcggatgccgaagccgctcagatcggacagctcaagcattgacgctggagggtatggcctgcccatgaatcatcctgaagttgaaattgtggagtgttacaggtattggtggcggctttaaaagtaaggaagctcaattcaatgtcccgcactaaatccatctgccttatcgctcttgccacagcagctctttccgggtgcgttactgcccctacgtggaccaacctcggaccagttgatctggatgtctcgaacggccggaccgcctgccatatcgacgcgaatatcatcgatggagagcgagttgagggcacactctgctccacctacgaatccggtttctttggaggcggagaaccagaaatttacttcgcaccacagaaccgcagattcatgcaagagcctgcgagcacaaccaccgcaggagttgctaaggactggaaagggaggagagtatttttacaatgcgaccctacactcgccgctgacggcaaaacagttgagaagcgcttttgcaaggtaaccatcaacgatcaattggttgttagtgcaaccgtaaaatacgtgaagtaaaccaagccttctcaaaataaatggacaatgaccctacgtgataaacgatcgatcgcttcccagtcggattgtttgattgtcatgtcgtctctctgatgcttgaaatagtggcacgtgggcggttataagaccgcccgataacgctatagagctcaaggtgtaggaaatggataacctgataaagctgcgtatcgggctgacaattgcgacggttgtcgggcttgtaccaatcaccatcctcttcgcggtcggcgtagtggcgttctttattccgctcatttttgtcgccaagagtactccgcttgggacgctagcacttataggggcagcaatcgcctcggcattcgcgatatggtcggcatggaagatctatgcactttcaatgtcagcgacacccaatgtgcgcaactcacgcttgctggcatcgggagcggtgattgcaatgatttggggcatggtcctcgcgtactggacgcgcgatctgcccgaactcacatacatatttcttatgccaggaatagtctcgacctccatgctcgcccttacattgaaaagagcgaaggcttgaggcgggcgatgagttcggtcagcaatttacccttctgaattttccaccagcacatcaatcagcctctgctcgcccaggcgcatcgcaccgaggcattgcaggtcgtcgcacttagggccgaggccgaacacagcgacctcaccctttgcgccgatcagcgttaaagcgcccacggtgcattcaggatgctccccggcatcgaggtcatcggcgatcttgcgcagggtcttggcggcgtcgcgccagtcttcccgcttgaactccagtaccttgacggtcattcggtcaccatttggtgtgtctgtgcgttggcatggccgtggagcaatccaacgataaggccctggggcaatccggcagacttcgcagcgcccacggcatcagcaatggccttgtcgagagcgcttaccgcaacgctgatgtcctggctcatcgggagcgcgtggcgcaggcgggttacgttactcattgaataccagcccctcacccatgcggaatgttttgttggtgtcggtatagccgccacagtagatgaccctgatgtcgccccatacagggtggaagtcgaccgtctcaccatcggtggccttgatcggctggtcggcaacaacggcgataccggcctaggcgtcacaccagatcatgcgggtcacaggatggccgtcgataatcacttttcgctggccccggccatcatccgcccaatggacgtattcgcctgattggtcgctcgtgtgttgcgcccttccagcggctgagtaaaggcgaacgtcacgccgtcatccgggcagtaggtcgaataggtggcattctgaaggatcaaaccgtcaaccagtatctgggcagccgtgtcaccgtacttggcgatcagcgcagctttcaggccatccgcagacaaggtcattgtgatgtcgttgaagcggatcagtggtgttttggtgtccatgagctatccagtgtcgcggcgcaatttgctgactcgcgaaacgtgtcgcaacctataagatgaatgaccacgccacctcctactcggctacaatccaacgttattctaaaggacttgaattaatgaatttcaaatacattctgctggtgctcgcggccgcttcagcgtcgggatgtggaacgatcaatacaacctttcggaatgatgccgtggcgagcagcaaactggctcgctggcactcccactgcgactcggtgcctcgaatctacagcggtgccatcttcgatttctgcaccctagatgcggaaccacgtaaaagcactggttttgccggataccctgctcccgcattgatcattctggacatgggagcatcagcggtaatagataccgtcttactgccttacaccatccacctgcaaaacaagcacggtgatatcaagaaggctcgttacgaatagcaaggcaactgatcccaggcaggtcattttgcacctgtctcggcttcacatatgagaaacatgtcgcgatttacttgcctcgccgcttgaccccgtcgggcaccttttcacgtcccatgcaatgctcacagttcagatgccggcagagccaggctttcacagtctgccagtaggtgaccatgaagatgtggcgggcgccggccagggccagggcgacatgcagtgtcagacctgcagtggtcggcccgaagaagatgttctgactacgcaccattacgacgaaaccggtgatggagattgtcgagtagatcagcttcccgaggatgccgtccctcaccttcccgctcagtacgcaccaggccgcccaggcggcgatcaggccgcaggcgatggagttgatcagttcaagattcatggtggattgcctcccccgaaccgttggcgaatgagcgcccagaggtcagcggatttgatggctcgattgatggccgccaggagcgagccgccgaatgcaccaagcaggaagccgataccggcgacgatcttcggctcggtcacgcccaagtaggtgctgaccatgctcgtcaggtagatcgagcaggccatgccggtcaccaagaacaccatccaggctcgccagtcggacaagtcgtccttgtgccaccagctcgcaacaacagccccaatcaggcccgcaattaataattcgaacctgtcgatcttgtcgagcaggcgctgtagaaactccatgcgctcgactccgtggggcatgtttaaaataggtcagccccagcagcactcccagccttagcgatgggtgtggtggagccgaaaacgaaaaggccccagcaagtgctggggcctaaaaggcacgctgcgtgatcgccgcttatgccttgggccaaagtttatttccttcgggcacacgatggcgagcgttagaacgtccagctccataccgggaagctaggaagagggcccgtaccgtggtctggatagaaaacaccacgattcggacgagctgctggagtgaagccaaaccgagcccagcggggtacgtcatctacaattacaacgttgccgtcatcctgaacttgcaggtaagcacgatctgcggaacctggaagccagtcaccgctggttgcccaggtacgactacctacacggtcgaccaaaaaggcagagccttgcatgtagaagcaagtgaccaaatctgtatttggacggttgtctacatacgtgtagggaacactgctatcagccacccagattggagcgccgttatcgtagagtcgtagatttccatcagcctctaggatcagcttgtatcgtttgcttggagattcgagatactgccccgccaccagacagttacgcggaggcaggatagcggtgccattattggcgctgttaaagaggataatacgaaagccactatgggacattttttcacctattgaatcgaatgattgatagcggaggattccgcattcatgtcgctcaaaggcgattgctcgaggctcgcggccttcacatgattcagcgtcccacatcgggaacatttgatctggagctctgtaaacccacccgttcgggcgagaagtcttttgcagttaccgcatctgaattctttcaacatctgcaaattccttttgctgaattacccgttcatttgggcaataaaaagcccggcactagaccgggctctgggatgtaacttgctctcactggattctacttcgcgccgccgttgtcgcgatcagtctgagcatcttggtcagatccggggttgcccggcggtggattccagtcctccggcttctcaccagtaccctgcttgggctccgactcagcttgctcaagaccggagtcatgaccctcgcccgtctcgggcatatcctcttttggtccaggatatggcgctgcaggaccgttattgtcatccaccataaatcacctcctgtctgtagcgcggggttgcgcatataactgggagggactgattagacagaaagtgcttctgcctcgacgagcggacgaaaaaaagccccgtgcagtgacgaggctttctagtgtcaatccctaacgcacaagatcgacatgatgggtaaatactctctcactttctcactcaatgcaatggctatttactatgccgcgcaagtttctatcaatccctcggcatcgagcagctcttgagcggaagtcagcgcctcattcacctggtcatccagcgtcttgcgtatcgacgagcgccaccgatatcgagtcgactctggctttccgtcattgtcccaattggtgatgtcgtaccatgccgctggcagcaccgcggcggagcgtttgccgtcggcgcctgctacctgaggaatagcccaggtcaatacggcgcattcccgaaagcgcttcggcgctggagtctttatcgaattcagcagctccagaatggcgccgtgcttgcgttcttcgtgagtggagtacttcgctaccagtgcgcgccagtgtgcaggggaaagcgccttgtgcagtcggccgaatacccagcagtcttggagaaacgccgcctccttaccgacgatctcccccttctgtttgacgcactgcaccttgggttcaaagtcgcagccgccggcggaactgatggtctcggccgcaagggcgcgaactactgctgaaacaacgttgcgataggtcatgcgccagccctcgggtataggtttcggccagcatgatcgctggactcgtacaggccggcatgccgcttgtctcggagattccacttcccaatggcatcgagcattacgtggtcgtaactctctgcgtcgtatatctcatcttcagcgatctcgccgctggcgccgcactcatggcagtagactcgagcctcaacgctaaggccgtcctcgccatagttcgctaccctctcaacgtgctggcgcgggaagaatgcggtagtaatgatagtcactggagggccaccgcagaacgcgcatggccccatcttgattggctcgttcacgctgcattccccctcttcagttctctggtctttgcccggtattcggctgtgatggctttcagttgctctacggtttctttgcgtggcgtgtggtcggcttccagcgcctcgacagcctcaaggccgattcgagcgatgaggccggcgcggaagccctgggaaacggtgtagcccttgcgagcgtgcatgtaggagcccgagttacacgctttgcactgaagccatatgttggttggctccaggcgcagctctgggcgagctcccttgccgaggaagtggcccgcatcgaatgccccgccagtcttccaaccctgggccgcaagaatcgattcctgcgactcaccacagctcatgcagccactgccaatactcagctcgtaggtgcgccggcagtcccgcacagccttctcggcatccttcatgtggtcggcgcgactcttcagggcctccttacggaccttgatgtccttccgctcgatttgtgccagcgccttgcgcgccttcggctcatgcctgggcgcgtcgatcattgcgcaggccgggctgcacaccgcctgaccgatgcgcgccgggacgaatgaggtcctgcacgtagcgacgcggcatttcttcggctttggctgtttccgtttgatagtcatgcggcctccttgaacgcctcaaaccctgccatttcggtcaggcgctcctccgtgagcgtcggccaatcgtgtagcaccaagtacgcgcagcactggcgccagaaatcttggaatgtctcctcccccattgaatcgtaggaaaggctgcggggtgtcttgcgggtgagctggcccaggccgggaatgtcgaacagttcctcgtcgcagtacacgccagactccagttgcaacgccttgatggcgtcgtgtgactgcttgccggagaaccgatcgatgttctggctcaacactcggccaaggccatggaccaagccattgaaccgtggattacgcggctgcttgaggtcggcacggatcttcgcgttcatcttgaattcacgctcgcgcaggatcgatcggtcggcgtcggaggacggcacgaacgcggccacctccttgccggtggcaggatctaccaggcggcgcagcaccaggtacacaggcattgggcgaggttttgccagcttggtcatgtcaggccccctccttgccgcgctgcgattcccactcgaacgggatgacgattaccccaccctcccgcaaccgatcaatgcagcgctcaccgagtgcatctggcagcgccttcgcatcaaggttggagacgatcacagtcgggcgcatttgctcgtaccgaccgttgatgattgcgaaaagtgtggtcagctcgaagtcgctgggcttttccttgctgacgccgatctcgtccaagatgagcagcgaggggctgatcaggctcgacaggatttggctttcgctctggtcactggagtggtcgtaggtggcacgaatggactgaaggacggcgccgatggttcggtacaccgccgtcgcagatgacttggccatgatctcgttggcgatcgccacggataggtgcgtcttgccggtaccgggcttgcccagcaggagcaggcagcggcccgattcagcgatctgcgcgaactcagcggcataccgtcggcaggtgttcagcgctttccgctgctcggtgctggtagcaacgtacccgtccagggtcttgctggcgaagcgttttgggatcagcgcggcgccgagctttcgctccatggccatgcgcagctccatcgccttgttggcgagctcagcagcttcagccttctcgcgaatgatccgactgcactcagggcaaccacttctcagctctttgccgagtactgggaagaccttctgttcgtactggccgtgggtctcgcactcagcgggctgaatgcgggtgcccggcggtagttcaggcgctgggagtattggctcagatcgcataggaaccatcctcacgctggatcaggccatcggtgtagttgcgttcagcaaatccggtgtggcgcgactgaggggccggcaccggtgcggactccgccaaacgcttaatcacccaagacgccttgaagccctgccagccagaattgagcgcttcggtgattgcaacgtctgcggtgataccagcctcggcgcacttggccaactcggcgctcacggttgaccagacggtggcggtcaccgctgcgcgcttggtcttgcgctgggtcagccagtcggccagcagttgctccggaacgttgtgcgggttgtcggccagcagttgggccatgccgaacggagccttgcgatcaggctttggaggttcggctggctcctggggcggattaatctctttcgtagaaagagttaataggggttctttctttgtataaagaagggagtcgtcggttttggtctgtttcgcggctgagccgattcggaccacttgagccgaatcagacgatatggtctgtttcggctctacgacgaagatccactcttttgggtcgcaaacgccgatatcaccgcgtgcaccaccctctcgatacagcacgcgacggcgcagcaggccggagattgccttcgacaccgtgtcggggtggatgtgggttgccttagcgatatcgaccgcagggatgcgatgggcgcccgtgctgaagttcaaggtggccttggccacgtacaaaacgatcttcatctcgcgcgccgacaaatcgatggccatcaagccatccatcatctggttgtccattcgggtgaacccccgagggttgtgtatcggaacaatgtttggcatgatttctctcgctcaaagctgttgaagaagccgacctcgtacgtcggcttttttgtgcctgtaattcaggcgatggatttcagtggccgagccgccgcgagcaattgctcagctctgcgccccaactcccccgccttcgcttcaacctggcggcactgcttggcgaatgctggcaagtgcggcaaatccagttcgcacatcacctggtcgtcaaacacctcgctgccggtatcgatcacatcgcccagggcgcggatcaatgcgccaaagctcttgttggcgcattggtcgctggtcatctggcgggcgccggtcaggccatggcggctcgccagttcgttcaggcagtgatcgcggtactcaggctcaagggcgttgacccacgattcttctagccaggacggcatttcctgatcgccgttcagccagcgctgaacgcgcttgagccagcggccggtggccttcacgaactcgtttacgtcgccggtcagcacggttgaattgaagtcaggaacgaccttttccttggctcgaccgggaatcgacaggtgcaactcgcggctcagcgcctgggcgaagtcgtcctggctcaggctggtgcgtgcgatctggtttgcagcgtgggcgaccagcacctgatcacgggtttgtacggtgtgtctggaactggacgtttgcatggggactactctcttctaatctggcttcaatggaacggcggacagggatgtcgcttaggcggcccgaacatccgtagaagattgctgcggaaaaacgcgatccaaagtgcatttcgcacctaattcattcagcgcctggacgatcttccgggcgtcttcaagcttcaatgggcgtgcccccgactcgtagttagcgagccgcgactgcttccagttgagctttcggtgcaaggctgcctgggtgattccggcctcctcacgaaactctgctatgaggttcattgcgttgctcctgcggtcattaaaccaaggataaacacataacgtgttattggcaaacacaataagtgggcggaatttatttcactccgtgattaaaattcaatccatgaagacactcggatcgcgcatcgctcactacagagaaaaagcagggctttctcaggctgccttagcaaaggcgtgcgggtggaaatcccaatcgcgcataggaaactatgagaaagatgctcgggagccaaaccttgacgatatcgccaagattgcccatgaactgaaaatcgatccggcagcgctgctgttgcctggcgaaagcccctcgaatatttcaatcgccgcccaacccatcaaatcattccgctacccagtaatcagctgggtcgccgccggcgcctgggcggaggccgttgagccctacccggctggattctcggacagctatgagttctcggagtacgactccaagggcaccgcgttttggctgaaggtgaaaggcgactcgatgacggcgccggccggccagagcatcacagaaggcacgctgattctggtggacactgaggctgaggtcgcaccaggtaaattggtcgtggccaagctaccggatagcaatgaggcgacgttcaagaagctggtgagcgatggcggccggcttttcctgaagccactgaacccgagctacccaattgaggcggtggacgagaactgccggatcgtgggcgtggttgttcaggcgctgcagaagttttactgatgcttttcaggaggccctatgtccctcacgaagccaaaccagcaactgcgccgcgacctgaaggcgattgcctcaaaccttgagcagtcctgtattgatctggtcaagctcgccgaaaagctcagtgatgccgacgcaatagccttgatggggctggtgggtacgctttatgaggaggcagataggttggtgggttatgcggatgagatcaaggtcggacgaataacacgaagcaagcccgagtaggcgcgtggtttggcgcggcgggatgctgtaggaatttaaattagcgctatgcgcatggagagcaaatggctaaccccataagaatggctaacaatttcgtcgctgggcacgcagattccgcaaccgttgcggcattgcgtccagacaactcaaaaatagctattagcttcgttgaggagcagatgcaaccattcctggttaagccagctggaagccaaacagattacgaagtcgtagagtcagtaatagcctcaattacgatggtccctgagcttgcaagggccctggcggattcgattcttaaaacgctcgacggtaataagtaaatggctgctgatgtcgatgttgcaggcgcatccagcgcccatcatcaggcctcctccatattttccttgagttctactccgattggcggaatcgctcagatcactgttactcaggcgcagagagatcaggcgcagcatggaagcagagtaattactcaaaatcgcgcagggatgggtgaccgtgctacgattgaaacaggcaaatcggacgaaacttcaacagaaactcaaatcacgggaggcggtatgtcagaaaataatgcatggttcgccttcctgaagtcaccacactttacggtgatctcaacgggagccataacagtccttgcgggagtaggcatgttcgtcatgctggataataaaatatccgcattacgcatggagacgaagtctgacctgcagctgtcttgggatcgtacggaagcccaattcggtaaagtggacggcagatttgataaggtcgactctaaatttgacgccgtgctgagcaaaattgactctgagggaaaagaaatccgcgccttactccgcccataagcttttcccgtaaaaagcccggcccagcgccgggcttcttgtttctgccctctcccactcaaccgctctatccgagatctcaatatgctcgtagaccttcccaagatgcttcgttgcccagaggcgaaggccagtcgcatgttgcagatcggcgaatcccatattcgccctttgactaattttgttgaccaactacgcgagaatgctgggccaggtgcgagcatcccctactttgacccgtgggatggtggcgtcgatgctgaagtgctgttcttgctggaggcacccggagctaaagcggtagcctcagggtttatttcacgaaacaatcctgacgaaactgcgaagaatatgttcgaactcggggtcgaggctggcattaatcgcaaacacacagtgctttggaatgtcgtaccttggtacatcgggactgggacgaaaatacgagcagccacccctctagatctcgaggttggacttcaaccgctgcctcgattgttggcactgctaccaaatctacgagctgtcgttttactggggagaaaggcagagagggcagcagcagccattgcctcagtccggccaggtctgaaactgttcatttgcgcccacccgagcccgctatacgtaaataacgcaattggtaaccgcgaaaaaattcttacaacccttcgccaggtcagtgcacgtttacagcaaggttgactggcagtgtccggccaacgctgggcttcttgtatctgccctttcacgaccttttcacagtggagcgcctattgtggccacggctccttgtgaagatcctttaagcccgctatcccccatcgcgggcttttctttgccttgaattcggtggtctacgctatctaggcccttaattggagacgacgccatgccctccccctactcccttcccccttatgctcgaacgcgtctacgagaacccgctcgccctggaagcggcacttatggagctgacattgctcgtcgaaagccaaggcagtgtcgaggctggcggcaatgttcgcggtgcactggagacgatcggtgagaacgccgggcatatcaagcaggggttggctaggttgagggcacaagggcctgattgatcacctgcccgccagtagtggctgtacgccacgaatggtaaggtgctggctcagtcagagagagaccctcatgcttaagaaattgctcgctgcttgtgccgcctcgcttcttcttaccgggtgcgtaaagcccactccagagcagcttgaaaatccggactatggaccttatccattcgactacgatcgtacgatcaaagcatatatggcgcggactcagccggatcccgattcaacaaagtatcaatttctgggtgaccctattccgatgtggaatggcatctttgggcttcgattcgggtatgggatgtgcgtcatcgtgaatgcaaagaatatttatggcggctatgcggggcaagaattgtggtttttcatgctgcgtggcgaacaagtcatggagacaaatagcgctcgtgtgggtggacacccaaaggcatacgctcgggtgaagtgcgaaaaagttggcttcaacttgggaggctgaactaagtcgaacccttgagaatttaatagagaagcccgtcgcgcgcgggctttttcatgcctttagattattgcgacgtcaccgaggcttgcggctgtgcagaaggtggaagacttacagcgctcagcttgccagtagcgtcttctggaagcgtatacatggcacctgtcaacggatcaacgatcaacatacctatcaagccgccaataagcaggttgccccagtaccagccgcttacagtcgacttcagagggacagttgtttctgcatagccgtctttttggaaggtaacggtgtagctctggcttttaaagtagcccctgctcgtctccaaaatcgcggaacctggagtgacgcccttatgcagcacacctccactactgtccttgattacgtagttggcattcgtcggaaggctgtacaacccaaccttcggcttgctatcgctgacaatgcttgcgcagccgcccagggcaatcattgcaataagcactacgactcccgccgcctttcccatcttcataccatcactccgtagcgccttcattggcttggccgatgctcggccggcgcgcattgtatccgaatgatggcagttagacaccccgccacagagctgggcttttctgggcttagggcgtctccaaccaagcggtttatgcatttatgcatgaaactccttgccaccctattgccaataagatgccaacaacaatactgtacatgcatacagatttcgcaaggagcgaagcatgattcaggcacccaactatccatcaaaaccacgaaattcctacgagcttgtcggccgacgcctgcaaggcttgatcgcctctcctcgggtacagaggattcaactggtcgaagtatccaagcgcgacgacgaaagccctgaagcctggcaccaggtcatccaggatatcggcgacaccgctggcataaggatcgaacatttggagggcggcactgtcaggatcggctggcgcgagtactgcgattcctaaatgagctcgccggtaggcgggcttcctgctatctccgtcccaatcaaaaccacacatcgtgattcaatcatgaaaaatataaacacgttacgtgttgacacaataaacacactctgtgattatcgcctcaagccagcaatgaagaatgtcggccagcagcgaaacctgcgccgctctttagcgataccccttgccggatcaccaccggcccagattcaaaggcagcgatgaaccggcctaaacggttcagagggttggcaactgacccgggcgtgcagcgtaaagcgccaagaacagttatccagcgggagaacaagccgaaaggcccgcggctggaaaaacaattgattcaagccggtgaccgacgccagtagcgggtcacggcggaaagcatcactgaagctcgttcgaggagcgggctttgggatgtagaccaggtgctaccgacttttccgagagctaattagcaactggcatctaccagccatctgcgggagggatgcagccacatcagacagcacgcggtacatgtcatcctcgtccggaaacgggtacacctcgaggttgagagcgatctgaatcttgcgcaggtctgtgccttcgacgagccagcgctcagctgtgcgagtcatcgctgatccgttgtcatccgtctgccaggcaagaaagtcaaatagcctggcgacctgcagaaacgatatcgagtcagggatatcggcaaaaagccgatcagccaaattttcctccccaaactcaaccactactgcacggacagcgctgaacgcttcagtgtattcgggctcgccgctctctgctgcgatcacgctcaacgccctttcaacaacctgatgcatggcaattccttgctccgagaaggagtgtcgatgctaccagccttcagtgtgactcgctaaacggtcagcgccgcggcagccgggaaagaccggcacccttccccacctctattacgtcagcactcctccccagcacccatcggcaaccagcgggaggcatgagtgttgacgaatacaggtgaacaacccgccaccttggaggcgaccatgtcagcactacgcaaacctaagtttgagcatgacgaacaattaccgcctccggtgagcgaagccgctcagcaattggctcgcagcgaatggctgtacaacgcagccgaagagctggccagaggtggcagcgtgatgttcaagcgccacttgcacccccaacaaggcgtcacggcctaccagttcgcactggctgtcgatgagtacgccaacaacctacttgctgactgcggcgtcaacactccagccctgggctacttactgatcgcagggatggcgggttcgagggtgaaatcggaagcactggagctgcttggccggagtgaccaccaacttgggaagctcggcgagattgccgaacgcctccttcaacctttggctgatgacgctcttgtcgcccaggccgaggacaacgaactgtgagcccctacgttgagatcgataaagcgttgtttgcgcttgaagatccagataagcccgagctcgacgagatcctagccgagggtttgatcgtcagacactttacttcgggcgccgtcaacgcagaagaattccactggtatagcgcccgtctactggatgtcagccggcggcgtaaggagattcaatgagtaccacaccggttaaatccctgatcgacgagcagcttgaagacatcagcgctcacaacctgcgccaggcctacagcctggccgaacgacgtggtttcttcggcccaccggttgagcaattcgcagaaccaggctacggcggtcgagtgctccaggtcctgcgctaccgggttcagcagcaggatcagcaagcagactgatcagcctttccccttattcttgttcttcgcactgccctgccgcgctttgaattttggattggatttacagatcacgtagatccggccgcggcgcataacgatctggcagtcacggtgacggtttttagcttctttgagtgaggacagcactttcataggtgaggctccttgcgttgagttgaaatgttattacgtatcttaaatacgaataagaacgtttatcaactcttatttccccttccctttttatcgctgcgagcatcgcggcaaggatctctcatgaccacaaacacgcgaatttgggaccaagtcgataccactgatccaagcgcaacaaagaacttcaccggcatgggcggctttaaaggcaccgccatcaaacctacctacctgatgcataaggccaccgaagtgttcggcccttgcggtgagggctggggctggacggtgcttgaggatcgctacgacgaaggcgccccgctccaggctcctaccaaggagtggccagatgctccgcgcatcaacgccaagctgcacacgctgaaagtggagctgtggtacctgggcaaggatgggcagaagtgcaccatcgtgcagtacggccacacgccgtttgtgtacctgcagagcggaaaaatcgtgaccgactgggaggtgtccaagaagtcgctcactgacgctattggcaagtgtatgcaaccactcggcttcgccgcagacattcacatgggcttattcgacgatccaacctacgtcgacaccatcgccgaggagttcaagcttgaaaaggcggaggacaaagacgccgagatgcttcgccaaaaacaggagcgtgtcgagtggcttgcttccgcggtcgagaccatcggcaaggccgtcactacacacgaactcaagcttctgaacgtgaagtacatccgtgaagccacccgccgcaatgagcctaccttcattgcacgcatcactcgcgcattcgaagagcgcaaagcaagccttgagaaaggcacggaggcagcagcatgacccagctctacgcactcaccggcaaactcgccgagcttcaggccatggccgacaccgatgatgaaggcctgaaagaggctttgcagcacgccatggacgaggtgcaaggcgatttcaacatcaaggctgacaacatagtcatgttgcgccgcaatatcgaaagcgacgtgacagccatcgaaaacgaaatcgagcgcttggccgagctcaagcgaatcaagtccaacagcgtgtcgcagatcagcgactacctgcgccgcaacatggaagcagccaacatcaagtcgatcaagcgtccgctcttcaccatcaccctggcgatgggaagtgaacgggtggtcgttgataacgaagacgcagttccggacgaattgacctctgtgaaatcaagcatcacgccagacaaaaaggccatcgccgccaagctcaaggaaatccgcgatcacaacgaggcggtgcgcaagcgaatggatgccggtgaggacgccgaacatgaactgctcgaagagcccaaatgggcgcaccttgagcgcggtgatagctcgatacggatcaagtgagggcatcatgatcagcaaccacctcagcctggtcgaggcactacgcccggcctcggatgaactggcggcccaggtcgcccagtttgtagcggccggcggcgaaatcgaaattgccgagcctccgccgccaccgaagcccgtcgtgtatgtgccccaggagccgccagcaccgaagccgtttgttcggcggcgggttgaagcgtctcccctaccactcgataaggacgacatccgcacccaggagcgactcaagctggctgagcagatacgccagcttggcgtcaccctcacccaaaccgaagtagcagccaccatcggtgtcagccgtcggctcatctacaactacgccgcccggtacgacatcacgttcaaggcgccaacgagaggcggcgcccggaacttggtgcacaacacggtcgatgaggagcgcgatgcgaagttcgccgagcgcatcaaggccttcaaggaactggggatctcccgccggcagtgctgcgggaagctggcgatcggcaacaaggtcttcgagcggatcatcgccgcccacggcatcgactatcccaaagcgcggcgtggcagcacttcatgcgccgcatagcccgcatccagcaacgcaaacgtcaaacctggctcgcactgccggccagcggaatagaagaggtaggccatggcgcggatctacgccagacgcaagacaccgatcatcagcgaggtctttcagatcgccatcatgaagatggacttgatgggcgactacgaactgaccgcagcttagagttatccgcgctgcgtaattatgatatgcgaaaacgtgagacttaaaaatttcagaaaaaagaaattgaatagaggctgtacttcatagacaatgaagcaatctcgttttatctgagattgcctcactttgaatatcgactctctcgtgccaatatttgcaagctaaagtcaaagagcggaattgattctctaaaatcttgtgttcacgtcatctctgcgacaacgacactctccattgcagtaacaaaagcttttaggaaagtcacggcgtctaatgcctcttgcttggtaataggccgcattttcacctcacgagccctttcctgtattattaggtctgactcgtgaacgatttggtttcgccttttcgctatagaattcaattgatcctgtagctgttgactgcctatgcccccaccgtactcaatgcacatcttcctccaaaaatcatcaactcctaatatccttgaagccttcgtgatatttgaagaattttgaaaggtgaaatctcgatgaagtattttacgcacttcttctttaattgaatttcctgggcgcgccgcacgattctccctgatacgctcaatcgccctcctaactgcattaatgggcaaatttattgatttgaactctctagtttgttgctctatcggcgaattcaatattttcaaaaaatattttataactaattcatgactgtatcgatcaagagcggaaacagatgctgagatcgcccccctcagaagctcagaggcatagtcatgggtaaaagactctcgggttaatcccacagattctctaataattaataagctttttttgtccttgccatcgatcctgacaattttctctgcctttggccagcgcataaaactaagaaaggacgttcgccagtcatctcggatggctctttggcgcgagtcatgaactaaatcataaagatccagaaaatggtcagctcgttttacagcatttttaaacagatctagcggctcaattgccatcaccaattcccttttgatccggctccatgccggtaacccgtaataccccaacccaaaccaaattgccaccaccgttaaccggagggcggcgcttacctggagtaaacgaaatgcctgtacgccatagcgtcatccacaagatcgacaagaagcccgacggcagcccggcggtgctgatcctgggcgcatccgaacaggtcgaaagccaggcccgcgacgacctgatgagccaacttaacgaaagctacaacgccaccgctggtaagggctgggggttcttccatcacgagtcaggcgctttcccattcagcggctggctcggcaagtacatggccggagtaaccgacttcctggcgttcagcaccacagccgtcgagcacctgaccaggctcatggaagaatcgaacctcaccacgggtgggcacgcgctcttctgccattaccagcaaggtatgaccgattacctggtcatcgccctggtacaggaaacagaagcggtgaccatgaccgaagaactccacctgatgacagtgaagcgcctggacctggaccacatccgcctggccgcgcggatcaatatcagcgaatggcagaacaacccgcggtcgctgcaatacatttcctacctcaagggcaagcagggccgcaagttcaacgagtactttcgcgatttcatcggctgccaggaaggaatcgacggcccgggcgaaacccgcacgctgttgaaggctttcagcgactttgttgagagcgaggacatggtcgatgaggcggcccgtgagaagacggccaccctggtcaactattcaatggcccaggccaaaatcggggagccgatcacgctcgacgagctgtcgggcctgatcgacgaagaccgaccgaagaacttctacgacttcatcaaggcaaaggactacggcctgtccgacacgctgccaccggataaaaagacgctcaacaaattccggcggttcaccggccgtaccgaaggcatgtcgatcagcttcgatgcccacctgctgggcgacaagatcgagtttgaccaggctggtggcactctaacgctgcgcaatctgccgacgcagctcactgatcagctcaagcgcgccgccgcctgattcgagccgccgcgctcttcacagagtgcggcacctgactggagatgctccatggaccagttttatctacaggacagccggagtcacgcttatgtcggcgacggcctgtcgttttggggtgtgggcggctctggatatgtgaccgacctggctaaagcccaggtattcaccagggacggcgcctgcgatcaccgcgacacggacataccgtggcccaaggcctacgtggatgccagggcgcgattaggtgttgactgccaatatgtgacgctgggcgaggcgctggaccagcaccctgacgcagcagagttttacatccaaaagccgcagtgctggaacggtaacaatctgatttggctctgtgatgacggaatgttcactagcgacctgtcaaaagccgtggtggtgccaagagtgcacaccattacttggatcggaaagctggggcaaacaggcgccgttgtgtggcctaaaccatacatcgacaagttcgcccgccgtttggttgagcgcgacgacgtgaacatcaaggaggccttgcgaggcaccggcataaaactggcaaagccgcaaaagccgagaatgatgatgttcaactgcggcggctgtggtcggttcataagtgacgcgcagcgctatcgggaagactgccggaactgcggaacaaccaatactccttgatccggctccatagttagccagccttcatgacctctctcatgctctcttgccatgcctcaacaacgactggatcggttgaaataagtggcgtcattgcctctagattcgctgcgacatgaccgaacgcaccgggcagctccggatttccgcccgacgcgtaaatcccggctagcaggctgttcagaacaaaaacgttttcaatattcaagcgggccacttgtttgagctcgtcacgaattgcctccgcttcattgcgagcctgcttagcggccttggcatcggtttttatggaggctttccagaaagatatctccgaaatactgtcaggaccgataattaaaaaaatcgccacgagcagccaaagcgtggccactgcggtgaatgtggcgacaccaatcccacctgcaaacaacgcaacgggaaggccgataagcagcggccataaaatcgcgtaacccgttcttcttcctatctgcccagccaattcactcattttcactccatgacccgacctcatgccgggccagacacaaatacctcatatctacgaatcacgccagccggcgaggatcctctatgtccgcacaacagaagaagcccccattcatccatgcccaaccgagcatgggcctgccattccagaaagagctggtggtagatctgttcgccggcggtggcggtgcaagtaccggcattgcccgggcgtaccgtgagccagacgtcgcggtaaaccacaacccgattgccctggcggtgcaccgagccaatcacccgcagacggctcactacgttgccgatgtgttcgaggttgacccggtcatggcaaccggcgggcagccagtcggcatcttgtgggcatcgcctgattgccgccaccacagcaaagccaaaggtggtgcaccgcgcgaccgtggagtgcgcgggctggcctgggttgttgttcgctgggcgcatgccacccggcctcgcctgatgttcctggagaacgtcgaggagttttgcgattggggcccaatcgacgacagcggccagcccatcaaggcccagcgcgggcgcaccttcaagtcattcatttcggcgctcagcacagggctgccggatgatcatccggatatgccggaaattctggaggccatcggcgaatacgtgcccaaagaagccttggtgcgaggccttggttacaaggtcgaatggcgggagcgtatcgcggcaaacgccggcgctcccaccattcgtaaacgcttgtacttggtagcgcgcagcgatggtatgccgattgtttggccggggccgattcggcacaagaagccaacagcgaaacagcaaccctggcgcacggcggccgagtgcattgactggagcaacctgggcaaaacgattttccgagacaagccaatggcgctgaatacccgccgccgggtggccaaggggatgtggcgccacgtcattaccagcgacaagccattcattgtgccaatgcgcgggacgtcggaagcgcacaccagtacacacggcgtggatgagtcagtttcgaccatcagcgccggcggcacacaccacgccctggtgcaacccgtggcagcgccgtttctcactgaatgtgccaacggttcatcgcagcgcaacttcgatgttcaggaagcactgagaactcaagttgcccaggtaaaaggtggccacttcgcaatggcggcgtgtcacttgacccacctcacacaccatggtgaacgcagcggttactcgccagatgagtcggcccgcacggtcaccggcgccaatcgcggcgaacaggccattgtttgcgggcatatgacggcattcgggcagaacgctgtgggaggctctccctatgatcctgctcagactgtgctggccggtgcggcgcgacacgggatcgtcgcagcaaatatggtcactttgcgaaagggctcagttggtgctgacgtcgacggccccttgggcgtggttgcaaccagcaccggccatcatgcggtaacggcggcgtttttcgagcaagccaatggcggtttctacaagggtgacgggcgatccgcttaccagcccacctctaccatttgccagtcgggagccaatcagcgcatcgccactgcatatctggtgaagtactacgggtgcgataagggtggtgtctcgctgacagagccgatgcacacactgccgacaaaagaccgagttgctttggtcgaagttgtccaagtcccggataccttaacgcccgagcaaatggaaggtgcccgccgctgcgccgccttcatgcatgaacatctgccggagcatttcaaggagccggccgagatgatcatgatcggcggatatgtgctggtcgacatcaccttgcgcatgctgcaaccgccagagctgaaggccgcacaaggattcgacaaggactacatcattgaccgaggcctattcgttgatcctgtgaccggcgccgaacagtggctgcctatcaacaagacgaatcaggtcaggctgatcggcaacagcgtttgtccagacgaagccgaagctctggtcagagcaaacgctgcggacatcatcgagctttaccagcgcctcgctgcataggcggaacacctacttggcagagcgacctgcaatcagccttgacccgacctcacgcccagccacctgcgccaggccacggtcaacataggttcggtcacccgcaacaaccggcaccaccacttcgccaccgcgctttacctcgacgttgatacgccaggtctcccggccttcctcgtccttgtcgcactccatgtagttccaaacctgaaagccttcgatctcatcgtaaatatcgtgcttggtcatggtccagcccatttagaggaaggggccatcgtagctcaaagccagccggtacggatgatcacggagatcaggcgaaggatggcggcgatcaggttgatccattcggtcagtcgtttcattttcagcaccgcttagttgaggtgccactgattctgatgtcacgacggatcgggttgtatacctgaaacctgtcgttagccttcctacaagtcgcaactttctcacacgactaccccattgacagcactccaccgcccgggcatggcccggaaggactccccatgcctacagaaaccaaattcttcgccaccggcgtgacgctccaggccgcccgcgcaaaccgcgtctacgtggctgggcccataaccggaatagccgacttcaactacccggccttcaacgccgtggccgaacaactccgcgccatgggctacgaagtcgagagccccgccgaccacggcatcgtcgaaggcgcccagtgggccgactacatggcctacgacctaacccgcctgggcctgtgcggaatgatcgcctgctgccggactgggagaagtcgcaaggcgcccgcctggaagtgctgatcgccgagaagctcggcatgaccgttgtggatgcccatgatcttgtggctatttagatataagagtagagcgcgctcacccgatacgcttggaatctttgtttaaaacctttttgacacctataccttcaccactctcatcatggtaattataaagttcaaagctttgactgttagacagcccacttgacttcatatagctaatactgaggagtgattttctccccccaccaaatacatcatcaaggaaaaaacttctgcctactccgttatatagcggctccaaagatattggggggttgtctaccccctccacgcataaaacaacgttaacaccctcgcagtaactcccgagatttgtaagtaagaagccggagtaataatcaccatcatcctcctgaccacctgtatattttaactgaagcaatggttccagcgaacgctcgtgattttctaaactgagttgctgagcagctaccaacgatgtttgctgctgcaccgaagcttttagctcatcagcctgcattcggagcgcatcggcactaacacgaagttccgtcccctgctgcataaaacccagaatcaaccagaaaaaagcgatcggaccaaacgcgcctgccaaaaaatcacctaccgcattcagttccattgtctgaagctgtggcaaacgtccaaagatgaatgcggtaaaagcaaataaataaatcgcagtaaatatagtaccaatccaagcaagcttgttacgcatacatccctcatgctgttttttatcaagacccgaatcatattcgatgtagccatgaccagctacacccctccccccttcaaagtcagccgctatagcggcaaggacgactcatgtctcaagtaaaggaaagtccgatcctattctcggcgccgatggtgcgcgccatcctggaaagccggaagacggtcacgcggcggacggtgaaagcgaccaaggctcacgccgacggcttcatcatgctcgaccacggcaaggggtggcggccatacaacgcgtttggcgacttcacgtctgaccatgagggcatggaatacccaatcgcttgcccatatggcaagcccggcgatcggctgtgggtgcgcgagacgttcggcctgcaggtccgacattacggcggcggcgccggcgagcacatcgtttatcgcgccactaaccctgacgccatttactgcaagtcggcagagggccaggaatatccagtcaaatggaagccaagcatccacatgccacggcactccagccgcatcctgctgaagatcaccgacgtgcgcgtcgaacgcctgcaggacatcactgaggatcaggccacggccgagggcgtatgcgccagcgcagttgaatcgttcaaagccgccggcgtggagcggcccgccgggttcgctttccgggatatctggacttcgatcaacggtgacgagggctggccgtccaacccgtgggtctgggtggtcgagttcaaacgggtgtagcgcaaattgaggaagatcagcgctttgctcgttgggagagcccgatagccataaaggcgatgccgggtatccaaaagccagggttagatgtccccaagccgactgcaagtagtgatacaccgacagcaaacatatgcgctcctccctgaaaaactatccattccatatccacccatttaagcataaaccggccatcaaaacggccaaggacgaagtcatgcctgaagaaatcacgttgatccagccagccccggtcgtgcgcgacgaatacggaatgttcgctcaccccgatatgcccgacttcgacgagggcgacggtgataagtgcaaggcctggatcgctgcacagggcctgcaggtgaagatggtgagcctcgaataccacagcgacgaagcggtctctgagcgctatttcgaagctggcgaccctgactgcagttactgggagccggatcggcctgatggcgaaggctggttctgcctggctattcacgacacagacgacggtcctgtctgctggtgggcacgccgagaggttacgccatgatcgccccctctggttcgcctacgtcttcatctaccgaggggccaggccgtgagtaatttccactgtaaatagtcgggaaaccgacacttcaacgcgccgaccatcaaggctcaccaaacaaggagagccacatgagagcgttcgcacaagcaattatcacaattgcaccagtgaccaaccgcaaatccaggaatcgtttcctccgtgaatgcgacagatggtccaaccgcctatacaggcgggatttgatcagccttcaacaacgccaggatctgcgccggcaaatcgcagcagcgtgcttggtggcgttgatgtaacccctacatgcctatcgttgggcggattcacggcaactgactatcgatccatcgttcagctgccgccatcgcttcatcaagcgctgccggatagtcaggccaagggccttctaactctgcggcaacctcacccaacccattgatgggcgctggttcaatgatctttgcggcaacagggctctcgtcgttcgggcggcgccagtcgaacttgagaaccatcacgtggccccggtaaacgtgagctatcggagcatcgaagttgtgtgacacgtccatgcctcatcacgaacttagttgaacccttttgtacaccgcttcggtcctgtttgaaatataggcagaaagctatcactccaatcccctatacgccgcccagcgcggctaggacacaccccatgttcgctatgaaactcaccctgatactgctgggcgctttgctgtacctggtaggaacccttggctggttcttctgggccgggcctgaccttgttgccaccggcaccaacggtgcactgatctacgccttcgtcggcacctgcgcttggctgctgatcagcttcgccattgccatccacatcatcaagacagcgcggcccacggtgggcgggaggtaattatggaaattcactttctgtcacatgaggaggtttgcacgctcaccggcgcaaggacaaaagccgggcaggtgcaagtgctcaggcgaaacgggattcgccacaccatcaagcgcagcggctggccttgcgtcatagccaatgcgctaaccggagaggcgatcatcgaaactacgacaaaaccaaaatggcagccgcggctggtgagttaaatgggaaggaaaccaacacagcctgacagcgttacgcgcttaaggaagcggaagcaacgtagcggaactatctattactactacgacctcgggggatcgccgaggaaggaacttgccctgggcagcgactatggaatagctatcgtggagtacgcaaagcttgagaagagccgcgcgtcctcggccctggcccaagacgtgctgacctttgcctacgtggcaaacatctacatgcatgaggtggtgcctaccaagagcttggccactcaaaaggacaacactcgggagttgaagcagctgctgaaattcttcgatgatccgcccgcgccgctggaggcgatcgagcctcaacacgtcgtccaatacctgcggcagcgcggcaagacagctccggtgcgagccaatcgtgagaaagctctactcagcgccatctggaactttgcccgaagcagcggttatacggccctggccaacccgtgcgccggcgttaaggggcacaaggagtccgggcgtgatcagtacatcgaggacgagatgttcgcccttgtgtatcaacacgccgagcagccgctacgggatgcgctcgatttgttctacctgaccgggcagcgcatcgctgacaccctgaaaatggatgagcgagacatccgcgacaacaggctggccgtaaagcaaggcaaaacgaatgcaaaaaggaggattgagataacgggcgagctgaaggttgtgattgatcgaatcatggccaggaaggatgggcacaagatcaggacaagcaggctcatcgttatggagaacgggcagccaatgaccagcagcatgttgcgcgggaggtttgacgcggcccgggaagcagccggtgttgagaaaggagattttcagatgcgcgacttgcgagctaaggccggtaccgacaaggcagaatcgagcggtgatatcttgcaagcacgtgatcagctcgggcacaccaccgtggtcatgaccgagaactacatccgcaaaaggatcggcaaaaaggtcactccgacgaagtgaattctgcaccgcaatcattttcgcccccttgaaaacaaagggctgcaaggtgtcttaagagagcgcatagcggtgcagaattgacgctatctcattggtttaaaacaaatacattatggacttaaaatcccccgctcgtaagggcgtcccggttcgattccgggttcgggcaccatagatatcaagggcttgccagggaaacctgggcaggcccttatcttttctgttccgcaattcttagatctgttccgcaactcccttcccaccggtgttctgccgaacaaatacctgtccctacttgcaagacaccgaccatagctgatccaaccttgtcgtatagctctgactcatcatttcccggcgcatcccccagaggggattcgtcggcacgctagcagatcgcagcgtcccccttccccaccgttcgttgatctggtcgagtacagccataacctgggtcgcctcggtcggctgcgatattgcgaaaagattgtcggtgtattcgcctggctggcacaggtttagcagcatcacttcagccttgctgtacttgaaacctggccggaagatcttatccagagcatcaaccgcggcctttgtgagcaagcgcacgtcgtcggtgggataaggcatatcgactaccacgccgttggcgtacttcgcctcttgcgggttgaacatcccggttcggatgcagacacggaccttcttgcagagtgacttttgcgcacgcagcttttccgaggctcgcaacatgtaggtggccaccgcttccctaatcggtgacagctcggtcagccgcatgccaaacatgcggctacagcagatttcttgcttcggcacattgggatcgtccagctccaggcacgacgtgccggccagttcacacgccgtcttttcgatcactacgctgaatttcttgcgcagcgtccaaggatccgccttggcgaggtccattgctgattttatgcccattgcgtcaaggtggagtttcattttgcggcccacgccccacacttcgcagacgtcagtattgcgcaatacccaatcgcgcttgaccggatcggtgatgttcaccacgccacctgtctgagcttgcagtcgctttgccgtgtggttggccagcttggccaaggttttggtgctcgctattccaacccccacggggatgccagtgcagcgcagcacccgctcccggatctgacgacccaaagcatccagctcgggaatacccgataggtcagcaaacgcctcatcgatactgtaaatctcgacggcaggaaccatcgattcgatcagggtcatcactcgctcgctcatgtcaccatagagcgcgtagttggatgaaaaaggaacgatgccatgctgcttcagcttgtgtttgatttggaaatacggctcgcccatcttgataaacggcttggcgtcgtaactgcgagcgatgacgcaaccgtcgttattgctcaatacaacgatgggcaccttagccagatccggtcgaaagacccgctcgcaacttgcatagaagctattgcagtcaatcagtgcaaagactggcgcgtcagacatgactgcgcaccgtgctggtaatcacgccccaaattgatagctcgtcaccctccaaaacatacctcgctgggtatttcggattttctgacaggagaatcacctccttcccgcgcttgcacagtcgcttacagacgggatcattgttcaaaagagcgacaacgacgtgcccgtgggccggctcaattgaccggtcaacaactgccaggtctccctcaaaaattcccgccccttgcatgctttctccagtaatagcgatgagatagacgtgcggcgccctgatatttaggacctcatccaatgagatatgctgctcgatgtgatcggccgccggtgacgggaagccagcgggcacacgaaacgagcagaaaggcagcttcgtgccgccttcggatataggacctaaaatggtgaagctcatgatgcagccttctacatatactgtacgaatgtacagttaactttgaagccggcttgcggtcaatttttctgtaggagatttcgacagatggagaggtgcctatgtgcggaagactttcacaatacatcggacggaggacaccatgtccacccttcaaaggcctgggctacaccaagcgagatacaagtggtcgaaactccatttttctagcgtaattcgtaaaccaaaactgcttgggctagttcgacgtcgctgactgagctcgtttcattctgagtacgcaaaacctcgaatgcagcctccaggcccacgcctctaataactccatcactcgcgacaaaagctgcagcatcattgcgtgcggcaagtacctttcggtcacccttctttgaactattctgactactttcttgactgtcttcggtaagcgaaacgggggaaagggtcacagcaaggctcgatgagacaatcgctccaaaggccgaaaccttgaccggcctgccatcaccagcgattacgggaaaactgcacgaaaaaccgagcataagtacaacaatcagtttgcgcaaagatccactccacaggtatgcatcatcctttaggggctgaatctaccttcttccacgccaggcatccagcgtggatggaatgccagtggcgcacatcgattgatcagttgtagcttttgacgtccaccccataaggaactgagcacaccaaagggcggatcagcatggagtgcagcggatgtagcactgttacgtaagctggccgcaggtaatactccgacccgcgtcatcggtttgaagctccccctcgtccggcgtcctgccaaatccatgctccctccttaaatctcaaccgaactacccgcgcattcaaacgctctaccgaaagacgcctgaacatctccaggccaacccgcaggagtggactatgtctgacgatctgaaaaaccgtggccctcaagaccgtgctcgagtgaacacttcagaagcttgggagttgaactattggacgaaggagtttggcgtgactgagcaacagctcaaggatgcggtaaaagccgttggcccgatggttgcagatgtgcgtaagaaactcggcaaatagcataaaactcgccctgcgcttctgcggggcgctttaatgatcgtcgcccatctgcattaaggcatcggccgtactctggatatgctcacgcatccacaccttgcccagccaatcctcgggaataccttgcacaccataataggcgccggccacctgcccaacgattgctgcggtagtgtccgcatcgtctcccaggttcgcagccatcagcacggcctcggcaaagctatccgtctggtgcaagcaccacagtgccgcttccagcgaagcgactgcataacctgagccgacaatgtcaacgcaggccttttctcgatagtgcccttgggcaatggctatcacttttggctcggtcaagccggatcggcagcgtcaaaatcacctttgtgcagcaggctctcagccagacagggcgccatggaggtgtcgtcagtccattgaccaggctggagattaaaagggcctgcgccgatcatgccagtaacagcctcaaatgaaccacgcggcataaactcaaccgtggttcctacggcgtcaccgcaggccaggcccagcagacagccacgaaaacgctccgacagagagatgggcatttgtaatcagctcatagataaatcaggtcgcagcactattgcagtcccactctgctcggtatgtaagaggcgactgactaatatgtgtgacgtgcagcactgtagtagctacgaggatagcgtccgccgcaagacaggctgatgacgccaacaccaatgctccgttaacaatcgtgaatgacttccccgcaatcacatccgccacctgactcatcagcctaaggcgtccctgctgttttataacgatatatcaactagttatatattatatttaattttcaaataacactaaatccaatagtcatttataaagacaagcataacaagaaagcagcgaaaacgtgataagcatataacactccaaatcaatggacacgaaggaatgtacacgtatgactatcttggcgaaaaatcttgttagcccattcaccacgtcggcgcaattccgaacaagtgaagattaccaggcactctataatttttcacacacctatgatcgaggaggatttaattccttacaggggaagccgtcttacactattgcgcaggcagcggatgaaataactcgaggaggttactattggggtgacaacgaccacaatgggaaatacaacttcacctacagctttctgacttcagaaagtcaagcattcgcctccgagaatgtgtctggattcagcgcattcaacgctcaacagagatcccaagcagccctttctttccaatcctggtcagacgtcgccaacatttcattcatcgaatccagaagcggaggtgacgcacatatatcgctgggcaattatagtaatgacctgcagcatggtggtgccagatcagcgtttggattctatccaaataacagcggaaatagcgatgcgttgttttataccaatcaaaactatcaagaaaatttaacaccggcaaacggcaattacggtcgtcaaaccttgacccatgaaattggtcacacgcttggactgcagcacccaggttcgtacgacgccagtgtgggtcaaccgtcgtattcggatgcgaaatatgccgaagatacacatgcttactccgtgatgagttactggagcgagagcaacaccaaccagaacttcagtaaaggtggtgtcgaagcctatgctgcgggcccgctgatcgacgacatcgccgcgatccagaagctctacggtgccaactacagcactcgcgccggtgacacgacctacgggttcaactccaataccgggcgtgatttcctcactgccacatccgatgccgacaagctggtgttttcggtatgggacggcggcggcaaagacactctggacttctccggtttcactcaaaaccagaagatcaacctcactgccacctcgttttctgatgtgggcggcctggtgggcaacgtgtcgatcgccaagggcgtcaccatcgagaacgcattcggcggttcgggcaacgacctgatcattggtaaccaggtcgccaacctcatcaaaggcggggccggtaacgacctcatctacggaggtggcggcgcagaccaattgtggggcggcgccggcaacgacacgttcgtgtacggtgccagttccgattccaggccaggcgctgcggacaagatctttgacttcacctcgggctccgacaagatcgacctgtcgggcattaccaagggtgcgggcttgagcttcgtcaatgcgttcaccggccatgccggcgatgccgtgctgaactatgcctcgggtaccaacctgggcaccttggccgtggacttctccgggcacggtgtggcggacttcctcgtcaccaccgtcggccaggcagccgtcagcgacatcgtggcgtgatacaaagcgcggcgcttcgcgcgccgcgctcaatgattggaaaggaactcacgatcaaatactcggttctacccatgcagctgcgccccactattgctgcaatgtgaagcggctgcacttctccctagttgatttcggttacgaaattttcgcgagaccgccgtacttttttcaggtttaccagccagtcagactctgctgcccgataccccaaaggcaggagcaccacactgcgcagatgcctggctcccagtcccagaatctcatcgacagccgatgggtcgaaaccttccatgggcgtcgcatcgacttgctcggatgccgcggcgattaaagccgagccgaggccgatataggcttggcgcgcagccgcttgatagttggcctcctgtccacgctcggcgactataccgaggagcatttgacggtaatcttcccaaccctggttgacggtagctcgtaccgtattggtcaggtcgaacatcatgttgatacgctcaggcgtgatgtcatcccaggcggcgaacaccagcaaatgagagcagtcagtcacctgggactgattccagctgaccgccttaatcttttcgcgaatttgcggattggtcaccaccagcaattcaaatggctggagcccgcttgacgtcgccgtcaggcgtaccgcctccaggattcgctccagcttttcagcaggtattgtcttggacgaatcgtaacttttcgtcgcataacgccaattcagcaactcggttattttgctcattcttcatattccacgtaggtcaaaggtgcttatccagcccaatccgattaccttccggattacgctgcggcttatactgcggattaaagtcaacttgaaggtcaagcaaaaaatgaagataggcgagattgcgcgacgtaccggccttgctgcttcagcaatacgctactacgaggagcaaggcctgctggacgcccccacgcgcgacatgaacaactatcgctattacagcgaatccaccattaagcgcctggaagtcgtgatccacgcgcaaaggctgggtttttccctcgacaccattcgtggccttttccttcatgacgggagctgctccaaatccctcactctggaacagatcaatgtacgtctggaggagatacagcaaatcgaagccacgctaaaagtgcagcgtgaggagttgttgatgctgcaacaaaccctcgaagaaagccttcgtactggcatcacaccgggattggattgcccgcgtggcgctgagcgatcaaggcctgatcgagccgtagtcatgcgaagcaagcacatgatggctgccggcaactgaggaaaacgcgatactgcgggatataaattgctgtaaaacgatcagcaagaaaaaaccccacagcatctgcgaccctgtgaggttttatcgccagctgtaccgatgccgcatcaaaccacgctgatcatctctgcgctcagttgtgccgcattgaaccccaccagggtgacactgctgtcccccgccaaaatcacgctgtcactgccgttctgggtggtggacccgattacagcatcggcgctcgcaaacaacgacttggagaacaccagcagatcatgcccgttctgatggatgttgaagtcgctgatcacgtcgtggccgaacccgcgctgatcaaacaaaaacaaatcgctgcccacgccaccactgagctggtcattgccctgcccgccgatcaaaacatcattaccgctggcgccatacagcgagtcgttacccgtgccgcccagcagcgtgtcgttgccgtcaccgccgtgcagcaggtcatttccggcgccaccgtcgagccgatcgttgccgttctggccgaatatcaggtcgcgtgctgcagtgcctttcagggtgtcggccagttggctaccttcaatagatctggcgtaagccttgtcggcgccgaacaggccatcgaaatccagcttgccgttggtgaccgtataagacggcgtcagcgcctgcccgataccgctgaagatgccaccgataacaggtaactgaccgagcgtgttggcaaggccggtttcgaactcgacatgctctacgccatgcagttctttaaggccgtattggccgctgctatcgttcaaaaacaacgtaccgtcgctcagtttcacggcttcgtaggaggacgccgtacctttgagaaagactttgtcatcgcctgcaccgccagcgacgatatcggtaccggtactgactcggaaactgtcgtcaccactgaacccgtcgaggaaatcatcgctgcgaccatcctgcagcttgtctgcactgtcggtgcccagcaggaaggccggtgtaccgtaatggttggaggtggcggtctgtttgtcgctgacccaggtgaagctgcggctgatcgcgtcgaggttgctgatcacgatggtgctatcgcgctcgatgtaatcgtagaacgtcgactgggcaatgcgctggatggggttgatgaaaataccttcgaggtgcgcagcccatcctgacaagttggcaatggaaaacggaccgttgggccaggttggcagggcgtagatcgtatcgaacagcacgatattgtcggtcgtcgaggtgtaactggcgtcactcccctgaagagcgtcgatgatggcgcttcccacgttggtttcccgcccagtgaggcggtgcaccacatcgttttcaaaaccgaagttgtagattccgtcgctgttgctggacttgggcgactccatgccaaagtagtccgaatccttgaagaaaccgtctgccagcgtgtccttgccgatatacatgctgttagtgactgagccgccctggctgtagccggttaccagcacatccttgccgctcaggttgtggtctatcgcgtaatccttgattgagttgagcaggtactcatagccgttgatatacgagttgtcgatcatggccggccaacccagcagatcagtcagggagttggtgccggcaatggaaaaccccattttcagcaattgaccactgtcatcgtattgaccaaacaccctggcctgggagccgaacacgccatcgccggtgaagcttccggtgatatcggtgtgactgctatcaacgctcagttcattggcgccgatttcacgccagcctttgggcaatgcaaaggtgttgccctcccccagtaccgcccctggaatgttgtagagcgcgcctacggtcgcgacaccgctggtgtaagtggcgaggttccaggcatctgaaatcagcacacgggcatcttgacccttgtaatcgaatatagccatgtcagtactccttgagcccagcgatcaacaccgaagtcgacggtaataactgatacgtcgggctaaacatatgcattgaagttgttattgtgcattctgttcaggctgcttcttttcttaatgtcgactttgaccattaagaaagcttgtcaacattagcgtagaagtacggtggggaagcgaccggttatcggattacaggagcatgttgttaggaatacatacgacataactgccatgagcagtgtttaccgagcgttacggaaatatctgtatgcttcgtgaccgaccggtcaagcggtattggatgtaacgtccagttttgaacagatgcaaatctatttcggagccaaataagcctcagatcaattacagccatggcctagcgatcggaaaatgtccttagcgtttcctcaacagcacgactcagcctatccaggctctcatcatcaacctgaaaaaaagggggcggatttgaatggcacttacttaacattcttcgaatgtccatttctcctgacctcggcccttgccgccgagcgtgtctgcatcagcatcgggtaaggcttgggccttcgttttatggcgcgaggctcaatccgtcccggccggtttccgacacgttttctggcgatcaacttgagtaaatcctgcaccctatcgtcttgttcgtcggagctttactgccgcatcgcaaggaataattgaaggctatgtttaaagctaagctcgcgtggcaagcaatcagctaatagcgctgatttggccatgatcatccgaatcaaattatgcgccagcagatatacccacaactcttttacagccatgccgggcgtcttgcagctcaacgtttcaagccccagcgttgttttgatattgcgcagatccagctcaacatgccaacggtctttgtacagtgatttgagccccgctttggggacttgctgcgggcagttcaaggtggtcaccaggatttttccgccggttttcagctcacgcactgtcagtgtttcaggcgcatcgtcgtaataagtttggctcatccaagaaggtcgattcccaggttttgtcagctcaaccaaatgatcttccggccccagcgattgcccgagccgaaagtcggtactgcgccgcctagcgccatattgttcgaacactccgtcgattccacgacgttgcagttcgcacagcaaaaagtacgttgcgtagtaggcatcgcccaacacaatgtcaccttgattcagagtgtcgagcatcgtcctgagcagcgcctgttcatcgccacctttgcctcgaaagcgtcccagcgaggcatctaaaacagcaccgctggccaagcaaatgattcctaccaaacggcagatgggaaaacccagtcctgctttctcaccatgcgattgtggatagacagcttggttggccgcagtgtctggcagggccaccgtggtgccatctacgaggcgcaacggatgccccatccagcgccaggatggtgacgcgttgttactcatcgttgatcccgcggagcgcaacagcgttgaaaccatctctaccggtaatcgcgcccgtgctttgcaataagcgccggtatacacgctgctggggcttagcccatcgcagcaacgtttgatcgaaaaatcattcacggccttctgacaagaacggtcggcattcatggcttgagccagaaacatcgacagtatttcagtcggcgggaataagcgttgacgatgcttaggaatcactgactcggcacgctgtagcagcgccggatcggcgaacagcttaaagaacgcatgggcattgctgtttttggcgtgctgctgaatgcgctgctgttgatgcctgacgatttgacgtctacgattcatgcgggctgtccttgttccagtggtgtgtgttcgcaactatcaccgcagaccaagagcggccttttttcatttttttgtaatcagatcagccggttagcttttaagtaagtgccattcaaatctgtcaacttttatccacccccttttatccccacgcatctcttatctaactctatccgcttgtcaatggtttgcactatgattttttatgcgctctaagaactcagccatagctagtggatcccgctccactaactcttcaattaaatcttctgctgcccagtgcaaaatcatgtctccttcatctccatctttgcagagaatgagatcacttgacaaagaggagtcaagaacattgacctcactttcactgagtgccatcaacccaccgtaaccatcataaggaatgacccagtaaaagcgctcgttccttatccagtaaatcccaaaaacctgcacaggctcttctcggccaatttctcgaacaatcatgtccacatcactcaatagttcttccgggctgcagcacaggcggcagctgctggggcgtcgtgattttcatatcatatgctttatcggtaacggagttgtattggtagtgaacggttatattttccccgttaggcagccggtgacttgcttccatttttttccatccttcacttcgcggaaaatctttgtcgcctgctaatttcgtatcacgaccagccgagggattatcaatcactctattccacaatgtttgctcattcaaatctcgcggcacagtagactgatagctctttgctgttgaatgagttgcatagttaggaaggccagctgaaaattcatcggccgagttttctcttccatagctatctcgacttactttagacctttcagtaacagcgcttgggctatatggatcatccaccgcagctggtttaccgccactgaactcacccgcatttccatcttttgcacccttacctttacgagcaggcatcgccccaaacaatatactggaaagcagctcaccaccgccaatcagatatttgtcgctgtcatacgtcggattcagctcggtcccttcgatgatttgagcgactttctgtccgacgaacgcattcgctttgtctatgttctccgagatcgcctgccccgcctcggtcccctcaacagccttcatcgcaatgaattgagcaacccctttcgggccttgagccgcggccaatacgtaggctatggcttccacactctcaggatgttcgtttttataagcctgtattgccccaagttgacgaatcaccccttgaagctcgtcaatccctgtcgggttgacttgcgacgtttccagcactagtgcttgagggtcgggtttgtaggtgctcgactcaaccagcttctgcgcgtcggtaagcacctgaggttcgatcccatttaacgacgccacacttctcaagacgctgtcgatgaattcggggtcgcccatcttcgccattgccgatcgagggctcatgccagagagaatgagggcttcaagtgtactttcggccaagtctttcccggctatggcttgcgcacgagcatccatcggacggccctgcatggcttccactcgattgactactgcatgcaatgccccggcagccttgttgaagttatccagcgctgttttatcgtaattgagtagcccgtcagaccattgcttcagcgtttctccaggtttgagtacagcatcaatggacgaactactcgcatacagatccgttcgcttttcatcatccttggtgatctcataggccttacccacatcccggttcaatccggtcgtagagtcagcccccgtctcagcatccttgcgaacgacgatttcacctgcccccaccgtggcgcggacaatctgctcacgctctttctcgtagttccaaccctcaacgctccaaccggtttgaccttccttgcctttgcccgcctggctgctgtcttggacggtgttgcctttgttgtcattgctcccggctttataggtgccacctacgttcaggtagtacccatgctctttgtcttgcccggcgatatcgctgaaaccgagggtgcccgtgtccagtttcaggttgccgttgtcagcggcgatgacggctccgtcgatctgggtatggttctctgttctgatatcgacggcatttttaccggtgatacgggtttgctcttcgacccagtcggttttgccggtggtcttgccaaagccgaccgagccgctgacacccgcacccggaccgatggtggctgtaacactgatatcaaactctttgcccttgaccttgccggtatcggcaaccgacgagaccttgaggtcgccgcccacacgccccaccacttcatcgcctctgaggttcgctccgccgatggcggtgtctttgccactggcaaaccccagacggtcgccggcatagaggtaagcctcttgttggcgttggccttctcgctccaggttacccttgcccatactgacactgacgtagacgccaataccttcagagccaaacgtcaggcctgcttcgccgccgccactgtggcggttgttttcgctgttgctgtcgttatgcgccgaacgaatgttcaaatcgttgccggcattcagctcgatatcccgttgggctttggcctgcgtcccaatcaagttcaggtcattgctggccttgaggttgatatcgcgacctgcctccagttgtgaagccgtagacgagccttgggagctctcgcctgtagccgtgccgaaactgccgccggcgcccaacttgatcccgccgctggtgccgccatgaatgccgccccaactttgggtgtgggtggtttcttcactgataccgcccttggccacgtccaacgtgacgtcacgtcctttgatattgatgtcacgcccggcgtccaggtggcttcccttcaccaatacatcgttgccggcgttaaggtgcagatcgttaccggcgcttagcgtcgaagaccgattggtctgctcgataacctgttggctgttggtttgcttactgttgccaaacttcccgtccagcgttggcccattgacaaactgactgaccgaatcaaccgctttgagtgtgcttgagcctttgctgacattgtcctcgcctttccctgctccgctgacagcgtccttggtattggcatagttatggttgatcgaaacacccaggccgttgctctctttctcgcgtatctgctcggtgagcacactttcgcgcgcagcatcgatattgatatttctgcccgccgtcagctcgatatcattggcagcgcccacgtcagagccacgctggttgatatcacgcttggcgttgatcgccacatcttgcccggcgtttatctggctgccggaagcggtctcgcgttcgactcgattcttctccccactgccttcggtgccggcgaagaggctgatgccattaccgttactggagatgcttgaacccgtctgctttttcttctcccagctacgttcgctactggtgtcttgtgcggcgaccacattgacgtcgcgccctgcatccagattgacattgcgccctgcgctgatgccgctgccaactaggttgatgtcgcgctcagcctgcaacgttgcatcgcgctcggcgcttacatggctgcccacgctggtgctgctctgggcttcacgaccagccttttttgcggacgaaatggcaaccgacgtcggcctttccgtataaccaaacttcttcttgtgttcttcactgcggctataggcggtgtcgttcgcagaaatcaggttgatgtcacccgtactgttgaccagcccggagcgcagttcagtgtcgttatcggcactgatctcactggcccgcacccgcacatcattacccgccgccaccaccacgtcattgccagcctccaactcactgcccacttggctggcagtggtcttcaactggctcttgccgcttttggacagccccaggaacccggacttggtcttcttgctgtaggaaccatgctcctcgacacccgacaacaccgcgatatcaccagtggcgcccagcagcatgtcgccaccagccttcatttggctgccgatcacggtgacgtcacgtccgccgtcgatgctcattccaccgtcggcattcttactggcgttaacggtcaggtctttaccggcttcaacgaccgaggccacgttggtgctgtcgtaactctcccgctgttggcttttgctacgaccgaacgagcccttgctctttttcgagtagaacgaagcgtcttcatccagtgccgacaggatgctcacatcgcgttgtgcatcaagggccacgttgccgcccccggcaattcggctggcggtgagttccaggtctttcccggcattgagcgacacatcgccgccggccgtcagcacgctggaaacctggctgatgtgatccttggactgggtgaccttcttggacttgctcgatgaatgctgttcgtcggcggccgacgaaatgctcaggttttcggtcgtcgtaatgctcaagtcacgcttggcgtcgatgcggctggcaatggcggtgaagtcacgccctgccgacaccttgaggtcacggcctgtctccacgctggcaccgttttgcgtcacggtttcggtgcgcaggcggctgcccagatccaagccgttgcgttgctcaacggcatcgatgtgcacatcgcggccagcgaccaatgtggtgtcacgcccgctttgcagtacgccaccggtattggcgatgtcacgacctgcattcatcgtcaggtcattggcagcctcgatgcgtgacgcgctgtcgagataatcgcggcgctcagcggtgccgttaccggtacgggtcacggcacgttcgttgatcacatcacccttgatcgcggtgagcgtaacgtcgcgtccggcgatgatgccaccggacttgttgacgatgttgttacccgccagcaggtccaggcggttgccggcttcgatcaagccgctgttgatcaggtcgttgcccgctttggctgacaggttgttggtggcgcgcagggtaccggcgttctccaggttttcaccggcgatcaggttcaggtcgttaccggcgatcaaggcaccgttgggcgccaggcgattgtcggcctgggccatatacaacacgggcaccagcaccttctcaccgttcacttcgtgctgttcgagccagacgatgtcgtgggtcagggccgcgacctgctgcgaggtcaaggtaactcccactgccaggttcagttgctgtttgctctggatcgcattgtccatcaggtacttgaacagtttttcgtcagtgttctgaccgtcgataaaacgttgccctgtgcgcgcttgaacggcttgctggatcaaccgttgctcatagaggccgtcgcccaggcgcttggcgctttcgtccgggttgtaacccaggcccgcgagcagatagtccgagctcatgaactgcttgaggtccgtgagtaccgggttggtttcgatcaggtatttatgcggctgggacttaggcgcggtgggcgtaaagccctgcacccggttgatggtctggctggcgaccgtagtggtttgctccgctgtattgagcggctgggcaatcacggctgcgatctgggtcgggctgctgcccgggtcttgtgcagccggtgtgctcacaaccggcgtcacgcctagtatcaccggcgtcacgccaggaatgttcaacgtcggcagcgcaggagcgtctggcgtagcgacctgaacacccgtatctcgaccagtcagcgccaagtctggcagatcactcggcccggtgaccttggccactggtgcagtggagccggtggacggactccgggcgttgatgccatcgccccgagcgattccagcgggggtgatctggctgggcgcccagccgctgccgctggccacatcgccggccccggcaacgttaagcgttcggctggtggcggtgatgccactgacctgacgtgcggtgggatccaactgatgggtagacgcgtcctggtgggcgacattcttgaagtcgaaggtgcgtgtttcaagcgctggctgtgcgccctggcgctgagcgaggccgagcgtggcaccacccatggtccagctctgcgggccactggtggcttgggtggcttgagtgtcttcgctcgcttgactactgaggcggaacagaccgtgggtgccggtgggcaaggtgaagccgcgtaatgtcagcgggttgacttgttgttgtgccaggtccggtggcaactgcggagcgagctgcaccaccacggttgttggaccgctggcgacacccgtgtcctcattgcgcggcgcgcgcccggccaaggctgtgttggacgtctcaatgctgttgatcaaggtcttgctggcggtgatgttcaccgtgcctgcagcctggatgatcgccggtgccagtgacgcgccagcggtcgataccaaggtatcgccaatcagcctgaacgctgacaacgcactgaccggcaggtttttggggcctggctgagcgttgtaggggtccatgacaccacgtttgaagcgccagtaagtaccgttagtcgcttccagccgccaggtacgggtacgcgttccggagccagacgcagcgcctttgttggtcagcgtatccgcagcgatgttcatgtcggcgccagaagcgataacactgtattcattgagcagcgtattagcggcaatatccatgcgcccgcccgactggatagtcgaagtagccgatgtcttcagtaactcggtttgatagttttccgtgccgacaaagtcgacaacaaagtgatcgcctcggcagtcccaacaaatattggtgagtgacccgccgctaccggcggtgtctttcgtggtgaactcatcccggcggttagtcaggctggcaacctttagagacatgtcacgactggattcgatgctgccggatacgttttcgagactggctgctttgctcgcaccctctcgactggccacatccagtcgccccaggctatagatgtcaccgtactggttagtgattgtgtcgctatgcaaggccatgtcgttgccgctgaacagcaaaccatgatcgttcaacaaggctgcactggttactgtcacattctgtgcgccacccaatgtcccgtagttgttcagcgtacctgccgagagttcgaggttggtcgcagaggtcaaccgtccatagttgttcaattgaccatcaatgttgacctgggtatcgccaccgccagtaattttggcgctattgctcagatccaactgactcgcatgcaggttcagaccactctgactggtgactcgcccatcaccgctataagcgcccgcaaggtcgatacttaaactgccatcactggcaatcaagccattattgacccagctgccgcccttgccttccaggtgcgtcgaagccagcagttgcccggtttcagtctgggtgaagttgttgacgttgacgttcaaacgccctgcctgaatgacgctggtattggtccaggtgtccgcgttcagggtcaggccaccacgggtgacaagggtgccgcccgcaccggtgacgttaggcaacgagatgtcgaaggtgccctcacccacgtgtagcaattgcccgccgttgttctggaagctggcagccgccagggtcaggtcctggttggcggtttccacggcgccgttacggttgtcgaacacgccgccgatctggaactcggtcttgccggagcgtcccagggcgcgcaatttgccgccctggttatcgatggcgttggcggccacggtcaggttgttggtgctttcgatcaggccattgtggttggtcagttggccattgaggccgagcgcgatctggtcaccggcaatctgacctgcgctgttttccacggcgccgccattgatgcgcatgagggctttggcatacaaagcgccctgctggttattgagggttgcagccgtcagcagcgcatcgctggtctgtgctcccacatagccgccctggttatcaaggtgaccggcactgagtaacagccgctgaccctgaatcaagccgccattggggttgccgctcaggtcatgaccgttgcgcagcacacccaccacaccggcctcaatggcccccttgagactggcgagcacaccgctgcggttgtcgagattgccggccttgagatacacatcaccggtctggctgatgatattgccgccctggttatcgagatcaccattgacctcgacccgcaagccgttctgcccctgcagcttgccctgcgcgttggtcaggccaaaagcggtgatttgcaggtcgccttcctggctgtagatcaagccgtcggcgttgttttgaacgatagcgctggcatcgataaccaacggacctttagcggcaacagtgccgccctggctgttgttcaggccgcccatagccaatgacagacgcccctggctggcaagttggccaccgcggttgtccacctctatggcgcgctggagcagcagcgagccggtgcctgcgattttgccgttgacgttgccgaggtggccttgcaggttgagtaccagctggtcattacccatcagcgacccagcggtattgagcaagtcgccagccgagacgttcaagttgcgctgggccgtgacgttgccggcactgttgtcgaggttggccgcactcacgtccagcgtcgcaccactgtcgatcaagccaccctgggtgttgttcaacgcgccaagcaccgtcaaggtctgctgcgtgccgctggaaataacgcccttttcgctgttgtccaggctggcggcactgacactcagccgcccttggctggccagcgcgccttcgttgctgttgagcaagcgcccaccgaggcgtacatccagatcaccgttgcgactggacagcgtgcctttgtcacggttgtccaactgggtgccgatcaggttgagcccttgccagcccgacagcaagccgccgcgattgacaacgtcgcctgcgttcagcgtcagcagttgctggctgatgagcgtaccggcgctgttgtccaagttacgcagcgtcaagctcagggtattttggctggacagttcgccgccctggttttgcaggtcgcgtacatgtttgagggtcaacgggcctttggcgaagatcagacctttacggttatccagatccccgttggccaggtccacgctcaagttctgctcgccgatcagcctgccgccacgcagggccatggacgtcagcgtaaggtccatatcgcccctggccgacacctcgccgccgtcactggcgtccagggcctgggcattcagctctagacggccctggctgttgatcaagcctttggcactgttgtccaaggccgaagcattaatggtcagggcgctggtgcccagcaggctgccgccctggttattgaggttccccgctttgactgtcagtgcttgtgcagcgttgatcaaaccttgttgcccgttgctcagcagcccggtgctggtcaattcaagcgccccgcgactggtcagcgtaccgccgctgttatcgacgacacccgcctgagcggtcaggctcgctgccgcgactaaacccttgatgttgccgagcacctggtcgattcgcagtgtcaggccctggttgctgagcaggcggccattgctgttatccaggttgcgcgccacaagcgcaaacgcctgaccgctggagatttcaccggcctggttgttcacaccattaaggtggttgagcaccagcggcccggtcgcgttgatcaggccctgctggttgttaagctggccgttgttcaggtccagcgtgaggccggcgttgctgaacagcttgccaccttgttgatcaagtccatcgacgctggcggtcagggcctgggcgctgccgatgttgccggcgctgttattcagtagcccagccttcagctccagggtgtcgccgctgatgagacgcccacccgtattgtccaacgcgccggtgttgacccccaccgcccctttgccactgagcagaccgttctggttccccaggctggcgctgcgcagttgcagcgtgctgtcagtcacgagctcaccgccctcgttgtccagggtcccctgcgaacccagcaccaacgcgtcggcgctggaaatccgcccctgacggttgactacgctcgccgcatcgacgctcaggcccccctcactgttgaggacgccctggctgttattcaactcacccttgagctcaagttgcagaagctgttgagcgagcagtttgcccgtgctgttgtccaggtcctgagcgctcagcatcaaacgctgtgtgttgagctggccttggttgcggttaagcagcttggtcagcgtgaggttcaacgattgcccggccagcacacgaccggcatcgctgttatccagggtttgcccgatgacggtcaggtcggcgttagtcgacagttcgccgccacggttgtcgagccgatcgaccagcagtttcagcgctttatcggcgcccatcaggcctttgcggttgtccagggacgcagcgcgcacttccactgctgcagtgctgataagttgaccgtcgcggttatcgatctgatcgatatcagcggtcaccaatgccttgcccgatacgtcaccgccacggttgtcgagccgagcggaagacagccgcatggcgccgtcggcaatcagcgttccgcgctggttatcaagcgtttgggtggcagatacttccatgccgccacgactgttgagcaggccatcagtgttgtccaagcgggcactgttggtgttgagcgaggctgcgctgatcgcacctttggcgttgcccaaggcctcttgaatctgcagtgtcaggccttggttactgatcagcttaccgccgctgttgtccaggttgcgcgccgccagggcaaaggcttgctggctggaaatttcgccacgctggttgttcacatcggcgaggtttttcagcatcagcagcgggctgttgatcaggccgcccacattgctcagttggccgtgattcaggtcaagatcgagctgggtgttgctgaacagctcaccgccttgctgattcaggccggtgatcgtggcggtaaggttttggctgctggcgatacgtccgctgttgtccacctgggttgctgccagatccaggcgatcggcgctggtgatgcgcccatggttgttaagtgcgccggtgctcagggtcagcgcaccacggctgttgagcaggcctttggggccgttgtccagcctcgcgctggtcaggtcaaggctggcatcggtctccatgatgccgccctggttggtgatagcaccgctggcagcaagtgtgagcgcacccgccgaagagattgcacccgcgtcgttgttgagcgtcgcgccggccagctgcagtgtgccttcgctgctgattttcccctgctggttatccagtcgcccatccaactcagtgccgggaatggctaccagcgacaggctcaccgattgctggcctgcgaaagtgccttggccgttatccaggcgcgcgccgttgaaacggttgtcccgggcgaagatcaaccctttggctttgtttactacatgggccacggccaattccaatgcggtaccggcaatcagtttgcccgcgctgttatccaggcgctgcgccttgaagtcgatgctgttctgactggaaatctcgcccgcacggttatcaacggtgtcgacagccagtttcagcgcttttgtggcgccgactaaaccaccatcgctattgtccagtgaggtcccgctcaggctcagctcgttttgggcaaccagttcgccgccctgttgggccagtacgccgatggttgcctgcagatcactctgactggcgatgcggccagccgcgttttgtactgtgtcggcagtcagtcgcaggggcccgaccgcactcaccaggcccttctggttgtgcaactgttgcccggaaaagcccaaggccgccttgctgctgagcgtaccttgttgattgtccaactcacccacattgagttgaagctccttctgggaaaggatcacaccgccgcggttgtcgacattcgcactgtgcaaagtcaacagatcctgcccggttagccgcccttcacggttatccaaacgaccggcacgcagctccattgcgcccttggctaacacctgccccttagcctgattgtccagtaacccatcaatcgtggccttgagttggccgtcactgcccaattttccagcctggcggttatccaggcttgcggcctgcacgtccaacgaggtaccggcagcgagtgtgccagcctgattattcagcgcacccttgacctttacctccaggccgacatcaccgagcacttgcccggcggtgttgctcaagcttgccgcattcaactgcgtgtggcctgtgctgacaatttcgccctgatcgttaagcaggtcctccttgaccgccaggcgtgcgtccagggcgctgctcaccctgccctcgcggttgtccaggcgcgaggcatcgagcccgacacctgcggctgaaatcagccctttgacgttcagcagcgcctgttcgattttgagggtcaagccttggtcgctgagtaagttgcccccgctgttgtccagggtgtcggcgctcaaggtgaaggcctttgcgctggagatttcaccgttacggttgtcgacgcttttcaggtttttgagcaacaactgccctggggcattgataaagccatcggcgttgttcaagtgcccatggttcatgtccagaatcagttcgccgttgctgtaaaattcgccggcaccgcgctggtcaaggctggtgatgctggcgttgagcgcctgaccactggcgatgcggccctcgaaacggttgtctacgtcggtcgctgtcaggttaaggcgatcagcgctggtgacgcggccctgatgctgattaagcaatacgccggtagtcagttgcagtgcaccatcagcaacaatacgccctgcgctgttgtcgacactgccagctttcaccgtcgtagtatccgcgctgagcacatcaccgttctggttactgatcgcattggctgcggtcaacaagagcgccccgccgctgctgatacgcccgccgttgttgccaaggctggcgctgcgcagttgcaaggcggcgtcgctgcgcactacgccttggctgttgtcagcctgctgggccagggtcatatccaggttgcgtttggcgtagagactgccttgggcgctgttatccaggctgatcgccttcaggttgacatcctgttgggcagaaatcaggcctttgagctgattgttcagcctgtcgagcgtcaactggagcgtgctattggccagtacgcgaccgacattgctgttgtccagctcatggccagtcagcgtcagttcggtaacgctggaaacttcacctcctcggttatccagcttgccgatggacaggctcatggccttgcccgagttgagcaacccggcctgacggttatccaggtggtcacccttgacctgcaactgcccgaccgaggtgatgctgccaccgcggttatccacgttccccaccacaagctgcgcatcccccttgctggtgaggcggcccttggactggttgtccaggctggcggcattgagtgtcaatgcttggccggcggcaaacagcccggcctgattcaacaaactggctgaaatctgcgccgtcagtgtcccgtcactggtcagcttgccggcggtgttatcgaggctggcggcattgaccgtcaatgcctgacctgcggccaacgtgcccttgccattattgaccgtgccgaggcttgtcaaggtcaagcggttatcgccctgaatgcgcccctgactgttgtccagcgcagccgctttgactgtcaaatgctgaccaagcagttcgccagtgcggttatccagcgcaccctccacaccgaggttcagaacggaagcggcactcaacttgccgccctggttgcccaggctggcgctgtttacctgcaaggccgcggcagaaatcaggccgcgggtgttatccagtgcctgggcgatacgcagggtcaaggcttgttggctgagtatcttgccgtccgccgtgttcaaagcggttgccgccagctcaaaggccttggcactggagatttcaccgccttggttatcaacgctgcccagttgcttgagcagcaactgcccaggtgcattgatcaaaccagcgttattgttgaggtggccaccttgcaggtccaggcttacatcggcttggcttgcgacatgcccgttacgactgttgtccagttcggtagccgtcatgcccaactgagtcgcactgcttagatgtccgccttggttgctcagcttgccagtcgcaatcttcaagtcgccagcactggatagcgttgcgtcgtcgttggttaaaccggaggtattgagggccaaacgaccatcgctgcgcagcgtgccttgggcgttattcaattggccgccaacagcgatccccatctggtgtctggcgtacaggctaccgcccgcgctgttatctactccttgtgcgctgatctgtacctgcgcagcggcaatacgccctttgagcgaattgttcaggtcagcaacgtccagctgcaagtcggtaccggcactcaacagtcccgcttgattgagcatgttcccggctatacgcgcggtcagtgcaccgtcgctggtcaggttgccttgacggttgtccaggccggtgctgttgacggtcacgctttgcccggcagccaatgtgccggcgtggttgctgatcgtgccacccgcctggagcagcaacgttgcatcaccctgcaccaggccctggtcgttattgagcgaaccaatcccgagcacgaggttcttgcctagcacctgtgcgctgcgattatccagctcgccatcgacttgcaggttgaggccctccaccgcagtgagtcggccgaattggttaatcagtgttcccgcttgaacatccagggctttggcggttaacacacctttggtgttgtccagggcgcgggcgatgcgcacgctcaaggcttgctcgctgagcaacttgccggcgccgttattgagttgatccgcgaccagatcgaaggtctgggcactggaaatctcgccgccctggttatcgacgctgctgagttgagtcagcagcaaatggccaggggagttgatcaagccgccctggttgttcaggtgaccccgattgaggttcaggctcagatcgccttgactgaagagttgcccgccactgctgttgtccaggctgcccacggtcaactgtgcgcccgcgtcggcactgaaactcccgctgtgattggcgagcaagccacccacccgggcgtcaagccgatcacggctgtgaacttgaccgcgctggtcgttgatcaaactggcaacatctatatccaggccgctggctgcaatcagccctgccccgttgttcagcgtctgcacgattttcaggcccaaggcctggtcactgagcagcttgccaacgcggttgtccaggctgtttgccgcgacggtaaaaccatgggcactggaaatttcgccgctgcggttgtcgacgctattgagattattcaacctcagctggccaccggcgttgatcaagccaccgtcgcggttgtcgaggtggccgttgcccaggtccagggttacgtcgccattgctgtaaattcgcccctggccatgcaggtcgaggctggtgacacgggcattgagcgctttggcgctggtaatcgagccaccttggctgttatcgagcgaaccggtcgccagctccagggcgccgccactgacgaatacaccgcgttgctggttattgaggtttccagcgctgacctgcgtcgcagtaccagactcgattcgaccctgctgctgattctccagggtaccggcaatatccagccccaggctgccctgactgctcgcgataccggactggcggttatccagctgcccggcattaatctgcagatgctgcccggcaaccaggcgaccaccttgattgttaaccaggctactggcagtcaagcgcagtgcctggccggcggaaatcagcccggcgacgttatccaggctatcgacctgcaaggtgacttcggccaggctcgagagctcgcctttgcgattgaccaactgcccgatgcgaccgctgagcccgcggtcgccaaccaccaggcctgcatcagcattgagcaactgcccggcattcaactcgatgcgtgcagcactcaacatgcggccttgctgttggttatcgaccttttcagcactcatctttagctggttttgtgcactcagggtgccgccccggttgtcgagagtgccatcaaccttgacggagaggtcacggctggcgatgacggtcttgccgttgttacgcaactgggcggcagtgacgtggatatcaccctgagcattgcgcgtctgatcagcgttgacgccggcttcgatgacgccgttgttggtcagcaccccaccactttgcagggccacacgatcacgcgccgccaggtttttttgattgatcaggtcgccttgcgttttcatctcgagcacgctgcccgccgcgaccacaccctgggcctcaacgctgtgggccttcacgttgatggcgccggctgccgttgtctggcccatgaccacattgccaccggcatcgatctgaatatcgccgccagcgaccatgtccccggacaacctcacgccgacacccgactcagtccccataagcttgaccgcgcccacatacatgccgcccaacgccgacgagtcgatcgccagatccggcgcctggctgccatctgcggcccgcgcggtggcattcaaggtgcgtgcgtccacgtcattacgaccggcgacgatggtgagttttttggcctgaatctgcgcgttgatcgtggtggcgcgggtgatgatttcgaactgatcgacgttgctggcattcaggccagcgccctcgatagccacactgccctggtcgacttgataacgattgatctggccgttttcgatcacggctttaccagtggtgagcgtcgcttgcggggtattgataaagccgcaaccgttacagctgatgccgtatgggttagcgacgatcacatgggccgattgcccggctacttcggtgtagccgcgcagttggctggggctggcgccgttgacttcgttgagaatgatattggcagcggtgccgttgagattggggttgccgacgatgatgccgcccagttgcgtggactgggtgcggtcggtggcgttgttgagaatgaccccattggcaccgacgttgtagtcatgaaattggttgtgcgagagcccgttggcattcggcgtggcgatgttgacgatgggcacgccattgcccgcttgcccgagcgtcgtacctggagcattcaccacaatgccgtctgcctgagccagcaatggatgccagaacatggcgttggccaggatcaacgccaacccacgtttaggcagccccaggaaatgggcacggctttttacggcagcagaaggctggcgcgcgaggaatgcgtactggcgaacgtccatgtcatgtctcaaagcccgagggcggtcaaaaatttaaaggaaaaaatccacacggaaatagatcggcgcttcacggtccgtgatcgcttccggtcgttccaaagagtgtgcaaaggtcacgctggccgcgacgttcttaccgcgcgcaaacaactccaccgagttgctgctcatgcgcccgtgctgctcagcgttatagcggccgtggctgatcacgccctggtcgtagccgaggctggtgccgtattcagtgaacactggctgcatccaggcccaagtcaccggccggctccagcgcaggtcattgcgccaatagccgccgctgtcgcccgccagcatttggtctttgtagccacgaatcgacgattgtccacccaggctcatgcgctgtgggctgaacaacacgtcttcgctgtgctggccggtcatcaaactgctgaagctgagggactcgccccaaagtctgaacgggtacagatagctcagcgtggcggtgtatttgcggtagcgcgcatcggcctggccaggctttgggtggtgattggcctgggcgtcgaatgcgccgatgccgttttgcatgccaaggtcaatattgaggaatgagccgccgatacgccgaccgtggttgatacccaattgcgcttcactgaggcggttgctgctcaaggccagcttgctgtcttcgatgaagttgttggtacgaagataggcaatgccagtgttcagggatgtcttgctcaaagcgtcacgatggataacccgttccaggcgcaactgatgattctggctgtcgccggtctgcttgaacttgaagttgttggcctgggcctgggagcgatactcagtttcgatgtagctgtacgagaggttccaccagccaaatggaacgctgtagctgagcatcgaattgcgtgaggtgcgttgatgatcgctgacggcatcgtggccgccacgcagcgaaagctgatcggccaggccgagcgggttatcccagtcaagactggcgccccactgctgctcaccggtgctgcgctggccgccgttatgccgcgacagacctacacgccagggcttttgcggggtgtttttgaccagtacatcgctgccacccacggctttgcccggcgccagctccatctgcgcctggttcgacggcaagcgattcaactgatcgaccatctgctcgatttcgcgcagattgagcagttcgccctgcttgccggggaaactcatggccaactggcggtcggtgatgccactgccttcggcgcccttcaggctttccagccggccttcgaccacctggatcttgaggttgccgctggaaaggtcctgctgaagcaggtaggcacgactggtaaccaggcctttggccaaatagcggtcggtgatgaccttgagcacttcgttgagctgcggtacgcccaggcattggccgatatagggcttgataagacccgtgcgctcaccttcggtcagcgcatcagcaccacccagttcgatggttttgatcgggaagcagcgggtgtcgacaggcgcgaccggtgcagcaggcgccgcggactttccaggcaggtccttgagctcttcgatccgccgttgttgatcctcaagcaggcggtcctggcgatcccggatcaggtcggtgatgcctggcgcgttctgcggcgtggcggcgtgcgcccctccaacaatgcccaggcaaaaaaagcggacagcaggctgaacccggtccgacgctgtaaacgccacattctctagatccctctatgtggccttaagccaccaatggagggcgatcataggatgtcattttgatggcgtcaattaagcgtgtaagtttgtttgatctctaacactcggcgaatcacgctgaaaagtatgactttttcgtctgcacactcatcatcggccacgggcattcaagcgtattttgcgtgacacccgtttgacctcaggaagaaaaaacctcagcgccttgacgtgccggctggtgatatcgaggcatttgctgcctgaccaattgcgcctgaacccccgccaccgcatcgagcactctctgcgcccactgctcatcctgcgggtcaaccacgaccacacgaaagccatgatcgtgaccttcaatgcgcacgccctcggagtcatccacgtgcaaatcaatatcgaaagccggcgggaatttcgacggtgtattggccagcccgtgcgcactgagggcgtcgttatgcagggtgctatttaccaccccgtcaacgcggatgccgtacagcatcaaccaacgcctgatataagaaggtgcccgaccggacgaggtgtacacccagatactgcaaccctggcgccgcagctcgcgggtcagggaacgggtgccgatacgcagcggctcgccccaccagcgatggacgcaggctggtagccagctgctctccacggcggagtgatggagctggcaggccagggtgtcgtcgatatcaaacgagatccgtacctgcgggcgcgtgaacgcgcgcgtggacagggctcgtacgactcggcgggcggacgttcggcatttgcccgcgagtgttggataccaacgcatcagtggcctcctccatagatgggctgcggtgtgtcgctcaaaaaaaacacctttggatcaggggcctgttcctccaggaaagccgcgtattttttcttgatcttgggcaattcatacaacgccttgacgccatgcttggccgagttgcggatcaccgaggatgggttgaaatagccctcggcattttccagtgtcagcacgaagggtggtaaaccggagcgcatcagcaggtagctgacgatcagcgagccgctgcggttgttaccttcgataaacaactgcggcttgctgaggatacgtacatagacacccgccgcccgcttccagacggactcactgcgatacgcacaataccaattgaacaagtccttgatgccgccttcaacgttgttgaagaagtgctcctcggtcgcggccaggtgctgggcgtattccacccgacgcgccgggtctcgaccgcacaggaccgtggcattgatctccagcatcaagtccagatgatgaagatcaaacaggtcgacaccccgggccacatagtcgtcaatcagcgcgtaaccctcaagcacattgagcagcacttcgtcggtcaaggggtcacgcggctcggtaaattgcgtgctgagctcggcgaagcggccctgcactttacgcagggcgcgttcaatcgctgacaaatcaagacgatgggttacaggcattgatattcccgggaagacgttggcacaggtaccgcctttatcgaacatggatggctcagctgaacttaccgctgatgtaatcctcggtcattttttcccgtgggttgccgaacacctgggtggtcgggcccatctctaccagatagccagtgcgcgtgccctgggaaatatccaccgagaaaaacgccgtggtatccgccacgcggatggcctgctgcatgttgtgggtcaccagggcgatggtgtagtccttcttcaactccaccatcagctcttcgacccggcgggtcgcaatcgggtcgagtgccgagcaaggctcatcgagcagcagcacttccggctcggtggcgatcgcacgggcaatacacaaacgttgctgctgaccgccggaaagcgacaggccgctgaccttgagcttgtccttgacctcgtcccacagcgccgcaccctgcaaggcgtgcttgacgcgatcgcccaggtcgcccttgtagcggttcaggcgcaggccgaacgcaacgttgtcgaagatgctcatggaaaacgggttgggctgctggaacaccatgccgatgtagcggcgtaccaccaccggatcgacgcccttgccatacacgtcttggccgagaaaatgcacatggccttcgaaacgaaagcccttcaccaaatcgttcatgcggttgaggctgcgcagcacggtacttttgccgcagcccgacgggccgatgaaaccggtgatcttgtttttttcaatcggaacatggctgtcacgcaccgccatgaagttgccgtagaagatcctgtccagcttgcagtccatgaccacaggcgactgggtgacaaacggagcggctacttgcgcagttgatacgttcaaattcagatgctcccgttcttaatacttgggcttgccgaagatacggctgacgatattgacgaccagcacgatcatcaccaacaccaacgaggccgcccaggcgagctcgagttggttgtcgaagggcatgccggagaagttgtagatcagcaccgcaagggaggcggtcgggttcatcaccgacaggtcgccgtcgtggaagatccagtagttgctgaacagcgcggtaaacaacagcggcgcggtttcgcccgcagcgcgtgccacggcgagcatcacgccggtgaggatcgccggcaggccggtgggcaagatgattttccagatcacctgggaacgggtgcagcccatgccgtaggcggcgtccttcatgaccttgggcaccatgcgcatcgactcttcagcggtcagcacaacgatcggcagcatcaataccgccaatgccacaccacctgcgggtgccgaataggtgccggtagtcatcaccaccagcgcataggcaaacaccccggccaggatcgacggcaggcccgtgagcatcttggcggcaaagcgtgcggtgttcgccagcttgctgtccggtcccaattcggccaggaagatcgcggccaggatgccgaccggcaccgcgatagcggcagcgatgccgaccatcacaaaggtaccggccatcgcgttaccgaaaccgccgccggtctcgaagccggtgggcggcagttcggtgaacacctccagactcaagcgtgcgccgccacgggtgatcagcatgtagagcacggaaatcagcggcacactggcgagcagcgcgccaagccacaccagcgtagtcaacaccaggctacgcagtgcacgcccttcgaatttgcgttgcaggctcggcaccgcggttataggggacgtgaggttagtcattgtttagtaccccgctgagcgtagagcatgatcatggagccgataacgttcaccagcagcgtgatgaacatcagcacgagggcggcgtacatcaacacctcgatctcgttgggcccggcttcggggaagttcagtgccaacaaggcggccagggtattggccggcgcgaacagcgaaagtgaaatgttgttggcgttgcccaccagcatcgccagcgccatggtttcgcccagtgcgcggcccaggccgagtaccagggaaccgaagataccggtggcggcggatggcaccatcactttgagaatcgcttcccagtgggtggtgcccatgccataggcggcctgtttggttttcatcggcacgctggtcagcgcgtcctgggacacggcggcaatcgtcggcagaatcatgatcgccaataccagcgccgccggcagcaacccgggcccgctcaacgaggtgccgaaaaacggtatccagcccagctcgctgttcaaccaggtggtcaggggccggatcgccgggatcaccacgtagatgccccacaggccatacaccacgctggggatggccgcgagcaattcgacgatggtacgaaataccgcggccagcttcgccggcaggaaatcctgggtcaggaaaatcgccatactgactccgaaggcgcctgcaatcagcagcgcaatcagggcgctgtagagcgtgccccaaatggccggaagaatgccgtacttgccttggttaacgtcccagacactgccaagcagcacgtcgaagccgtgcttttccatgcctggaagggccttgcgtcccacctcgaataccagggcgacgaccaacgccagaatcagcaccaccccgattttcgcaagcgcacggaaggtgcggtctaccaggaaatcctttgccgagggaggttggcaggcagagtccgggttaaccggtacgacgaaaggtttgatcattggtcaattccggaacaaagggggaaacgctcccggcatggctggcagcacacaccgggagcggccgcacgggtattactggatgttggcggaggctttgcgcacctgatcgaccaccgattgcggcagcgggatgtaacccatcgagtcggcgattttctgcccttcggtcaggctgtattcgaccatttcgcgcatggccttggccttggccgggttaccgttatccttgcggaagatcatccaggtgtaggaagtgatcgggtaggacttggcaccgtccggatccggcaaccaggccaccaggctctccggcatcttcaccgcggccagggcctcggcaccgctttcggcgttcggcaccacatactggccggccttgttctgcaactgggcaaagtcaaccttggccagcttggcgaagccgtattcgatgtagccgatagcgcccggcgtctggcgcacggtggcggtcacgccgtcgttcttaggcgacttgataaacttgtcgctggccggccagttaacggtgttgccctcccccagcgcctgcttgaactcagggttgatggtcgccaggtgcttggtgaagaccgccgtggtgccgctggagtccgcacgtaccaccacggtgatcggcgtatcggtcagcttcaggtccgggttggcggccacgatctgtgggtcattccacttggtgatcttgcccaggaagatattggagtaaacctcgcgtggcagcttgagccccttgggattgcccggcaggttataggccagcacgatttcgcccgcggtcatcggcagcaactgcacgccttcggccaccttggcgatgtcttcgtctttcatggccgagtcactggcggcgaaatcgacggttttgttcaggaagtcctgcacaccggcgccgctgcccttggattggtagtccacggtgacgccagcggtcttcttgctgaaatccttgaaccaggtgaggtagatcggtgcagggaagctggcgccggaaccggtgaggcgcacgttctcggcggcaaaggtcatggaggaggcacaaagagaaaccgtaacggccagtgctgcagacttcatcaagcttttcattaaaaggaactcgttgtggtgacgggctcccgaactgtgcagcagggttgttacatttttatgaaaattgagtggcaaaccggggttttgtcccggtttgccactacagccctatatttttagtgcattggttagtaacaaaatgcgaccaaaatgctcggatcctccagcgccttaatggtagccatcgccaatcctcactttgccgcgaaatacgtagtagctccagcaggtgtacatcaggatgatcggcaggatgaacagcgtgccaatcaggatgaacaactggctagagggcggcgatgcagcgtcccacaagctgatggatggcggcacaatgttcggccagatgctgaaggccaggccgatataccccagaaataccaggaccagggtgaatacgaacggccagtgcgagtggtgttggcgtaaagtcttcaacagccccaccagtgccagtacgcccagcagcatcaggccgccgaacaccacaatgtgcgcctgggcaaaccagcgcagggcgatttccgggtgcagccacggcgtccacacacacagcactgccaccaccgccatcagcgcgaaggccaggtaacggctgaacaggcgcatgcgcgattcgagcatgccttcggtcttgaccagcaaccaggtgctgcccagcaacgcatacgccaccaccagcccgaccccgcagaacaacgggaacggcgacatccaatcaagattgcccccggcaaactggcgattgaccacaggaatgccggcgatgtaggtgccgatcaccacgccctggcagaaagtcgccaggaacgagccgccgataaacgccatgtcccagatatgccgcttctgcgggctggccttgaagcggaactcaaacgccacgccacgaaagatcagcccggccagcatgaacatcaacggcaggtacaacgcctccaggatcactgagtacgccagcggaaacgccccatacaacgccgcgccgcccagcaccaaccacgtctcgttaccgtcccacaccggcgccacggtgttcatcatcacgtcgcgttcctgctcgtccgggatcagcggaaacaggatgcccaagcccaaatcgaaaccatccatgatcacgtacatcatcaccccgaaggcaatgattacgccccagatcaacgacaggtctataccttgaatgcccatgtgcaatccccttgatcagttggtgtggtcgccggacgcgagcgtctcggtgacggcggacagggggcggcgtggtgtacgctcctggccggggccgccctgtggcggatggtcgtgatggggctgcgggcctttgcgcaccaacttcatcatgtagccgatacccacggcgaatacagagaagtagatgagcacaaacaacgccagggagatgctcaattgcgtaacgctgtgattggacgccgcgtctgcggtgcgcatcagcccgtagaccacccacggctggcgccctacttcggtggtgatccagccggccagcatggcgatcagcccggccggccccatgaacaacaccaggcgcaggaacaggcgattgcgatacagcgcgccgttacgccgcaaggcgaagcccagcaagccagtaaggatcatcaacatgcccagtccggccatgatgcggaagctgaaaaagatgatggtcgagttcggccggtcccccttggggaagctcttgagcgccgggatctgtttgtccaggctgtgggtgaggatcaggctacccaggtacggcacttcgattgcaaagcgggtcttctcggcctgcatgtcagggatgccaaacaacaccagcggcgtcgcaccatcgccgacgttttcccagtgcccctcaatggcggcaattttcgccggctgatgctccagagtattaaggccatgggcatcacccacgattgcctggatcggcgccacgatcagcgccatccacatggccatcgagagcattttgcgcaccgccggcgtgtcgttgttacgcagcaggtgccaggccgccgatgagccgacaaagaacgcagtggcaacgaacgcggcaatcgccatgtgcgccaggcggaacgggaatgacgggttgaacacgatagcgaaccagtccagcggcatcacccggccatcgacgatggagaagccttgaggcgtttgcatccagctgttggacgccaggatccagaacgtcgagatcaacgtaccgatggcgaccattaccgtggaaaagaagtgcaggcctcgccctacccggttccagccaaacagcatgaccccgaggaagcccgcctccaggaagaacgccgtcagcacctcataggtgagcaacggtccggtgatgctgccggcaaagtccgagaagcggctccagttggtgccgaactcgtaggccatgaccaggcccgagaccacgcccatgccaaagttgacggcgaagattttcgaccagaagtgatacaggtccttgtagaccgcgttgttggttttcagccacaagccttcgagcaccgccaggaaactggccaggccgatggtgatggcggggaaaataatgtgaaacgagaccgtgaaggcgaattgaattcgcgcaagatccagcgcctcgagatttaacatggcaatacccttatggaaacttgatgcgcacgcgcacctagcccggcgtgcctcaggcctcgtggcctggggcaaacggatgtgcagtgatcagggaaacccagggcgccgtaatggccgccccggtacggctcaagcgccgtgggactggatcagattgctggccggcgcgggttcaagccggatggcgatgaacttcgacgtcggggtaaaggtgcggtcgccatagctttccagcggcaccaatgggttggtttcggggtaataggcggcggcctgcccggcgggaatgtcataggcgatcaaggtgaagccgctgacccgacgctcacggccatcgccccacagcgagaccatgtcgactttctgccccggctcgtagcccagcttgcggatgtcctgttcattgacgaacaccacatcgcgcatgccatagacgccgcgataacggtcatcgagcccgtacagggtggtgttgtactggtcatgggaacgcatggtctgcaggatcagctccggcttgacgtccaggttgcgcacgccttcgctgaccaggtgcgccggcaacacgctggagacaaactgggctttgccggtgtcggttttccagatgcgtcgcgctgcgtcgttgcccaggtggaaaccgcccgggtgcagcagtttggtgttgaagtccttgaagccgggaatggtgtcggcaatcaggtcgcggatgcggccgtagtccgccacggtccacagccagtcaatcgggtgcttgcccagggtcgcattggcgatcccggcgatgattgccggttccgaacgcatcagcggcgacttgggtttcagctggccgtgggagatgtgcaccatgctgaaagtgtcttcaacggtcacgccttgcgggccttctgcctggatgtcgatatcggtccggcccaggcacggcaggatcaaggcttcgcgacccgtcaccagatggctgcggttgagcttggtggcgatgtgcacggtgagatcgcacttgcgcagcgccgcatgggtgcgcggggtgtccggcgtggcttgggcaaaattgccgcccaggccgatgaagaccttggcgcgcccttcttccatggcagcaatcgccatgaccgtgttgtgaccatggcggcgcggtaccttgaagtcaaagcgtgcttccaatgcgttaatcaactccggcggcgccagttcgttgatgcccatggtgcggtcgccttgcacgttgctatggccgcgcacgggcgacagccccgcccctggccggccgatgttgccgcgcaacagttgcacgttgatgatttcctgcacggtcagcaccgagtgcgtgtgctgggtcacgcccatcgcccaacacatgatcacccgcttggcgcgccggtacatacgtgcggccagctcgatatcctcaaggctcaggcccgattgctcgacgatatgctcccaggaagtcgcgtccacttgcgccaggtagcgctccaggcccgaggtatgctgggcaatgaaagcgcggtcgaaaactgcctcgccatcgttctccaaggcttcacgttcccatttgagcaggaacttggcgatgccgcgaaaagctgccatgtcgccgcccaaggccgggcgaaagtacgccgacgaggtaggttcggaaccattggtgagcatctccagaggatgctgcgggtgttggaaacgctccagcccacgctccttgagcgggttgaaacaaatcacctgagcgccgcgctttaccgcctcgcgcagtggctcaagcatgcgggggtggttggtgccggggttctggccgatgacgaaaatcgcgtcggcttcttccaggtcatcgaaagtcaccgtgcctttgcccacgccgacactgtcgtccatgcccaggccgctggcttcgtggcacatgttcgaacaatcgggaaagttattggtgccgtaggcgcgaacgaacagctggtacagataagccgcttcgttactggcgcgccccgaggtatagaactcggcctggtccggcgactccagctcgttgaggtgcttggcgatcagggcaaaggcatcgtcccaagagatttcgacataacggtccagggagtcgtcatagcgcatcgggtgggtcaagcggccctggtattcgagccaatagtcactttgcgctgccagcgacgacaccgtgtatttgttgaagaacgccggattgaccaggcgcccggtggcttcccagttgaccgccttggcgccgttctcgcagaacttgaccatgccgctttccggcgactcgccccaggcgcaaccggggcagtcgaaaccgccgttctggttggtcttgagcatcgcgcggatgttcttgagcgcgttttcactgcccagccagtttttcgtcaccgcgatcagcgcgccccaaccggcggccgcccccttgtagggtttataacgctcaacttcgctcatgatgcttctccaggacttcacgcataggcagcgcctaacttaaagcctttattggtggttattttcaggcattgcagaacgcaaacagtgtttgcaccgatctttccacggtctcaaaatcggtttacatattcaggctaggccctgcaaaaacatctgtctaatcacaaataatgaccacgccatcgataacatcgatcaccattaaagtcgttatttttcatagtgatatgagcttaaaaaatctaaataaaatcgctatagatttcatcgatcactcagttgctaatagtgattagacgcccttcaaaaacaactttaggcttgaatcaaataaggctctcatctctgtcgagcgctcaaaaacaacgccatggctacgctcttattgagccgcagccggaggtttccatgaccgataagatcctgatggatagtttttctcgccgggtcgactacctcagaatgtcggtgaccgaccgctgcgatttccgttgtgtgtattgtatggccgaagacatgcagttcctgccgcgccagcgcatcctcacgctggaggagctgtatcaactggctgaaagcttcgtagcgctgggcacgcgcaaaatccgcctgaccggcggcgagccgctgattcgcccgggcgtggttgacctgtgccagcgcatcgccgccctccccggcctgcgcgagctgtgcatgaccaccaacggctcacagctgggcaagctcgccgcccccttgttcgaggctggcgtgaagcgcctgaatatcagcctcgacagcctcgacccccagcgctttcgcgaactgacgcgcaccggcgacctggccaaagtcatcgccggtatcgacgccgcgaatgctgcgggttttcaacacaccaaactcaattgcgtggtaatgaaaggccgcaacgatcacgagatcaacgacctggtagcgttcgccatcgaacgcggcgtggatatcagctttatcgaggaaatgcccttgggcgtgatcagcgaacacagccgtgccgaggcgttctactccagcgcgcaagtgcgcgagcgcatcgccgaacgctacaccctgatcgactcggccgaatcgacccagggcccttcacgctactggcgcctggccgaagcgccgcatatccgcctgggctttatttccccccacagccacaacttctgcggcacctgcaaccgcgtgcggctgaccgtagaaggccgcttgctgttgtgcctgggcaacgagcattcggtcgacctcaaggaggtgctgcgccgttatccgggtgaaccacaacggctggagcacgccatcctcgagtcgatgaagatcaagccttatcgacacaacttcgagctcaacgatgatgtgcaggtggtgcgtttcatgaacatgaccggcggctaatcgacccggctttcccttttttgtatcgagctgccccgaggtgccccatgcacgagggcagcggcggtgaacagctcgtactggatgagtccctgcacaccattgcagacgtcaggcaattgctatgcgcccgcggtgagacctggcagcaggtgctgggtgaaaccagcctgatgtgtgcgctgaaccagaaattttgtacaccggaagcggtgatcgaagacttcgacgaaattgcattcttcccccaagtgaccggaggctgacccatgccggttcaggcgcagaacgagttgttcgaccttctacacgactttgggtgcgccgctggacctgtgggagggggcttgctcccgatggcggcctgacaggcgaccagaatgctggatcaagactgattactcttgcccgaccactcggtacctcgccaaggcgcggcgtgcgcgaatcagaacaactcagagaacggtatgaaccgcaccgtatcaccggcctgcaacgtgctgccctcgcaaatctcaaccaacccatccgcccacgacgcacccagcatcaccccggaactctggttcggatacagcaccgccctgcccgcctcgatcctggcgcgcaggtattcgcggcgactgccggccctgggccagtcaaaccccacactcaccgcaaagctcatcggcgtgacatcatcgacgccctggatgcgcaacagatatgcccgcgccagcagcccgaaggtcaccagcgccgaggccgggttgccgggcaggccaatcactggcacacggccaaatgaaccgacggtcaggggtttgcccggtttgattgcaagtttccagaacaacggcttgccgcattcacgcagtacctggccgaggcagtcggcatcgccggccgacacgccgccggtggtcaggatcaggtcagcggcgtgctgcaactgctccagcttgagccgagtcagttgcggctggtcgggaagaatgccaccgtcgatgacctcacaccccagcgcgcccagccaatggctgagcaaggtgcggttgctgttgtagatgcagccaggcttgagcggcgtgcccggctcggccagttcatcgccggtggacagcagcgccacccgtggacggcgtaccaccgatacatgggtgcagccctgggccgctgcaacggccaactcgaaagggccgagtcgcttgccggcctgcagtaatacctcaccggcgcggttttcctggccttgggcgcggatattctggccctcgcgcaacggctgggcgaagtgcacgcgcgcatcgtccagcacctcggcgttctcctgcatctcgacgcaattggcaccgtccggcaccggtgcgccagtgaagatgcgcacacaagtgccgggctgcagcggctcaggctcttgaccggcgaagacctgttgcgacaccggcagtggctggccccgccaacccgtgaggttcagggcgtagccgtccatggcactgttgggccagggcggcaggtccagggtcgccaccaagtcattggccagcacccgttgccgggcatcgctgagcaacaccgactcgctgtcttgcaggcggtgttcctgggccagggccaacaatgcagcaatggcctcctccaccgacatcagcgcggcgcggctcatccccgtgtgccacacagtgcgatcggcttgagatgcggcacaaaattacaagggcggtgacgcgcatcgagctgctcggcaagaataccttcccacgcagtacggcaagccccggtcgagcccggcaggcagcacaccagcgtgccgttggccagcccggccaaggcgcggctctgcaccgtggaagtaccaatatcaagaatcgagatcgcccgaaacagctcaccgaaaccgtcaatgtgcttatccagcaaacatcccactgcctcgggagtgctgtcgcggccggtaaaaccggtgccgccggtaatcaataccacctgcacgcgctcatcggcgatccaggtcgccacctgggcgcggattttatacaggtcatccttgagcagattgcgctccaccaggctgtgcccggcttccaacagacggctgaccagcaattgcccggaggtgtcattggcatattcgcgggtatcgctgaccgtcaacacggcaatattcaagggtacaaacaatgcatccgacgttacgctcatgtgattctccggcaggcgattatcaagacaatggccgcaggctaaagcgctgaaacgatggctgtctaatcgttacggctgaccgggttatcgagcgtttctatcacggcttttacaggcggccctggactgttatcgagtgcatcaatcgcgtcgtcaatacaggtgattggacgtgcctgccgttacaatgagatcgtctgttcattcattcgtcgggttacgcgggtttccagcacctcgcgcctcgaacggctctcacttattcccaggcaggtgccttaatggacataaagcaactcaaattcctgatcgcgctggagcagacccggcacttcggccaggctgccgcacgctgccacatcacccagccgaccctgtcgatgcgcctgcgcaacctggaagatgagctgggcctggagctggtcacccgcggccagcgcttcgaaggcttcacccaggccggtgagcgcgtgctggcctgggcccggaccctgcttgccgcccacgatggcttgttcgccgaagccgccgcgtgccgtggccagttggtcggtaacctgcgcctgggcctggtgccgcttagcgggttcaacccgatcagctacatccagggtttgtcccacaccttcccggaactcaagttcagcctgacctccatgagttcggacaagattatcgaggccctgggcaccaaccaattggacctgggcgtgtgctacctggaccatgtgaacgccaactatctggattttttcgaattgggcgagacccgcgtcggcctgctctacgacacccgtcatttccatttcgacggcacggaaatgagctgggaagacgcggccgaattgcccctggggatgatcagtaatggcatgcactaccgcaagtccatcgacctgagcttccgcagccgcggcctcgatccgcagcccatccttgaaagcgattcgacgtaccaactgttccaggccatccacgagggcttctgctgcgcgatcatgcccctggacagcggcctggagagcccgatcgagaacctggcgttcatcaacctgccggacgccagcgttctcgcgcccctgggcatggtgatgcgcaagaccgaaccacgctcggccattgccgagaagtgttttgccgaggccaggaagttgttcgcgaccaagaccgaggtctgacgcgcataaaaaaggcgctccgtagagcgcctttttaccgccgtttgctttactgcacacttacctgacgcagttcaggcttggcctcgccgccaatcgtgatgcgttttggcttggcctcttcaggcacctcacgcagcaggtcaatgctcagcaacccgttggtcagggctgcgccacgcacttcgatgtggtccgccaagcggaacgacaaccggaaggcacgctgggcaatgccctggtgcaggtaagcgaccttatcgtcggtttcgcgttttccgccggaaaccgtcaagacacccctttcgacctggatatccaggtcctcctcggtcaggccagcgacggcgatgacaatgcggtaggcgtcgtcaccgtgcttttccacgttatgaggcggataggaattcggagcctcgctacgcagcgccgactcgaacaggtcattgaagcgatcaaagcccaccgattgacggaacagtggggccaacgaaagggtagtagccattttaaaatctcctgagtttctccaagtgatttagtacgcgacccgagttcggcatcgcgtgatcaaaaatctatggacgagaaaacggaattcaagggggccataagaaattttttcttgcgccaatgactatcgcaaaaaccgcagtgataccgcatgtgctctaatctcaatgccaggcgtgctttaaaccgtgagcgcctgagacagcccttgaggtacaaaaaaatgaaaatgacattccctgccctggcattgggcatcctgatttcccaaggggccctggccgccggagatggcactgccgcgctgggcggcggtgtcggcggcgcgttgggcaatgtggtaggccaacagctcggcgggtcgaccggtgcggccatcggtgcaggcgtgggcggcgccgccggtggcgcggttggcgcgcaaaagggcaataaaaccgaagcggcgattggcggcggtttgggttctgccggcgggtcggtgattggtaatcgcctgggcggcaccaccggttcgaccatcggcgcgggtgtaggtggcgccgcaggtggcgcgctgggtaacaacctggccgatgacgagagcaatcatcgttcaggcggcgcgaagcacaaaggcaacaagcataagcacaagaataagcatcattgatcgtctgatgctgttctgattgcaaacaagccgggctcaaaggcgttgaattcctttcaacccggcttgtcaacacccgccccgtgttatatcggcgagctgctcaccacccgcagcgccaagccttcataagcatccagcgtgatagtgaaatcaccctcggcgctcaggtcgccttccacccgttcattgatgatgtccactaccatccccgccgcgatatcgggcaagtgcaaggtttcggtgatcggcgtcgcgccgaagttcagcgcggtgatctgcgtgcccttaccggccggcaattcgtggaccatgatcaacaatgcggggttttccacgtccggcaccaggatctggcgactggcggcaatgtcgtaggcgcggcgcacggcgaggattttttgcagttgcgaagcaaatgactccgggtcttccaactggctgttcaggctgccatacaggcttttcgagcgtggcatctgcccggccgacagctcggcatcggggttgagatcgaccaggtcgtaggcgccgcgatggatccagcgggtatcgccatcggccatcaagtgcgcgacttcctcggctgccaatggcagcgcgcccaccaggtcccagccggacagcgcaaacacgccaggctgcatggcgttgtacatcaccagcagcagatggatctggcgaatctgctggatatcggccggggtgatcgcttcaaggtcacgaatacccagggcagcggtgatgatgctggcagtggtgcaggacacgccattggtgacgaacttaaggttatacggcgcatgctcgccggtcaggcgttcgtacatctgctcgcggatgtgctcgcgcaggatgttgccgggaaaggtctggccctggaacaggaacgtgtcatgggcgtgcagcgtccagaaatgcaccagctccagggtcagttcgtcatggttctgcaaggcatggatcagtgaccccggatcaatgccgaggttatgcatctggcgcagcatcaggcgcaggaattcagtgtcgcccatcagcaacgcatgctggtaggccgggcgggtgatgaagtcataggacaggtccgcaccgccgtgggacatggacgcaatatcgtccaccgtaaggttgagttcctggaagctgaaaccgccggccttgcggatcgctccgccaagcaactggttgccggtgatcgacagtggatggctttccgaccaggccgtgccatcgagcttgcgctccacgccgagaaaaccgttggcgtccaggcgcaggatcttggcacccatcacatcgatggcgtgcagcgcgtcaccgataatcatctgctgcgcggcgaacgaagggtcaagccagttcagcgagggttggccttccttgaagtaatgcaggtacacccagcggcgtggcctgccatccacgccgagcaccacaggtgtggcgctccagtcggtttccttcaccccgggctcgaagaaaatcacccgttgcagttggccgacgatgtagtgcttgtcgcgcagcgcatccacctgcagcggggtaaggttctgcgcatcacggccctcggccacctcaggcagcaacggccagtcttcctcgcggatttccaccatgtggtacagcccggggtagtcctcgtaggccatttccgccaagcgaaaatcggcgcccttgccggtgtgggatgggatcacgtcgtcgatgatcaccgcattgtgcgcggcggccatgcgcgtcaacgcctgcaactgcgcctcggtgcccagttgcgggtcgatatcgaagctgacgcggtcgaaattgccgtcgatggtcggcgtgtgttcggtgccagacaggccaccggactttttcagcgggccgttatgaatgccttggataccgatcttcgacaaggcatgccacagagtttcatcccccagcgcttccagcaccgtgccgtcttcgcgggtgacaatcgacgccgggtaggcggtgaaccacactgacgacaaggctgacgcatcacgcggccgggtatgcgcgtagggctgctgccacaagcgaccctgcccggaatacagtttggcccgctgtcgcgccgcgtgcagcatggattgctgcaccagccagttcacatggtcgttgttcgccgcggtcataagctcgatacctgtggtggtcaaaaggttactcgtaagcataggaggggcgggcgcgccattcgttgcattgaaatggagccaaggcaggcagcaatccaaaaatgtgggagggggcttgctcccgatagcggtgcttcagtcgattcttgtgtgactgacataccgctatcgggagcaagccccctcccacattggactttcgtgtgtccgccctcctggtgttgcttgtcgatactgcctcggggtgaacccggtcagcgccttgaactggcgggtaaacgcgctgtggtcggtgtacccgcattgcagcgccacctcggtaatcggcaggtcggtatgcaacagccgccgggcatgttccagtcgcactttctggatcatttgccgcggtgtgaggtggaagacgcgtttgcagtagcgctccagttgcgccacggatatccctgcgatacgggtcaactcaccaagggtcacacggcggttgaagtggttgcggatgtgttcgtccactgccgccagacgttgataggccgggtgggtttcgctggccgattgcaggtcgaccgaaatccccgccaggccgatgatcgcgccgagatggttgtacagcggccatttgtgcgtgaggcaccagccgggctcgcgggtgccgtagaggtgcagttcaagctggtcttcaagcaccagcccctgctcgagtacacgtcggtcttgctcggtatagcccggccccagttgcgcgggaaacacctcggcgctggtcttgcccagcagcggttgcaactgccgcaggccgcatcgctgcaccagggtgcggttggctagcacgtagcgggcgtcgatgtccttgataaaaatcgcggcgttgggcaacacgtcgagcatcggcagcaactgctctacaccgctcaatagctgttcgatgctgtgggggcgactgccttggaaaaggctcgcaaacgcgctgtgcaacatgactatcactgcccttttcgtgcttttacaacgcgcagattgcgccatgcgccaagcgctgtcgagcgcgacaaactgtgctgaattcgtcatccatcccaacgcaaaacatcaatcgccgccatgtcgatgggttcacgatagcgccactgcatgcctatccaataactcacaagaaggcgccgctatgtcaggccaaggcaagttcaagaaacagctgtcactgatggacctcacctttatcgggttgggtgccatcttcggttcgggctggctgttcgccgccagccatgtgtcggccatcgccggcccggcagggattttttcctggttgctgggtggtttcgctgtactgctgctgggcatcgtctactgcgagctcggcgctgccctgccccgcgccggtggcgtggtgcgttacccggtgtactcccatggcccgctgctgggctacctgatgggctttatcacgctgatcgcgttttccagcctggtggcgattgaagtggttgcctcgcgccaatacgccgcggcgtggtttcccgagctgaccaaggccggctccagcgaccccaccaccctgggctggctggtgcagttcgcgctgttgtgcctgttctttgtcctcaactaccgcagcgtcaagacgttcgccatcgccaataacttggtgagcgtgttcaagttcatcgtgccgttgctggtgatcggcgtgctgttcaccttcttcaagccggcgaatttccagatgcacggctttgcccccttcggcctctcaggcatcgagatggcggtgtcggcaggcggggtaatctttgcctacctggggttgacgccgatcatttcggtggccagcgaagtcaagaacccgcagcgcacgattcccatcgcgttgattctctcggtgctgctgtcgactgccatctacgtgctgctgcaaactgcgtttctcggcggcgtgcccaccgaaatgctcgccaatggctgggccgggatcagcaaggaactggccctgccctatcgcgatatcgccttggccctgggcgtgggctggctggcctatctggtggtggccgatgcggtgatctcccccagcggctgcggcaatatctacatgaacgccaccccacgcgtggtgtatggctgggcgcagaccgggaccttcttcaagatcttcacgcgcatcgatgaaaagtccggcatcccgcgcccggcgctgtggctgacctttggcctgtcggtgttctggaccctgccgttcccgtcttgggaagcactgatcaacgtagtgtccgcggcgctgatcctcagttacgcggtggccccggtgaccgtcgccgccctgcgccggaatgcgccggacatgacgcgcccgttccgggtcaagggcatggcggtgctgggcccgctgtcgttcatcattgccgcgctgatcgtgtactggtcaggctggagtacggtgtcctggctgctgggcctgcaaatcctgatgtttgtggtgtacctgctgtgcgcgcgctgggtgccgaccgcgcacttgaatctcaagcaacaagtacgctcgtctgcctggctgatcggcttctacgccgtgaccatcctgctctccaagctcggcagctttggcggcgtcggcgtgatcagccacccgtttgacaccctggtcgtggcggcctgtgccctaggcatctactactggggcgccgccaccggcgtgccggcccacctggtgcgtctggaacacgaagacgacgaaagcgaagccgtcagcgacgcgccttaccgcgccccactgtccccgacaacccattgatggagccttctatgaaacggctgcacgtgattgactcgcacaccggcggcgagcctacgcgcctggtaatgagcgggtttcctgagttgcacggcgcctcgatcgccgagcaactggaacacctgcgcacccaccacgatcagtggcgccgcgcctgcctgctggagccacggggcaatgatgtactggtcggcgcgctgtactgcgcgccagtcacaccgggcgccacctgcggggtgatcttcttcaacaacgccggctacctcggcatgtgcggccacggcactatcggtctggtggcctcactgcattacctcgggctgatcgccccgggtgtccacaccatcgacacgcccgtgggcccggtggcggccaccctgcacgaagacggcaacgtgaccctgcgcaacgtgccggcttaccgctaccgccggcaggtagcggtgcaggtgcctgggcatggcgtggtgctgggcgacattgcctggggcggcaactggttcttcctggtgtcggaccacggccaggcgctgcagatggacaacgtggaggccttgaccgactacacctgggcgatgctcaaggcccttgaggcccagggtattcacggcgccgatggcgcgctgatcgaccatatcgaactattcgccgacgacgaccacgccgacagccgcaacttcgtcatgtgccccggcaaagcctacgaccgctccccctgcggcacaggcaccagcgccaagctcgcctgcctggccgccgacggcaaactggccgcaggagacacctgggtacaagccagcatcaccggcagccagttccagggccgctacgaatgggacggtgaacgtgtgcgcccgttcatcaccggccgcgcctacatgactgccgacagcaccttgctgatcgacgagcaggacccgtttgcctggggtatctgagccttttatttattgacctgaatggagttagcaccatgagcgacaacatcttcaccggctgcatgcccgccctgatgaccccctgcaccgccgagcgcaagccggacttcgacgccctggtcgccaaaggtcgcgagctgatcgatatcggcatgagcgcagtggtgtattgcggctccatgggcgactggccgctgctcaccgaggcacagcgccaggaaggcgtggcgcgcctggtcgcggccggcgtgccgaccatcgtcggcaccggcgcggtgaacagccgcgaggcggtagcccacgcggcccatgccgccaaggtcggcgcccatggcttgatggtgattccccgcgtgctgtcccgtggagcttcggtcaccgcgcaaaaggcccacttcgcggcgatcctcaacgctgcgcccaacctgccggcggtgatctacaacagcccctactacggcttcgccacccgcgccgatctgttcttcgaactgcgccgcgagcactcgaacctgatcggcttcaaggagttcggcggcgctgccgacctgcgctacgccgcagaaaacatcacctcccaggacgatgacgtgaccctgatggtcggtgtcgacacccaggtggtgcacggtttcgtcaactgcaacgctaccggcgcgatcaccggcatcggcaacgcgctgccacgggaagtcctgcaactggtggccctgagcaaaaaagccgccaagggcgatgccaaggcccgtcgccaggcgcgcgagctggaagccgcgctggcggtgctgtcgtcgttcgacgaaggctgcgacctggtgctgtattacaagcacctgatggtgctcaacggtgaccaggggtacgccctgcacttcaacgaaaccgatgtgctcagcgaggcccagcgtcggtacgccgagcagcaatacgcgctgttccgccagtggtatgccaactggtcggctgaacagaacgtcgcttgattttctgtaggagcgagcttgctcgcgaaggtcgttaacgataacgcgttcatcccgaatgcacgcgttatacgcactattttcgcgagcaagctcgctcctacaacacccctctgtttttcaggatgccccatgactctgacaggcaagatgctgattggtcagcaatccctttgcggccatcgcgatgcgatccgcgccatcaaccccgccaccgacacgccactggaacccgcctatgccggcggcgatggcgagcaggtcgagcaggcctgtgcactggcatgggccgcgttcgacacttaccgcgaaaccgccttggcagatcgcgccaggtttcttgaaaccattgccgataacatcgaagccctgggcgatgaattgatcgaacgcgccagcgccgaaaccggcctgccccgcgcacgcattcaaggtgaacgcggtcgtacctgcgggcaactgcgcgcctttgcccgcactgtacgcctgggtgaatggctcgacgtacgggtcgataccgcgcaaccccagcgccaaccgctgccccgcgccgacctgcgccagcgacatatcgccctgggcccggtcgcagtgtttggggcaagcaactttcccctggccttctccgtggcgggcggcgataccgcatcggcactcgctgccggttgcccggtggtggtcaaggcccacagcgcccaccccggcaccagcgaactggtgggccgcgccgttgcccaggcggtcaaacagtgtggtttgcccgaaggggtattttcaatgctctatggcgcgggtaacgaggtgggtatcgcactggtgaccgacccgcgcatcaaggccgtcggctttaccggttcgcgccgtggcggtgtcgcattgtgccaggccgcccaggcacgcccggaaccgatcccggtgtatgcggaaatgagttcgatcaatcctgtgtacctatttgttgccgcgcttgaagcacgggctgaagcattggccgaaggctttgtcgcgtcactgacccaaggtgccggccagttctgcacgaaccctggcttggtaatcgccgtgaaaggcagcgccctggaccgctttatcaaggtcgccagtgatctgcttgcacgttgcccggcccagaccatgctcaccccgggcattttcagcgcctacgaaaccggcgtgaatgcactggcccagcacgcccaggttgccgccaagggcctggcggccgccgggccgaaccaaggccaggcccacctgttcgtaacccaggcccaggcattcctgaacaacgaacatctgcaagccgaggtctttggcgccgcctcgctggtggtggaatgcggcgatgtcgagcaagtgcgccaggtatccgaacgcctggaaggtcaactcaccgcgaccttgcacttggatgagccggatttgccccaggcccgcgcactgctgccggtactggaacgcaaggccgggcgtctgttggtcaacggctggccgactggtgtggaagtctgcgatgcgatggtgcatggcgggccgttcccggcgacctcggatgcgcgcagcacctcggtgggcacggcggcgatccacaggttcctgcggccggtgtgctatcaggatttcccggatgccctgctgcccaatgccctccaacaggacaacccgctggggctgcggcgcctgcttgacggccagagagaggcgtagccatggccgagcccaatcaagcagacattgtggtggtcggcgccggcatcatcggcgtcgcctgtgccttgcagctggcgcgccaaggccggcaggtgcaggttatcgacgcgcaggcgccgggcatgggcgcgtcctacggcaacgccggtcacctggcgacggagcaagtgttccccatcgccgacctgtcgatcctcaagcgcttgccggccatgctcctggaccccatgggcccgctgcgcctggactgggcctacctgccccgcgctctgccctggtttattcgcctattgttgaatctgcgaccggcaagctaccagcgcaccgtggccggcctgcgtgcattgaatgaaggcagcctgggtgcatggcagcgtttgctgcattccattgggcaaacgcaactgcttcgcgaagacggttcgctgctggtgattgagcgcaccgaatcccgcgtcgccctggatgcgttgcagcaacgcatgcagcagcaaggcgtcgccgtggagttctggagcggcgaggcggtgcgcacggtcgcgccgcaattgagcgacgccatacaaggtggtttgttcttccccagtaccgggcattttctcgacccctataccgtggtcggcgaactggtgaatgcggccaaggccgagggtgtgcaatttctgcagcagcgtgttctggatgggcgcctggatgacagcggtgtttcattggtgaccgatcaaggcttggtgacggcgcgccaggtgctgatcgcctgcggcgcccactcggccaaactcactgcggccctgacaggcaaacaggtaccgctggacaccgagcgcggctatcacctgatgctgccccacgaacaccagcgcctgcccttcgccgtcacctcactggaacgcaagttcatcatgacgcccatggccggcggcttgcgcctggccggcacggtcgaattcgccggcctcgaccgcccggcgaatatgcaacgggcctggcagctgcaccgcttgagccaggggctgtttcgccacaacctgaacgacagtgacgccacaccgtggatgggttttcggccgtccctgcccgactcgctgccgatcattgaccgggtgtgcgaggccaaggtgctgcttgcgtttggtcatcagcatctggggctgactcaggcggcggtgacggctgaaaggatcgggcagcttgccgcgggtgaggcagtaccggagttgaagccttatcgactggaccgtttctgggcaaactgatcccgatacacaaaggtgggagccgttcggctacttgaccaaccgcttctccttggaggggcgatagccgaagtacgcgctgtagcacttgctgaaatgacttggcgaaacaaaaccgcatgccaccagtacatccacctgtgacaactcggtgtgctgcaacaggcggcgcgcttcggtgacgcgcagctccatgtagtagcgctgcggcgtagtgcccaattgttccttgaacaggcgctccaactggcggcgggagcggccggcgtagacggcgagctgatcgagttcaagcggttcttcgaggttggcgtccatcagcttcagcacttcgcgcagaggtgcgctgacgcagacgttctccgttggcttgatgcggcgatagcgtgattcctcgaacgccaggatgtcttcgatgccttcgaccagcgccttgccgtgcaggctcttgatccagtccagggccatatggaaggcgccggaggggctcgacgcggtgaggcggtcgcggtcgatcacatagggctcgctggtgacctgggcccccttggacacttccgccagcgccgggcggtgttcggggtgaatcgcgcagcggtagccctgcaacaggccggcgcgaccaaggaaccaggagccgttccacaaaccggcaaggcgaacgcccgcctccgcggcgctgcgcagcagttgaatgaacgggtcgctggccttgagttcggtacggaaaccaccgcagatgactagcaggtccagctcctgaagtgtcgacaactccaggctcgcatcgggtcggatcaccagcccgaggtcactgatcacttctccctcgccccagccgaaggtgcgcgaggcaaacagctcggggcgcagcaggttggcggtcacgagggtgtctagggtttgggtgaaggccggcagggagaagtgttcgagcagcaggaaaccgacttgggtgaccgaggttgcctgcggggttttgtcattgaggtagcgcaggttcttgccttgcatgccaccgctgaactggcgtctttccatcgagggttggcccactcttattgttgatgcaatgggcgctatcttaggggcaaacgctgtcactgtctcaatcggcgtacctgatattgataaatccaagatgcttcaaaagccgcagcccagctactgcggcaccatctgatatggttttttctctgtcatctgcacctgtattgaacgccgtcccaggcggacaataggcgccatcccgacatccctgtcgctccccgcccttcggaggccttatgaccaaaatggcaattttcctgttcggctttttggtattgaccatcggcattggcttgctggcaactatttcgccggtttgaacctgaatcagctcacaaaaagcatcggatacaacgacaacaccagcaacccagccatggaccagttgaacatccgcagccagcgcggctcgcgcaatacattgcgcaggccgctaccgcaaccaagccatacacacacgcttggcaggttgaccacggcaaacaccaccgcaatcagcagtacgttagtggcgtaaccctcagccggcgtataggtggtgattgcacccagcgccatgatccaggccttggggttaacccactggaaagccgccgcacccaggaacgtcatcggtttgccctgttcgtcgttactgtccgataccccaccagcggtagcaatcttccacgccaggtacagcagataggtggcgccaacatagcgcagcagcgtgtacgcccacgggaacagcttgaacacttcccccagacccaacccggcgcaaatcaccagcaacatgaaccctatgctgatgcccaaggcgtgagggatcgagcggcgaaacccgaagttcacccccgacgccagcaacatggtgttgttgggacccggggtgatggaagacacgaaggcaaaaagcacaaaggctgacaacaggctggtagacatcaacatgaggcgcggtatccaagcgacaatggtatgtcagcgacggtagtaggttgcggcgcccatcgcccggtacagctggagagagatcgaggcatacacttttggaggtctacattcacttgcgctcacgcagatcaccgatgggtttcacaaacctttcacagaccagcatttatggtggtttcagctccttaatgaactccttttagcccgcgcctcatcgcgggcttttctttgcctgataattgcaccgggcaaaaaaaacactcattacctacttggatgaatatcatgacctacgctcttattcgctttaacccacacaggccagagtgaacgccttgatagaagatctcgacggcccccgaactgcgcagcaggaattgttctacgaccttgacgacgccagcgctgttatcggctggtccgtggttgagctgaccgcattggccgctggcgggcattcaaatgatgcggttgcattaaggaaggtctgcgcattactcactgcacagcagcaaaggcttgaagcctatgccaatgaagtcaaagcacagaggatcagcagatccgaggcgctggggtgacaccgcccctcggatcatcggactgaggccagcgctggcggctggcacgcgctacgaacagtcagtgactttgagcggagggctgcttgtcatgaccacgttgtttttttacacgcttgcgcgccctgagttcgtattgatggtgaaaaaaccaagcgatcaggagtacgcccgtcacgccaaaaaccagggtcaacagctctaatgcagtgccttcgtgtgaaaacatttttcgttcctcgtcctgaagtcgtttggctgaaaaacagtcaaaccgaaattgttcgtaacaattcaaacattttcagggtagtcggcaaatgcttccgtgacaaccccgactgagctgtaaccattgatctagacacgtcactcgtcgaaaatctacttaataacctgcaggcgataaaaaacccgtagacgctaatctacgggtttccaatagcgcaggcccaggtcgtaatcgacccatgagcaccggcctgccctggttctcgattacttattcagtcccggacgcgtcctgctccaccaccagatccaacacatagaccgtcgaaggcgcatctgctggcggattcttccagtcgtattgcttgacccgcactaccgtgcgcacgccatcacgatgctcaaagccttcaatagactgatacagcgggtgccatgtgtcccgggtcggaagctgcaggcctgcgtcgtcatagcggcgctcacgcacttgcaagcactgatagtcagggatcatcgggtgactgcacttgacagtgttgggcgccacttccaggaacttgacctcgcccttgctaccgtaacgggtctcaggagtggcctccccctgaagcttgagcaccgagccgtccactgtagtcagttgcagcactggccccgtgttatcaccggtgatgacggcgcgcagatcacctttgaacagtcgacctacctgggcgtcaaggtccatcaggctcttgtcacaggccatgagcgtagaagccagtgactgcaccttcagaacccctccctgatattgatagccgccgaactggccattgcagccaccgctgatgttcaggttcttttcaccgaaggaaacacgcaacttgcgctcgatgcctttgttcatcataacgagaggtttgcccgaagtatcagtcgccgaaaccaggttccagtaataagcagataatgctggctggcctgcagcggtcgaggtagcaatgggcatggaaggtgattcttcatggcttttggaaggggcggcgcaaccttggaccagtgcagcacaaacggccacaagaagaattttgtgtttcatggttcactctgtcagcttgatgaatacgggcgttatcctgcgcgggcaggataaacgcgcggctaaaccggcaagcgttcgaggtattactgagtgttgacccagcgctcgctcggacgacctcgtccttgaccgatagcgatgggacatcacttttttcgttcagtttcacgcaataaggacgctggaagcgataccacagtcccgggcaacgccctttatcagtgatcgatgaaatctccgactttccttgcgtcctgttcgaacctttcgaatataggagctggtttcggggtgtcgaacatacgctgagtcagaagcaccgtcgtcagtttcgagacgggatcgctttgccatctactgccaaacccaccgctccagccgatcgtccccacacgagccccgctcgaggtttcttttgcggtaacagacaacccatatccccagccttgaccctcctggaggacagactcaccctccttgcgctgagaaggtgtgaggtggtcggtagtcatcatcttgaccgcatctcttgacagcaattgtcgtccattattcgcgccgccattgagcaacatacgtacaaacgccagataatcatccactgtcgaaaccaggcctccatcaccttgttcaaaagcgggaggtcggctccaaccaccggttctcggggcatcccactcttcaagtgtgccttccttctgccggtaagcggttaccaagcgatccagcttatcttccggcacatagaagccagtatctttcattccaagtggactgaaaattcgttctgacaagaactcgccgaactgttgccccgatgcgcgagcaatcagcacacctagaatgagagagccaatgttatatatccacttttcgccaggttgggcaaagagtggcagcgttgagatgcgttgaagccattggtcagcattcaaactcaacgttgggtcaggtggtccgaaaccggcgataccgagtgctgatatcttctcctggatagggtatgtgccgggaggctgaaaaataattccccaacctaaacggaatgtcagcaggtcttcaaccgttatggagcgttttgccgcgacggtatcatccactggtccgtcgaggttgcgcaatacttgtcggttagccaactccggtagcaggcggtcgaccggctcattgagttttaacttgccatcgtcaacgagaagcatggtggccgcagccgttataaccttgctcatcgaggcgatgcggaagatcgaatcacgtcgcataggcggaccatccaacgccatgcgacctaaaacggcgacatgcgcatcgtctccacgcgctaacaatccgaccagaccgggtgcatgtcccgcgttaagggctttctgtaaattggcatcgacagacgacaaacgaagatgtgaactttgttcagccatcggttgttctcctaagtttatatgcgttcggccctagaactttaaactggactccccctgcgccaggcttagtgtgctctggccgcaagggttgtcatatgcaaaatttggattaatcaataaatatgcatattcgtcgtactatccatcaaaggacaacaacaatttttcctaacgcgcggtcgctttcaatcaaacgatgcgcttgacggacctcatcaaaggcaaaggttctgctattaatggaagggatacgcttggcagcgatttcctttaccaaccatggcaatggtgtgtcttccaaaggcaagtcggaagtccccaacaagctgcttgggaagaggctcagccgcacagcacccggcatgtcccctctcaggttgaattgctcaaggttgggcgtaccacccagcccgccgacaacgctcaccccaccgaagggacgcacggccttgagggtgtccaatagcgttacgacgccgacgacttcaagcgccgcgtcgaccccgcccggtgcgatttcgcgaatgcgcggggcaattttaccatcgtcgattaccacgatatcggcccccacttggtagaggcgttggctattgcccgcactgcgggtggtcgcaatcacttttaatccgcgggcttttgcataagtgatagcagcaaggcccactgcggaagtgccaccgcgaaccaacagcgtctgaccctttttaatcgccaggtttttgtccagtgctccccagactgttaagtagatttccggcagcgcggccaattgctcccaaggcagcgtggtgtcatccaaggcaatcacgttattgctcaacacggtgacttgttcggcataggtgccattacgggtaaattgcagtcctcccatggcggtagcgacgcgctgaccggcgctcaatttgccggaggggtctcgaatgacttcacccacagcctcaatacccgggacccgtggctcggtgataggtcccattcggccggcgcgcaatgcggtatcaatgcggttgatgccaaaggcgcggacacggatcaatacttcaccgactgtcggctctggggatgggatatcccgcaattgcaaaacgtcggcatcgccgggctgttcgatcacataagctttcatggggaatcttcctcaagtgcgttgcaggtatgaaccttgccgcttgggcaagtgctcgcactatccatcactctaagctggaagataatccacgcaaacgataggctctcctaccaaatgtgagagggtatcgtcatggacttaaacgccgttcgcatgttcgtcagtgtggcgcaggccggcagtctgtccgccgcagccgaacgcctgaacattccactacccaccttgagtcggcgcattcgagagctcgaacagcaacttaaggttcaattgctcgagcgctcggtgcggggcaccaaactcaccgattctgggatgcggctgtatgagcacgccagtcggggcatcgaagcgctagttgcgggtgagcaatcagtcatatgttcccagcggcttttgaccggacgtctgcgcctgtcgctgccgccctcgtttgaaccgtggtgggacgttgtatctgcctttcagcgcagctacccgcaggtacaagtcagcatccacaccactgaacggcgcgtcgatctgatcgaggaaggcatcgacgtggcgctgcgggttggtgaaatcgcacacgaaaccctggtcgcccgtcacctgcttaaatatcgtcatgtgctggtggccagccccatgttgatcgagcggctgggcctaccctccagtgtcgaggctttacatgcatatccttgcggcgtttggggacgaggcaaccagggcaactggttattggggggagaaacgatcaagccggtagccattctgtccacaaatgactacatgcatcttcgcagccgtgcactgacgggagacctggtgacggagctaccgccctttctcgccgcaagcgctatccgtgaagggacgctccaggccttgctgccggcctatccattgccagaacagcaaataaacttgctctatccgtcgcatcatcatccgtcggctatcgtgcgtgcatatctggacttcgtgcaaggatatgtagagtacatcgcgcaggtatcaacaatatctcagtgattttttgagcgttcggatggcgatccagacaacgaaaaaaaaggctccctacttatccaagcagggagccaaaggggaaaacgtaatgccatacattgctacgctggttgctcagcggtgtatgaaaccggttaatacgccagcgagtagcggaataggtaaatggccgtataactcagtttttttctgtgttgactgctaaacgcgctttgagaagagttacgagcaagcgatctcgctcggccgccagctcttcaaagcttctatcggccacttccgcatacagaccctggatcattttctcttgcatctgcggcgtgaactcaacgccccccagcggcgtccaccacgtcaccaaaggaccagcgaactgtttgtaaaaatgctcaattccgcctgctccgccgccaagatggttcaaaagcacgggacccatcacgccccaacgcagacccgggccccaagagcaggccgtatctgcatctgcgacatttacgacaccttcattgacgagcgacatgatctctctgataagtaccccttgcaggcggttggctacatgccctggtacctctttgttcagtcgaatcgttcgcttgccaaggctggaatagaaggtttgcgcacgatcaactgattcgctggaggtctgtttaccggctactaactccaccaggggaatcagatgaggtggattgaacggatgcccgaccaagcaacgctctggatgaagaacgcagcctttttggatttccgtcattgttagccctgaagagctagtggcgatcagtacatctgaggccaggacagcatcgagttgacggtataaatcctgcttgaagtccaatcgctcaggaccgttttcctgtacgaaatctacatccgcgatatcttcgagagaggtggaaaatgtcagtcgcagttgcgaggcgccagccgcaaccaagccaagctcctgcatctctgtccaggctttagcgacatactcgcgcagtgccgcttcggctccgtccgcaggatcaacagcgatgacttcaaatccgtaagccaaaaacaatgcgctccaactcgcgccaattacccctgtgccgactatcccgatttttttaatcacgttgctcatggttatttccatccgttaaaacagaccgcggtattactgatgaatacatcaggcagccttatgtgataagcgtgaggatgaatgatcatccactggtgagcacaagctgagcgcggtccactgtctgcccacaatggggtttttcactgcaatcaacttggcttgacctatagtggggatgacttgagccacggaacaaataccttgattggcgcaagccataactgacaggcatggccatcgtgatagagatccgacacctacgttatttcctggaaatttccgacatgggcagctttaccgcggctgcgcagcggctgggtgtagcgcaaccatctttgacacgccagatgcacgcactggaagaacatgtcggctgcaagctttttacccgctcctggcagggagcctgcctgacagaagcgggagaagtgttgcagaaggaggctcgtctgacggtcagccaattcaattctgcgatcaagcgtacgcaggataaaggaaagcaggttcatagactggtactgggaatgatccccggaacggaggatgaactgatgggccgtgtttcgacggcactgggccccgaaatgaaaggcattgcggtagatgttcaaagtaaactgccgctggacctgatcagcgctttgcaacagcagagcattgaggccgccttcattcgaagaggcgacgtgcccattgaatgggtgagccaagttatccggaaggagactttgacggcgatcctgccgcgcggccatcacctattacgcaagcgtatgatttctgccagggacttatccggggagcgtctggtcgtgatcagcgccaaggcagcacctgcgcttcgctcgacaatcgacgccttcctggcaccgtacaagacagacttgatcgtgccacttgaggccgacgggatgctgagcattttttccatggtgaccgccactggactatgcagcctggttcccgattccttttgcaagatgctgcctaagaacatcgctacccgacgccttggcgcgatttacgactctgccctcgatctggtcctggcacacaccgggacaagcgtctcccccttgctggagcgcctattcgaacgtatcggggattgcaaacagccatgatcggcgcgttgttgaccagtacgaacaacgaataattagttttcttttgggtatgtaaaccataaaaaaaagccatttttttatggtttttttgtacgtagagtgcgtcgcagatcgtcgagaccactcaccccatgaccatcctggtgcgtagcactggaaggaaactattgtgaatatcaatgatatcaagcagtacgcttactctatgccactgacaagtcctgcgtttgcacctggtccgtaccgctttgtaaatcgagagtttctcatcatcacttaccgtaccgacccggagaagttacgtaaatgggttcctgaacccctcgacattgacatggataatcccatcgtcagatacgagttcatccgaatgccagattcaacaggcttcggggactacaccgaatcgggtcaagttattccggtagcttatgcagggcgcaagggcggctacacccactccatgtatctcgatgactttgctgcaatatctggtgggcgagaattgtggggctttccaaagaagctcgccaggcccactctcagcgttgagtccgatacgttgatgggagaattgcactacgggaaggtactagttgcgaatgcaactatgggctacaagcatctcgagatggaccacggcctggcgaaggcagcgattgaggcacctggttttctgctgaaaatcgttccacatgtagacggtacagcgcgtattttggaactggtcgaataccgttgtgaagatgtgctgattaaaggggcatggacagggccagttggtctgaacctgttttcccatgcgctagcacgagtcaatgacctcccagtgcttgagattttatcaggtgtgcacatcgtggccgacctgacactgggcctgggcgaggtagtccacgactaccttgcacccgtgcaacgctgagggtaaaggcctgcacgaccttcgtgccctcaacgtattaaagaatcccaacagacagatcatcccgcacgatactcttactgctttgcgccatggcgacatccgaatggatcttaagacgcttcgttacttcaccgagatagttcgccatggcagcttcggcaaggcagccaaagctatcccgctttcccaaccggcacttagcaaagccatacgtttacttgaggatgaactgggcgtcacgttactggagcgcggacgccggggtgtcggggtaaaactcaccacctctggcgaaaccgtcctggaacatgcactcacaatgctcgcgcagcgtgaacgcttgttgttcgatctagacgcatcccgccaagtcaaaaaaggtgagttgcgccttggccttcccccgctgggcagtgcgcaactgtttgccgcccctctggccgagttccgtgagcgttaccctggggttgccattcatttgcgtgaacatggcggtgaagaacttgaacaggcaatccataacaaagaaaatggaactggcggtaacactactgcctacgctcaccgagctgaacgcgctggtcgtgcattgtgagcccatggtgttggtcgttcctcgcagccattcactcgcgacgcgcaagaaggtgcggctcaatgagcttgcgcacgaagcgtttgtcaccctcggcaaaggctcggcactgacgcgcatactcaaggaagcttgtgtggctcagggtttcgaaatccatgaagttgcccagagttcgcagccggactttgcccttgcaatggtagcggcgggagtgggtattacttgcctgccgcgcctcatagccaggcactacgaaaacaccagtgtacaactcgttgatctggatgcgcccggaatggaatggcgcgtggtggtggtctggcgcaggggttccgaactgtcctgggcagcctggaaatggattgaatcagtgaaggccggggctacatccagtgaattctcatcttagattaccgactttatttccagaatcacttttatggtatcaaaagctcttgaaatgcctgcatatacttcgggcgcttgctatgtgtgcccaaaaaagagcttgccattcaactcagacgggagtgatcaagatatcgtagtcaataaaaaaacccgtagacgttaatctacggggtttctaagagtggaggccgaggtcggaatcgaaccggcgtaggcggatttgcaatccgctgcataaccattttgctactcggcctcaaacgatcaatgcccttgctgctgacattcaccgcatacaaacttgagtgggctatgtgaagctcgcctctactctaactcattgaatacattgaagtttttaatgcttcattgcgttcgatgggcgccattatgtactcatttgcctatgcctgcaaccccttgatttcaaaaaatattctgtcttggcatcaaggggttgcaagcctgccctactccttcacggtctggacttggtactgcggatcggctttgatctgggcatcggtgaacggcagtgggcgtagttttttctcggagaaagcttgggtctggtcctttgaatagttggacgcagggttgctggattcggagaacgccagcacgcctaccgcgttggggcccttgtcgtcgaaggtgacaatttgcagatagctggtgccgctgaccacttcgcgtttgccgtcggcgcggggcacggtttgcatggcgttgtagatacccaattcctgcgggccgccgtggatgggggtgtggccggagacttggatatcgccccaacggctcaggccaagttggttgacgtctgcgttggaggccagcatggcttcgcgcagggccttggcaacgggggcgcggtcgatggcgaggccggttggggtggtcagggggcgggccgggtcgaaggccacgcgccaggcgtcggggatttgctgcaggtgctgcatcaggttgatgaagtgcatcaggcccacgccgctgtcgaggttggcgtgctggtcccagtctttcaggctggcgcacagcggttgtagcacagcggcgtcggcgcccaggtgtttggcgcagaacgccagcaggtcgggcatgacttggcccgccaggtacacctggttgtccatgaccatgttttgcaggtctgcgacgctgatggggtgtttgtccagggattgcaggcgttggatggcaaaccgggcgcgtgggccgaggccgatgttgtcctggctgatcaccggcgagaagcctgtcaatggcgccttggggttggccatccaggcggaatcgttggagtgctgcacatagtcggtgcgttgcagctgtggcaactgatcagccgggaagataccggcctgggcagcacgcgggtcgatgtcccaggcgcaggcgctatgggcgccgtcgagcatgatcatttgcaggccggcccgcgggtcgctgcattgggcgagcttggcggcgctgacgttgggcaccaccgacaggttcatgtacaggctttgaccctggtcatcggcggccagggtgttgacccagggaatgccttgcagggtgtgtaccgaggtttgcagttccttgaggctgccggcgcggttcatggcgtaccactgttgcagcacccggtcgttgcccaggttggcgtcgcgcaagctgaaggcgtagtggctgtcccagtcgagcttgccgggccattgcacaacggggccgaactgcgaactgtagaccgtatgggtcacatccttgaggctgccgtcggcctgcttgacctgtaccgtcacagtcgtcttgtccagggggatggacttgccgtccagcaggtaacgggtggagtccttggggtcgagggtcaggcggtacagggtgaaatgcttggacgtatccacggtatgggtccatgccacatgctggttgaaaccgatatttaccaccggcaggcccggcaaggcagcgcccatcacatccaactgaccggggatggtcaggtgcatctcgtaaaagcgcatgccgcctacccaggggaagtgcgggttggccagcagcatgccacggccattgaaggaacggtcacggccgacggcgacggcgttgctgcctcggtccagggtgaagcgctgttggttagcggcggccagctcaaagactttggcgctgggttgcaccctggcgatggcttggggtggtgtggcccccaccaaggcttcggcgaattggccgacaccaccttcgaccaacagcctgcgggtcaacttcacaagatcttcaaccaccaacggccgcacccaggctgcctggcattgtgccggggcgccctgctccttgagataacggttatagccggccacatagccctggatgcgctgttgcagctcgggggtttgcgctttccagaaggcggtcaccgcttcggggttattcagccaggtgaagaacacatcgctggcgaggttgttgcgctcttccagggtggcttgttcggggccgaaaaacctggcgcgctggccattgaccgtcaccacttcattagccagcaggcacaagttgtcctgggcataggcgtacccgataccgacccccaggccacgctcatcgttagcgcgaatatggggtacaccgtaactggtacggcggatatccgccgacgcctgcgttactggttcccgtgccgatgcggccaggctcacccccagcaacagcactgccacgcctaccctggacaacccattggaaataatcacgccgactccacagtcaaattagacacccttacgagggatggttaccccaccgtaagaacgcgaatagccaggagtaatttagtcggcagagacgattatcagtggcggtcgaggtgtgtccaatccgataccgacaaattttctacatccatcgtttcatgatttgcgccactcgttcgtcttattacttaagagcgccatctttttctgatccggctctgaaaaggactttatgcatgtataacccgcaagtgcccacggatggacattcaccgactgccgattccaacttcggcagtagcacacaagcgttcggcaagttgcccgaacagcagggcaaccagcgcattcgccatttgctcaagtgtttcggtttgcgcaccagccttattcggctgaaggtcatcgacgcccttctcaccgctgccgacaaccagcgcaccctgggggtgcgaggtgtgcacagccatttgctggagctggacatcccgttgtcgtttctcagtgtgcgagaggtgctcaagcgtctgtgcagcgagggcgtgatcacgttgaatgccgacaagagctacagcctccatgaagaggctgccaaagtgctcgagggtcgggcctgactcagaagttgggcttgaccttgcggcgcatgatgccgttgatcaccacgaccaccacggcaatcgcaatggccaggtactggaaggttttttcgctgatcaccccgatattctgcagataggacaggccaaacatcgatgccagcactaccagggaaatcaggatcgagtatttcaagcgttgcttttgggtcatgacgggttcctggaccttggatatgtaacaacattacctccccataagcgcaagcaagctcggtcctacagggagggttatgttacagccgatgaatcgctttggctcgcccggcgttcaactcgcgtgcacccatcgctgatgcagccatcgtgcaaacgcatccagggcaaaccccagcaacccgatcaacaccaccatcgccatcaattccgaatacgccaggcggtcgcgggtatcgagaatgtaatagccaagccccgcactgaccccgagcatttcacacggcaccagcacgatccacaggatgccgatcgccaggcgcacaccggtcaacacgtgcccgaccacgccgggaatgatcacccggcgcagcgtctcccaacgcgtggcactcaagcttttactcaactgcaaccagcgcgggtcgagctgacgcacgcccgctgccgtgttgagcataatcggccatacggcggcaaaggccagcaggaagtagatgggctggtcccctacccccatcagcatcaccacaataggcatccaggacagtggcgagatcatgcgcagaaactggaaggccggcgtggttgccgcctccaggttgcgtgaactgcccaccagcagccccagtggcacgcccactgacagtgcaagaaacaacccgacgaaaatgcgcttgaggctgacagcaatgtgcagatacagctcactgcgcccaagcaattcccacaaactgctgaaggtggcctccagggaaaagcgcgccgacaacccatcggcctcgccaaacacctttacccccagccaccacaacaccaacaaaccggccaagccactgataccgagcagccaacctggccacacgaaggttttgccgttgttcaaacgccaatctcctcgtgccgctcataaccgtccggcaagccgaacgtcttcatgccacccactgcttcgatcgcatgacggacgaaacggtcgtccacgagatccttggcgacgaaggccggatcgaggtcggcgagaaatttcttgtcgccttcgatcagggtgtctttcaggcgcttgaccagttcctcggtatagctggggaatgggtaaggctggaagtcgatgcggtgttcgtcccaattggcgtgctggatcgcaccgtccgcaaggtagccagcgcggtcgctggcggccggggccaggactttgctcaacaccggctcggcatggggtgtgtaacggttcgggccgtccttggacaacaacttcaccgcttcttcgcggttgtcccgtgtccatacctgggccttgacgatggcgttcaccaccttctgcgaccattccgggcggttggtgagatcatgttcgtgcatgaacaccacgcagcacgcgtggttgcgccacacatcgccggtaaagcgctgcactcgacccaccttgagattctccgccagggcgttgaacggctcggcgacgatgtagccgtcgatgcgcttgctggccagcgctggcggcatgtccgacggcggcaatacgatcaggttgacttcattggctgcaatcgcgccgccggtggcacggctgaccggcgtgaggccgttgtcgcggaacagttgctgcaccactacgttatggatcgaataccagaacggaatcgccaccgacttgccgcccagttgcttcacgtcggtaatgcctggcgatacggtcaagcccgaaccgccgacatggttccacgccacgaccttggccggcaccttgctgccgtagcgcgcccacacggtcatcggcgatagcaggtgaatcacgttgacctggcccgagataaacgcctcgatcacctgggcccaactgcgtagcagcaccgggcgttcagccttgatgccttcggcttcgaacaggtcgttattgtgcgcaaccagcagcggcgtggcgtcggtgatcggcaggtaaccgatgcgtaccggcgcgtcaggctcattggcggcacgggcctgcaggctgctcagcaacggcaaggcgccggcagcactgagcacggcagacagtttgagaaagtcacggcgcgagtgggtcaagtcatccagacacatggctaagctcctgttgttctaaggggttgggttgagtgcggctcgcctgccgtaaggttttaagaatgtcgatacgcagcgcgccgatggcctcgacctgttcatctcgcggttgtggcaggtcaatatgccattcgcccagggtccgcgccgggcggtcgcccaggagcagaatacggtcggacagcagcagtgcctcatcgatatcgtgggtgatcaataccgccgccgaaccttgttcgcgattgaccttgagcaacaggtgctgcatatcggcgcgggtcacttcatccagtgcaccgaagggctcgtcgaggagcaacacctgaggctggcgcgccaggcagcgcgccagcgccgtgcgctgagccatgccgccggacagctgcgctgggaactgttgccgcgcatgttccaggccaacggcagcaatcgcatggtcgacacgctggcgccgctcttctgtggtcaggtgcggctggcgggcgaaatccaggccgaacgccacattcctttccaggttcaaccatggcaacaggctcgggtcttgaaacgccaccgccaccctgggatggggaccgcgcagtggctcgcccaagacctgcacactgccaccctgggccacctgcaaaccggcaagcacgcgcaacaggctggattttcccacgccgctggggccgaggatcgaaaccacttcgcccggctgcagctgcaagtcgaagccttgcagcaccggcccgttggcgtaccccaggcaaactccctgggccgtcatgaccgcctggctcatagatgaccctggcgatgcaactcggtacgcagttgcaccaggcttggcgtcacaatcggcacgaacgccgattcgcgccagcgccgggcaaagccgctgccatgtgcggtcaggtacgccttgccaccgctggcttgcagctcaagctgcacggcgctggcggcggtttcggccagggcgatacgcagcttgaacaagggcaccggctcggcggcaaagcgcccggccagcaggccagtcttgagctcggtgaccaggtgatccagcgtcacgcgcaacgcttccaactcttcgcgcaataccgtgcgactggcacccaagtggtgggccacctcggccagcgaacgtcgggccaggccaatcgacatgccgcactgcaagcccaggaacgccgggcgcactgctggcaggaacttgcgcgcatcttcatgcagcaaccagtcgcggctcaactccacgccttccaggccaagggctgcggtattgctcgattgcagcccgagcagctccaggtcgcgggaacgctgcaagcctgccaccgaatccgggatcgccaggataaagggcgcgccgcctcccgcatgctcgatggccgctgccgcgacaaacccgttcttgcgcaggttagtcacccaatgcaagcgaccattgagcgtccacccatgctcgttgggctcggcactgatctgcaacgcctcgatgcccgatatgaacttcattgcattcgacagcccggttgccccggccaatttgccactgagcaggtccggcatcagttgctcgcgcaaccgttcattcgggctctgcaacaaatactcgataaacgagcgctggccccagcatacaaacgccgccgccagggaatggctggcaacgttggcaatggcctcgaccgcccccgccacatcaccgcccaggccgcccagctgagtaggcacgccgattttcagaatattggcctctgccaggcgtggcagcacttcctgtggatcgcaactgcccacgtccagggcctgcgcttgaacatcgagccaacggctcaagattgggtcaagcattcatgtctctccttttacagcaggtggaccaacgccaattcagcttgccggtttttcccaacggtattgcgccagctccgggttcagcggggtacgggcaaacacattggcgaagttgcacagggtggccaggctcacccccaaaatgacttccagcgcgtggccgtcggtgtagcccgcagcgcggaatgcctcaaagccggcatcactgacatcaccacgagtggcgatcacttcccgggtaaaagcggcgagtgtctcatagcgagcgtccggtagctcaccgcgccggcgcaaggcctcgatcacgtcttcaggcaacttggccttgttgcgcgccacggcggtgtgacctgccacgcagaaatcgcagccatggctggtggcggcaatcagttgcaccacttcgcgatcggccaggctcagttctgccttggcgttcaagccggagacggtgatataagtctcaagcgcagccggtgcgttggccaggacgcccaacagattcgggataaaacccgagcctttcagcgcgttttcaaggaaaggcctggccgcttccggggcggtttcgggggtcagtaacggtacgcggggcatggcggggtctcctagtgggatctaatgccccagtctgttggttctaaaaaaatcgctcaataggctaaagtagcgattacttgctcttgagtctttctattagatgaattcgtccaatgttctagtcgactggttattagatagcctcgaactcaacaccagcctgtttcacgtgggtcgctactgtggcgactggcatgcaagcacccatggcctggcccaggcgagcttccatttgattgtgcagggtgaatgctggctgcatatcgacggcgatccaacgcctcagcacttgaataatggtgacgcggtgtttctgttgcgcgactttgcttatcgactgtccggggaagctacggcagccggcgcccaggagtgcccgcgccgtccgatgcaggccctggacagcaacgccaccgacggtgtgggattagtctgcggtttctttcatttccaatccggtctgtcgacgctgattgtcgacaccctgcccacctggatcatcctgcgcgccggcgacccgtcgcttaccgcggcacgcaacctgttcgagctgatcctgcaagaatgtgcccgggcacctgcgccctcctctgcgttgcttgaacgcctgtgtcatctgctgtttctgtatgtgctgcgtcaacaagtgatcgataacaccggcctcggcggcctggcagcgctgggccgtgcgcctgcgtttgcacacctgctggaacagttgatcgcacggccgggcgagccctggagcctggaaagcatggcggcctgcaccgggttgtcgcgctcggcgttcttcaagcgcttcaatgaactgtgcgggcagtcacccggccaggtactgttgatgatccgcatgcgccatgcctgccaattgctcaaggccgaccaaaccgtagccgaagcctccctgacggtggggtatcagtcggtggccgcgtttacccgcgcctttcataaagtcaccgggcaacagcctggcgcttatcgcagggcgcaggtctagccgcccgtcggcatgggcctgcggcgacaatcgcgcctgcgcgcattcagggacgtatacagaattatcctctgacaacccactggaaccattaccctgcccacgtcactcaatggaaacctgacaggtagtcaggctttcgtaacgcgcaaccatggaggacgcgcacatgctatttcccctggcgtatctcgccacaacttacacagacgcccgatccagtgggcctgccagccaccctgccccatcgttttatgacccgccaccggacctggaacctggcgtgtataaccaccggctgctcacactgcacagcgacggtgaggtcaacatctcgcggctgcttgtatgggacccgagctccgatgtacccacgatcaaacgtaattatctggttatagagaccggcgacggcgccgaccgcatccacatacgcaactggcctggcgacaggctgcagatactcatcaacgacaaaccctacttcttttcgataaagccaccccaggggcctgagcagagcctgctgatcgagaccaaaggtggccatgactcggtgatcatcgatgatgacgtcaaactgcaggcaacggtagaaggcggtaacgacgacgattacctgcaggcaggtggtggcaggaccagcctctacgggggcaagggccgggatgtcatgcgcctgggcagcggcctcggctatgcggagggcaacgacgatgacgacacactgatcggcggcagcggcaatgccgcgatgtacggtaacaacggcaaggacctgctcattggcggtttcggccccgagggcaaacagacctacatggacggtggcaacgacgacgatgcactgctctcgggcaacgggcaaaccgtggcccacgggggcaatggcaatgatgtattcgtgggcgctggccgtacgaccttctataccggcaaaggccaggacagtatctggaataaccgccgtgaggatcgaatctacggcaaaaccggtgatgccttcgaccgcgccagcggttcgacattcatcgaggtcaagcccagcgacgccggccagcacggtttcacactgttggaatcagtcgaatcaaccgagcaggaaaacgaagatttcagacagcgagtggccgacgacctcgagttcctgcgcagttcacctatcggtcagcaggcgctcactgaaatggatgcaatcgcgatggtgaatcaaggcaaagtcagcattgctccgatcagccaggacggctccagttatgaattcgacagtactgaactggatagcctgacagagcagcaagcgcaaaaccttgacggtgctgcattgggagaaatgaaagatggcgttgccggctcaagggccaatcgcgcagtgatctactacgacccggcgcagatcgtggaaaacagccaacacacccatctgcgaccgccgattggcgtgtttttccatgagcttgcccacgcctacaatggcgccaccgggacgctgctgccaggcgagaccttggaaatttcacgatcgggtggaaccaacccggtcaataacttcgaacaccaggccgtgggcttgaccagcgacaatcccaggcattttaccgagaacggtttgtatgaagaaatgggaacccccctaaggcctaattaccataaggacagcatcggcatgtaggccctcttgcacgcagcagaggggggattgggtttaccggagcgaacggaaatgttccgcatcacgaaggtcgtcagcccccgggaacgatcgcgcctgagcctccacacaatggcgatcctgaggcaaattcaggttttcatcgtgagtcaatgaaaggaaggcaccatgctgttccccctgacgtacctggcaacattttacagtcccccacccgcctccaaaccgtcacccttcgaccctccgccggatctgacgcctggtaccagcgaacggagaattcacctgctccatgccgacggtgatactcaaatcagcagggtcattgactgggattcatcgccgcccaaagacccggaagttatcggcaactggctctatatagaaaccggtgatcgtgcagaccacattcatatccgaagttaccccggcgacaagctgcagatcctcatcaacggcaaggaatacttgttcgagaaacaggaaggaggtcatagacaagcgctgtggatagacgccaaaggtggtgatgacaccgtgatcgtcgacgatgacgtcaagctgaccctggacattgaaggcggggatggagacgactatatccagggcggcggcggcaggaccaggctctacggcggtcagggaaatgacttcatgcggttgggcagcggcctgggttatgcagcgggcaacgaaggcgatgacactctgatcggtggaagcggcaataacgtgatgtacggcaaccagggccgggatgatcttcacgcagggctcggcccttcgaccaaacagagctacctggacggcggcgacgaccaggacaggctcttcgggggcagcgggcataatgtgctaaatggcggcaacggtgatgatcatttggtcgggcatgaccgcacgaccttctacaccggcaaaggccatgacgctatctggaacaatcgacacagggaccgcatctatgtcggcgccgctgattatttcgatcgcacccaaggttcggcctttaccctggtgaacccaagcaaagccggtgaccagggtttcactgtgcaagacggcacacatggcttcaaacagcaggtcgccgacgacattgagtttcttcgcagttcccccataggccagcaagctctggcgaaaatggatgaactggcggcacgcaatggcggcagcgtcagcatcgaacccggcggtgacagcgaggtggcctacctgtatggcagcaccgaattggaaaacgtggcgcccgaagtcagaaagacgatggacgacagcaaatggggcgttctcaaaaatggcgttccaggctcccgcgctgatcgagcgcgtattttttatgctcatccgtctacgctggagagcgctgaccgcaccaacacgaccgtacccgtcacggctctcttccatgagattgcccatgcctacaatggtgcaaccggtaccttcctggcaggtacaagcaccgagcaactggaatcgggcatctcgaaaaccgtcaacaatgacgaacttcaagccataggcctgcccaacagtgcaacgcctttcgacttcgacaacgacccttcaacgcccccaggcacgatcaatccgccccccttcaccgaaaacgccttgaacgaagagatgggtaagccactgagggcgatctacaatttcgaagtcagtcaccagggcgacggcgcctgaggcgccatgggcacgccgcccacccggcgacccaaagaatgcgcgcagggcggtcggcaattggacctccctgcactgacgctttccgacttcgcaccttggcgcctaaagctcagccgttcctcgccgatagcccgacgaagctctaacaaagccgcgtcgacaataacgcttcgtaaggacgacctcccatgcccccactgcgctccattcaagcccgctataccctgttcctggtgctattcgtcctggtgttattcgtattgaccgtggtgggtatcggccagttggtcgcgcccaagctgcagcacaccgaagaacaggtggtgctcaatcgcgtggccgaagtggccgaacagatccagggcgaactgaacaaggtccaggcccagcaacgcagcatcacccagaccatccccttgctcgacagcgatgccatcgacaaggtcttgcccggcctggtggatcaatacggcgagctgaaagtatttggcggcggtatctggccgctgcctaaccagcgtacgccggggcgtaacaagcacagtacgttctggcaccgcgatgcctccggcaagctggcggtcaacaccttctggaacagcgacccggcccccaactattacgaccagagctggtacaagggcggcctcgcctccccacgcggtcaatgtgcctgggccgccgcctacaaggatgatgccagccaggagccgcgcaccaactgcgccatggcgatccagcgtgacggcgccgcttatggcgtggccactatcgacgtgaccctgggtttcttcaatgagctggtggccagcaaggaaaaagacatcggcgggcaaatgctgatcgtcgaggccgatggcaagatcatcagcaacagcacgcgcttgagtagcccggtagtgttgaagaacatcagcgaactgaccggcacctcggccttcgccgcgcaggtcagcaaagccctggcccatcgcgaccagggctcacaacgcagtgaattcgacaaccagggcgtggccagcaccttctacatgcgtgccatcgagggcacgccgtggttcctcgccaccgccctgcccacctcgctgatcaccgcccagcgtaatgatgtgctcggcagcctggccctggtgcagatccccatggtgttgctgctggtgctgctggccgcctatgccatccgccaactggtgcagcgcatgaaaacgctgaaaaccaatattgacgccctctctaccggcgacgccgacctgacgcgacggatcaccatccgggccgaagacgagttgggcgctatcggccactcggtgaaccgctttatcgtttacctgcaaaacatgatcggcgaagtgacccaagccactggcgccatgtcgtccgggcttgaacagttgcaacgaacatcagcccataccaaccagatcctggtcaggcatgcctcggaaaccgaccagacggtcaccgccatcaccgaaatgagctccaccgccgacaccgtggcgcaaaacgccgccgagaccgcctcgttcacccagcgtgcaaacgaacatgccgaccgctcccgggtggtggtgggtgaagcgtccaccagcgtcagcgcgttgatcggtgaagtggccagcgccacccacaccgtggaaaatatgcgccaggatgccgcacgcatcaccgaaaccctcggcgtgatcggcgccattgccggccagaccaacctgctggcgctcaacgctgcgattgaagcggcgcgggccggcgagcaaggccgggggtttgctgtggtagccgacgaagtgcgcgcactggcggcccgcacccaggccagcacctcgcagatcaacgagatgctggcacgcctgaccaccggcgtgagttcctcggtcgccgccatggaaaacacccaggccagttgccaatcagcagcggatgccacagcgcgggtcaacaccggcctggatgagatggccggttcggtcagccatatcaacaacctcagcacccagatcgctacggccgccgagcagcaaagtgcggtgaccgaggagatcaaccgcagcatggtgcagatccgccatatggtcgatgaactggtacaaagcgggcataccacgcaaatcaatacccagagcctgctggaggccaatggccgggtgatcagcttgatggggcgctttaaagtacgctgatcaatgctatgaatactcccgtgctgagcgcgggagtcgactatcctgagagctcccagtgttataacgcgccacacaggaggtgtgccatgcatgcgactgagcattcgatccgcttggagcggatcagtcaggagtgcttcatccaggcacctgtcgatagggtctacgcctatgtgacccagcccgaccgctggcacgaatggcaccccacctctctcaatgccgacactgggaccaccggctcagtgccggtaggtgtgcgttttactgaaaccattgatttgctgggcatacgcgtccccatgagttaccgcgtgcaaattgcccgttgccccaatgagttcagggctgtgtttacctcattggccgtggacggtgctatccattatttcctgcaacctcatcgtaacggcacgctgttcaagcgcgtactgacgtatgagaccgagttgcagctcgcaaccttgcacgaacacattgccaagcggtccgccatcgcgctggatcagctcaagtgccggctggagagcccctgcttcgtataatttagaaacactactgcgtcgccccgatgcgaaaagcagggagaatgcccgatttattgccgcgctttcagtgagacccccgatgaaaaacccattgcgactggccatgctctcctgcgtcctgctctccactctcgcccaggccgccgacctgatccccatcgatgtgcaccgcgacgccaactgcggctgctgcaaaaagtggatcagccacttggagagcaacggtttcaaggtcaatgaccatgtcgaaacagacatgagcgcagtcaagcaacgcctgggcgtcgcaccacgcctgggttcatgccataccgcagtgatcgacggcaaattcgtcgaaggccatgtgcccgccgagcaagtgctggccctgcgcaaacgcaacgatctgctcggcctcgccgcgccgggcatgcccctgggctcgccaggcatggaagtggaaggtcgcagcgaggcgtatcaagtcatcggcctgacccgtgacggtaaagacatagtggtggccgaatacccagcacactgaccggtgctgatgggttacctggggctgttcgccgcggcgtttggtgccgccacgttactgcccttgcaatcggaagccgtgctggtcggcctgctgctcagcgggcattaccacctgtggctgctgctgggcatcgccacgttgggcaatgtgctcggttcgctggtcaattggctgctggggcgctcggtggaacgcttcaaggcgcggcgttggtttccgatcagcgccaagcaactggaaaaagctcgcaggcattactcgcgctgggggcattggacgttactgctcagttggatgcccatagtcggcgatccgctgaccttggtggccggggtgatgcgtgaaccgctgtggcgtttcttactgctggtcaccctggccaaaggcgtacgttatggggtgctcgcagcgctgaccctgcagtgggtgttaatccccagttaatctcttccaaagagcatccggtcatctctcttggagctggaacccatgccttcaatccgtgcgttgtgcgtcgctggcctgttgtcaggcgctgccgctcccgtgttcgctgccacctatggccccgagctgcaagggtttcaatacccttatccgctggagcatttcaccttccagtcccaaggcaaatccctgcaaatgggctacatggacgtcccccccaaaggcatagccaacggccgcagcgtggtgctgatgcacggcaagaacttctgcggtgccacctgggaaggttcgataaaggcgttgagcgacgccggttaccgcgtgatcgcgccggaccagatcggcttctgcacttccagcaaacccgaccactaccagtacagcttccagcaactggcgaccaacacccaccaattgctggaaaaactcggcatccagaaggcaacggtgatcggccattccaccggcggcatgctcgccacgcgttatgcactgatgtaccccaaccaaaccgaacaactcgggctggtgaaccctatcggcctggaagactggaaggccctgggcgtgccctaccagagcgtcgaccagtggtatcagcgcgagctgaacctgagcgccgacggcgtgcgcaaatatgagcgcgacacctattacgtcggacgctggaaacccgaatacgagcgctgggtggatatgctcgccggcctgaacaagggcccggggcacacccaggtcgcctggaactcggcgttgatctacgacatgatcttcacccagccggtgtactacgaattcaaggacttgcaggtgcccaccttgctgctgatcggcaccagcgacaccaccgccatcggcaaagatgtcgcgccgccggcagtcaaggccaggattggcaattaccaagtgctgggcaagcaggtggccaagctgattccccacgccaccctcgtggaattcccaggcttgggccatgcgccacagatggaagagccggagcagtttcataaagcgctgttgcagggtatgaaaactctttgatccaacctttgcgaggcaagcgtaaatgtcggtacagattgcagtgatggatgattggcagaatgtagccaggggcgtggtggattggtcggttctggacgccgtgggccaagtgcattttctccacgattaccccgccgacaccgccacgatggtcgagcgtttgcagcgctttgacgtgatttgcctgatgcgcgaacgctcaaccttcgacaaggcgctgctgcaaggtctgccgacgctcaaattgctggtgaccggcggcatgcgcaatgcggctatcgacattcccgccgccaaggccctgggtattcaggtgtgcggcaccgacagctacaaacatgcggcaccggaactgacttgggcgttgatcatggcttccacgcgcaatctgcttgccgaagccaactcgctacgcgcaggcggctggcaggttggcctgggcggcgacctgcatggcaaaaccttggcaatcctcggcctgggcagtatcggccagaaggtcgcccggttcggccaggtgttcggcatgcgggtgattgcctggagtgagaacctcacgccgcagcgggcggcagaatctggggtcacctgggtcagcaagcgcgaactgttcgagcaggccgatatcctgagcattcatttagtgctcagtgagcgcagccgtggcttggtggatacccgggcgttgggctggatgaaaccgacggcgcgcctggtcaacaccgcacgcgggccgattgtggacgagcaggcgctcgtgcaggcgctaagcagtggccgcctggccggagcggcgctggacgtatacgccgaggaaccgctgccggctgaccatccgttgcgtcgcttgccgaatgtgctggcgacgccccacatcgggtatgtgagcgagcagaattatcggcagttctatcagcagatgatcgaggatatccaggcctgggccagcggcgtgcctgttcggatactcggttgacgcaccagatcagtgcgagcgccgtgctgggtctgccccttgcaggagctagcttgctcgcggaaaccgtcattgattcaaggtgtgcgcggcgctcttgagtgcttcgcgagcaagctcgctcctacagtagagaggaggctaatcgccagcagcctaagcttaaaagatttttgtcctacaaaatcccgctgaaaaccctacaggcgctgggatctatcctagactgaggaccgatgggtccgttccaaaacaaaaaccccgcaaaaaatcgaaactttcgaactctgccgcaggtccagttttaggtaaggacgagcacacgcgactcacgccaaatgcccgtccatccaatcttttttagcctgagccgcaactggcatacgccttgccagcttgtacagcgcttgtgtgcctggccgcaggatgcggtcaatcggagccaatggcagcgggccattagccgaccaacagatgggagtgcattatgatcagtgccgcagtagatactcagggagagcgttttagtcagccggcaggggggcctaagtctttggccgacctgcccaacactgtgcggccgatcgtgagtcagaacccgaatcgaaagaaagtgttgttcgtcacctccgaattcgccgacctggtgaaaaccggtggcctgggcgacgtgtccgctgccctgccccgcgccatggcccacctgcacgatgtgcgggtgctgatccccggttacccgcaggtgatggaaagcgacaacccgattcacattgtcggtgagctgggcggccacgccgcgttgccaccctgcaagatcgggcgcatggacctcaaggacggcttggtcatctatgtgctgatctgccccgagctgtacgagcgcgaaggcacgccctacggtgccaataatggccgcgactggccggacaaccatattcgcttcgcccgcctgggcctggccgccgccgatatggccgccaacctggcgcaaatacactggtgcccggacttggtgcacgcccacgactggcccgctggcctggccccggcgtatatgcactggcgtgggtcacgcacgccgacgttgttcaccattcataacctggcctaccagggcgtggtgagcctggcgtcgacgcccgagctgggcattccgccccacgccttgcaacaggaaggtatggagttctacggcaagatgtcctttctcaaggccggcatggcctattccagccatatcaccaccgtgagcgccacctacgcccaggaaatcaccaccccggaattcggctgcgggctggatgggtttctcgccagcaagacccagcaaggtctgctcagcgggattcccaacggcatcgacgaaagctgggaaacctccaccgacacgcacctgacccacaacttcaatatcggcgactgggaaggcaaggccataaacgccgcccatgtgcgcgagctgtttgggctgcagccatccagtggcccgctgttcgcggtggtgtcgcgcctggtctaccagaagggcctggacctgaccgaggcggtcgccgatttcatcgtcgagaacggcggccaaatcgcgatcatcggccgcggcgagccggaagaagaacatgccatgcgcgagttggcgttgcgattcccgggccaggtgggcgtgcgcatcggcttcaacgagaccgatgctcggcgcatgttcgccggcagcgacttcctgctgatgccgtcgcgctatgagccttgcggcctgagccagatgtatgcacagcgcttcggctcgttgccggtggcacgtaacaccggcggcctggcggacaccattgaaaatggcgtcactggttttctgttcaacgagtccactgtggacagctacaaggaagccctgagccgcgccttcaaggtctttgccctgcctggcctgcttaacgccatgcgcagctgcgccatgacccaacccttcaactggtgccaggcggtagaaccctacgccgaactctacgaacaactggtggccaaggccctggggaaatcgactaaataatcattgggagggcttcatagatgccactacggactctggaaacctggccccacggcgcaatcatgctggacgcgcaacacacgcgttttgccctgtgggcgccagacgcgttttatgtcagcgttgaattggaacacgggaaatccatcgccatgctgccccaggcagatggctggttcgaattaacaacagcgtgccccgccggcacgctctaccgctttaacatcgatggggaaaaggcggtgcccgaccccgcgtccagggcccaggccgtggatgtgcacggttggagccgagtggttgacccgcaggcctatgagtggcgccatagtcagtggcaaggccgcccctggcatacggcggtgatctacgaactgcacgtaggcgccatgggcggttacgccgaggtggagaagcacttgccgcgcctggccgagctgggcatcaccgccattgaactgatgcctctggcgcaatttcccggcgaacgcaattggggctacgacggcgtgctgccctacgcgccccacgcctcatatggctcacccgagcaactcaagcacctgatcgacagcgcccatgcccacggcctcgccgtgatcctggatgtggtctacaaccacttcgggcccgacggcaattacctgggtcagtacgcacaggggttcttccaggaagacgtgcacacgccctggggcgccggcatcgatttcgaacgccgtgaagtacgggatttcttcctcgataacgccttgatgtggttgctggaataccgcttcgacggcctgcgcctggatgcggtgcacgccatcgataatcccggtttcctgaaggaacttgcgcagcgagtgcgtcagcgggtcgacagcgggcgtcacgtctggctgatgctggaaaacgagctgaaccaggccagcctgttaaaggaggatttcgacgcccaatggaatgatgactttcataacgtgctgcatgtactgctcaccggcgaaacagatgcctattacagcgactttgccgaacagcctaccgccaagttggcgcgctgtctgggcgaagggtttatctaccagggcgataccacccgccatggtcatgcacgcggcgaacccagtgccgatcttccgcccagcgccttcgtggcgttcctgcagaaccacgaccaggtcggtaaccgcgccctgggcgaacgcctgcaccagctttgctcgccccaggcgctgaaagcggcgaccgccctgttgttgctgtgccccatgattccgatgatcttcatgggcgatgaggtcaacgccaccgaacccttcctgtttttcaccgaccatcacggtgaactggccgaggcggtgcgcgaaggtcggcgcaatgagttcgctgatttcgccgcgtttcacgaccccgaacaacgcgagcgcatccccgaccccaacgcgttgcccaccttcctgcaatcgatgccttcatttgtagaaaacgaccatgcccagctctatcgtcacctgctgagcctgcgccacctgcatgtggcgccgcacttgcccggcgcgatggccttgggcgcacaggtgctggccgagggcgccgtcatggcgcgttggcgcttgggcaacggcagcctgttgcagatcgacctgaacctgggcgaacagcccctggaccacccagcccctcgacacctcatcttccaaacgccggccgagcaaggtgcgcagttgccaccctacagcgcccgcgtatccctattccctgctggagaagacttttgagcgaagcgaacctggaactactcgccagccgtgcgggcctggccgtcgactggatcgatgccaacggtcgcccgcaacatgtgcaagccgatgccctgcgtgcggttctcaaagggctggggcacccggccgacaccgatgccgagatcgacgccagcctgcgcgagcttgagcaagtacaacaagacacccacctgccgccgttgatgactaccgacagcggtgaaggcctggacctggcgcgctacttcgcagcggataccccgtgtcgcgtcagcctcgaaggcggtgaaaccctggagctgcgccttgacggcgatgccgtgttgcccggtgtgatcgccctcggctaccaccaggtacatatcgacgggcaaaccttcaccctggccgttgctcccgcccactgctacagcgtggccgacgcggtggacagccgccccgcccgggcctggggtttgagcgcgcaactgtatgccctgcgccgcctaggcgatggcggcttcggcgacaccctggccctggagcatctggtgcgcgcggcggccgagcgcggtgccgaggcggtggcgatcagcccgatgcacgcgatgttcagcgccgacaccgaacgtttcagcccttattcgccgtccagccgcttgtttctcaacagcctgtatgcttcgcccgcgtgcatcctgggtgaacgtgaagtgcgcaacgccatcgaagccgccgggctggcggacgaactgcacgcactggagcaactgcccctgatcgattggcccgccgccgccaaggccaagcaacgcctgttgcggacgctgtatgaagacttccgccacggcgcgcacccgcagcatgccgacttccagagcttccgccagtgcggcggcgaagccctggaaaaccactgccgtttcgaagccatacaagcccagcgcgccgccgccggcgaagacctcgattggcgccactggcccgaagcctggcgcaccccgcaaagcccggccctcgcgcagttcgccgagcaaaaccgcgatgagatcggttacttcgccttcacccaatggctgatcgcccgcagcctggagcgcgcacaacaagccgcccgtggcagcggcatgggcatcggcctgatcgccgacctggcggtgggcgcggacggcggtggcagccaggcctggagccgccaggatgagctgctggccgacctgaccgtgggtgcgccgccggacattcttaaccgcgcgggtcagggctggggcatctcggcgttttcccctgagggcctcaagcgccatggctatcgagcctttatcgagatgctgcgggccaactttgcccatgccggcggcttgcgtatcgatcatgtaatgggcctgcagcgcctgtgggtcattcctctgggtgcttcgcccgatgaaggtgcctacctgtattacccggtggacgacctgctgcgcctgctggccctggaatcccaccgccaccaggccatcgtcctcggtgaagacctcggcaccgtgcccgacggcctgcgcgaaaagctcagcgcccgctcgatcctgggcatgcgggtgctgctgttcgaacagaaccatgaaggccaattcaagccgatcctggactggcccgacaacgccttggccaccaccagcacccatgacttacccaccctcaacggttggtggcacagccgcgatatcgaatggaatatccaactcggcctgatcgacgccccgaccgtggagcaatggagcgagcaccgcctgaacgaacgccaggcgctacgccaggccttgggccaggacccgcagaactttgtcgatgaaatacgcaacgacaccgaccatatgatcgacgccagtgtgcgctacctggggcacacccgcgcgccactggtattgctgccgctggaggacgcgctgggcatccaggagcaagccaacctgcccggcaccctcgatacccaccccaattggcgccgtcgcctgccaggcgaggccgccagcctgctcgacaataatagtgctgcgcgccgcctcgaactgctggccgtggcgcgcaaccaagcttatgagcgtgaccgatgaaagcactgcccctgcgcgcaacccagcgcctgcaatttcataaagactttaccctcgatgacgcggtgccgctggtgccgtatttcgcccagcttggcatcagtcatctgtatgcctcgccgctgctgagcgcccgcgccggctccatgcatggctatgatgtggtcgaccccacccgtgtcaacccggagctgggcggcgaagcggcgctgcggcgcctggtcgccgccttgcgtgagcacgatatgggcctgatcctcgatatcgtctccaaccatatggcggtgggcggtgcggataacccctggtggctggacctgctggagtggggccgcttgagcccgtacagcgaattcttcgatatccagtggcattcgcccgaccccctgctcaaaggccaattgctcatgccgttcctgggcagcgattacggtgaagccctgcagagcggtacgctgaccctcaagttcgatgcggctcacggggccttctacgccgaacactacgaacatcgctttccgatctgcccaagggactacgccttgatccttggccacgacgaggggctcaagccgctggccgagcgctttgccgccctcgcctatcaggacgacgcctacgccgaagccgcctggctcaagcaagcgctggccgaacacgctaccgaagtactgccggctatcgaacagcggctggccgccttcgatggtcgccagcccgagggcttcgagcgcctgcatcatctgctcgaacaacaggcttaccgcctggccagctggcgcaccgccgctgatgatatcaactggcggcgcttcttcgacgtcaatgagctgggcggcttgcgtgtagaacgcacggcggtgttcgaagccacccacggcaagattttcgagctgatcagcgaaggcctggtggatgggttgcgcatcgaccatatcgacggcctggccgacccgcggggctattgccgtaagttgcgtcgccgcgtggatgctttgtcgccccagcgccacttgccgatcttcgtggaaaagatcctcggtgacggggaaaccctgcgtggagactggcaggtcgacggcaccaccggctacgaattcatgaaccaactgtcattgctgcaacaccacccagacggctttgccccgctggccgagttgtggacgcggcacagcgaacgcccttcgacgtttatcgaagaggcccggctggcgcgccagcagatcctcaacggctcgttgggcggcgacttcgaaagcgtggcccaggccctgctgcaagtggcccgcgacgatgtgatgacccgcgacctgaccctcggcgccatccgccgggccttgcaggaattgatcgtgcatttcccggtgtaccgcacctacatcagcgccaggggccgcagtgcggccgacgacaagatattccggcaggccatggacggagcgcgcagcaccctcaatgaaagcgactggccggtgcttgaacacctggaaaaatggctgggtggtcagccctggcgcaatcgcccggtgggccgtgaacgcaagatcctcaagcatgcctgcgtgcgcttccagcagctgacttcgcccgccgccgccaaggccgtggaagacaccgcgttctatcgctcggcagtgctgctgtcgcgtaatgatgtgggcttcagcaccgaacagttcagtgcgccgttggcggacttccacgccgccaatcaacagcgcctggaggccttcccggacaacctgctggccacggccacccacgaccataaacgcggcgaagacacccgcgcccgcctggcggtgctgagcgagtgcgcgccctggtatgccgaacaggtcgagcactggcgcagcctggcggcgcccttgcgggaaaatgctgatagcccctcggcgggtgatgagctgattttatatcaggtgctgctcggcagctggccgctggagcacaacccagacttggaggcctaccagcaacgcctctggcagtggcagcaaaaagccctgcgcgaggccaagttgcagagcagttggagcgcccccaacgaggcctatgaacaaggtgtcgaaggtttcctcaagcgcctgttactcagtgacgccggtgcgccgttgcgtagtgcgctggacagcgccgcccaggccatcgcacccgccggtgccctgaacgggctggcgcaaaccttgcttcatctcaccgtgccgggcgtaccggatgtgtatcagggcgatgagttctgggacttcagcctggtggacccggacaaccgtcgcccggtggatttcgctgcacggcaacgtgcactggataccccaacggacatcggcgaactgttgttcaactggcgtgacgggcgaatcaaacaggcgttgatcgcccaggtgttgggcttgcgcaaaacctgtcccgagctgttccgccacggcagctacaccgcgctggaagtggtcggccagcatgccgagcgggtggtcgcgttctaccgccaacatcaaggccaacagctgctggtggtggtgccgcgctggccttatcaactgctggaaaacggcatgtttccccaggtcaatgcgccggtttggggcgacacgcgggttaaattaccgttcgccgccacaacacaaaactggaagggactttttcaaacacgcgcagtcacacccaacaaggagctgttgatcagcgctgccctgggggatctcccggtcaatgtctttatcaatcctgataatcaagaaagctgaacattttctgtgaggagtttgtgatgagtaaagaagaggaacgcatccgcgaattggcgcatcagatctgggagtccgaaggcaagccacacggcgaggatgcccgccactgggagatggcgcgcaagctggccgaagccgaagcgctgacccccagcaagcccaagccagccgccaagccgaaaaccgcgcccaaggccgccgccaagcctaaggcggcggcaccggctgcagcaaagcctgcggcgaaaaaaccggccgcgccgaaaaaacccaaaccgccagcgccatgatcccttgggcctccgtactggaggcccgtttgcgtccacgtgattcgctgaagcaccgtcagcacggttgcgctcggcccgaaaaaagactttttgcaggagcaactcaatgagcaaacccgataaagctacagcgacgcaggaacatgaaccgtcgcggattcgtgaaggtttgcccttccccctcggtgctacctgggatggcctgggtgtcaacttcgcactgttctcggccaacgccaccaaagtcgagctgtgcctgttcgacgatgccggcgaggtagagctggagcgcatcgaactgcccgagtacaccgacgagatcttccacggctacctgcccgacgcccatcccgggctgatttacggctaccgcgtgtatggcgcttatgacccggccaatggtcaccgtttcaaccacaacaaactgctgatcgacccctacgccaaacagttggtgggtgagctcaagtggtccgaggcgttgtttggctacaccatcggccacccggacgacgacctcagtttcgatgaacgcgacagcgcgcccttcgtgcccaagtgcaaggtcatcgacccggcgcacacgtggggcaacgatcaaccggtccgggtaccatgggaccgtacgatcatctatgaaacccacctgcgcggcatcagcatgcgccacccttcggtgggcgagtcggtgcgcggcacctgcgccggcctgatggaagacgacgtgctcaagcacatccgccagctgggtatttcctcggtcgaactgctgccagtgcacgccttcgttaacgaccagcatctgctggaaaagggcatgaccaactactggggctataacagcattgcgttcttcgcccccgacccgcgctacttggccagcggcaagattgccgagttcaaggagatggtcgcgcacctgcatgagcagaagctggaagtgattctcgacgtggtctacaaccacaccgccgaaggcaacgagcgcggcccgaccctgtccatgcgcggcatcgacaacgcctcctactaccggctgatgcccgatgacaagcgcttctacatcaatgattcgggcaccggcaacaccctggatctgagccacccctgtgtgctgcaaatggtcaccgactcgctgcgctactgggccaccgaaatgcatgtggacggtttccgcttcgacctggcaactattctggggcgctaccgcgatggcttcgatgagcgccacagtttcctcgtcgcttgccgccaggacccgatactgcgccagttgaaactgatcgccgaaccctgggactgcggccccggtggttatcaagtgggcaacttcccgccaggctgggtggaatggaacgaccgcttccgcgatacggtgcgcgcgttctggaaaggcgacgacggccaactggcggatttcgccgggcgcatgaccgcttcgggcgagatgttcaatcatcgcggacgccggccatacagctcggtgaacttcatcaccgcccacgacggtttcaccttgcacgacctggtctcgtacaacgacaagcacaacgaggccaacgacgaaaacaaccaggacggtagcaacaacaacctgtcttggaaccacggcgtcgaaggccccaccgacgatccggaaatcaacgaactgcgcctgcgccagatgcgcaatttcttcgccaccctgctgctggcccaaggcacgccgatgagtcgtcgccggggacgagttcgcccgtacccagcatggcaataacaacgcctattgccaggatagtgagataggctgggtcaattgggacctggacgacgacggcaaggccctgctcaagttcgtcaagcgcctgatcaagctgcgcctggcgtatccgatcctgcgccgtgggcgcttcctggtcggcgactacaacgaagatatcggcgtgaaggacgtcacctggttggcgccggatggcaacgagatgaccaccgagcaatgggaagacagccagggccgctgcctgggcatgctgatggatggccgcgcccaggagaccgggattcggcgtgccggtgcggacgcgaccttgctgctggtggtcaatgcccatcacgacatggtcaatttccgcctgccgccggtgccagagggtgagttctggacctgcatgctcgacaccaacgacccggcggtacgcggtcaggagcgctttgatttcgagcatgaatacgcggtaaccggccggtcgctgctgttgtttgaactgcaacgcgaaggcgaggtgtgagatggcgttgcacggtttccttcagggttaccgcggttatgcggatacgcaggccctgggtgacgcactgaaggcactccaagaggaaggtctggatcaactgccgctgcccggcagtggccagaccctggcccgcttcagcgggctggcgcaggtggcggggcatgatttgcgcttgtgcaagttgttcgaaggccataccgatgcgttggcgatcattgccgaactcgacagcccgctgccgccgctgggcagtacatggggcatgtgggcatctgagccgccgaccgccaaagtgcgggtgcgacacgctggccagcggctcgtggtagatgggcgcaaggcgtggtgctccggcgcggcggtggtcagccatggcttgctgaccgcctgggacgaagaggatcgccagcagctggtggcggtggcaatggatcaacctggcgtgacggtcaccgatgaagggtggagtgccgtgggcatggcggccacgggcagcgtcgaagtgctgttccacgaggcccggggcgttgcggtcggcggcccgggcgattacctgtcccgtccaggtttctggcacggcgggatcggcattgccgcatgttggtacggcgccgcgcagcgcctgggtgaagtgttgcgcgcccactgtgcccagcgccccgagccccatgccctggcccatctcggcgccgtcgacagcgccctgaacagtgccgcttgcgtgctacgcgccagcgccgagcagatcgaccgcgagccgagcgcggatgcccggcaactggcgcaacaggcacgggcctgtatcgaggacgccgtcgaacaggtcatgcatcacgtcggtcgtggcgtcggtgcggggccttattgcaaggacccacactttgcccagttgatggcggacttgccggtgtatgtgcggcaaagccatgccgagcgcgaccttgccgccctgggcgaacaggttgccggcgaccccttagggaggtggcagttatgaagcccaatccgattgtcggtcagggtacatcgctcaatcactggcaaacctcgacgcggctggccgagttgccgcacatcagcgtcgcgcagttggtacccgaggggcatcgcgcggtgatcatcgccccgcatccggacgatgaagtgctcggcagcggtggcttgctgcaaggtctggcgctgctgggccggcccatccagttgatctccgtgaccgacggcagtgccagtcatcccggctcccggcgttggccggtggagcgcctgagcgtagtgcgcccccaggagtcggcccaagccctgcatcgcctcggcttgccgctgcacagtttgaaatggctgcgcgccgggtttgccgacagcaaagtggccgagcgcgaagcccagctctgcgagtttatccagcgccacctaaaacccaccgacgtggtgttcgccacctggcgcgaagacggccattgcgaccatgaagccgtaggccgcgccagcgccaaggccgcccaggccgttggcgcaaccttgtatgaactgccggtgtggacttggcactgggccacggctgaagacgacatggtgccttggcatcgggcgcgcaaaatcccgttgaccatcgaggccgtggcgcgcaaacgccatgcgatccacgccttcgccagccagctggaaggcgatccgcaaatcggcctgccgccggtactggcgccctatgtggtggagcgcttgctgcaaccttttgaagtggtgttcgtatgagtgtggcaaccccctacttcgaccaactgtttgccggcaacgatgacccctgggcctttcgtcagcgctggtacgaacaacgcaagcgcgccctgacactggccgtgctgacccggtcgcattacgtctcgatctttgaacctggctgtgccaacggcgaattgagcgctgaactggcgagtcgttgcgatcgcctggtgtgctgcgacgcgacccaggcagcggtgctgctggcacaaacgcggctggcagatttcccccacgctctggtggaacagcgtcgcctgcccgggcaatggcccgccggcgagtttgagctgatcgtactgagtgagctgtgttattacctggatgccgatgacttgcatcgcctgatcgactgcgccctcgccgccttgaccgctgacggtcagttgctggcttgtcattggcgcccgcccatcgagggttgcccgcaaaccgccgaacaggtgcacgccctgctccagcagcggctgggtatgtcgcccctggcgcagtaccatgaccaggatttcctgctcgacctgtggagccgtgagggtacctcggtcgcacaccacgagggtttgcgatgatcggtattctgatcccggtgcataacgaagaagcgctgctgggcgactgcctgagggctgcgcagatcgctgccaaccatcccggcctgctgggggaagcggtgcagatcctggtggtgctcgacagctgcaccgacggcagcgctgcgatcgcccaggcgcatcgggtgcacagcctgccggtgcaggcgcgcaatgtggggcaagcccgaggtgacggcgcacggcatttattaaacctgggcgcacgctggatttcctgtaccgacgccgacagccgcgtggcccctgactggctggtggcgcaactggccctgggctgcgatgccgtgtgtggcacggtgacggtggatgcctggagcgaaggcttcgactcggcggcacagattcgttatcaccaggcttaccaagcccgcgatgggcatcggcacatccatggcgccaacctgggagtgagcgccagcgcctacgtgcaggccggtgggttcgagccgctggcctgccatgaagatgtgcaactggtgcgcgagctggaacgttgcggcgcctcgattgcctggagccatgcacctcaagtggtgaccagtgcgcgcctggactgtcgcgcccagggcgggttcggcgactacttgagaagtctgatgcaggtttcgtaaaaaaacgacacgccaacgtgtaaaagcgccagatccttgtctatgctcataacgccttgcacggcacgccaggattggcgtgccgtgcactcaccccagcggagcctggggtaaaaacaagagcgtcgtcccgtcaacggggtacgacccagcattgaccgacaaggatatgtcaccccatgaagcctgcctccctaagcgaagcccgtcgcggccccgcgcaaatctggaacagtgcgccgcagctggcacaggttcccgtcatcgcactcaccagcctggtgccgcccggcgcacgcgtcgtggtcatcgccccgcacccgggcgatgaagtactggcctgcggtggtttgctgcaactgctcagtacccgcgaacaccccttgcaattgatctccatcaccgatggcagcgccagccaccccggctcccacgtgtggccggccagccgcttgagcgtggtgcgcccccaggaaagcgccgaagcgttgcgtcgactgggcatgccgttgcacagcctgaaatggatccgcggcgggtttcgcgatgacgcgctggccgcccacgaacaggcgatgagccagttcatcgcgcgctacctgcaaccgggtgacagggtatttaccacgtggtgccgcgacggtaatgacgatcacgatgccgtcggccgcgccagcgccaaggcctgcagcctggtgggggccaggctgtatgaactgccggtctgggcctggcactggccggcacgggaggcttcgatgatcccctggcagcgcgcacgcaaggtacgcctggatacctggagcgtggcgcgcaagctgcacgcgacccatgcctatgccagccaattggtcggcgatccgcagatcggtttaccgcccaagcttgcccaagtgttgctcgagcgtatacgcgaaccctacgagatcgtatttgcctagacgtcggctcgtctatacctgttatttcttacagtagcagccgatcaaatctacggctaaggtgcaaaaagtcctgcacaggttaaggtgcagtcgagaaagccatgccaaccctttgcattggccggtgttttcagatgcaggtaacccgtagtccctgatccgtatcgagttcgtcgttgccatggttttgaaccgcgcctggtatcccaggtgccgggacatcaatgtgctcaagcgagggccgaccatgcgcacacggatcacttctctgttgtactcaggcattgcctcagcgattgtactggcggcctggccgctggcctcgtatggggcgtgtaccatcaacaacacggcgggcagcgacacctccagctgcgacagcgccaccgcgccgggctttagcgataacggcggtgataacaccctcgaaatcaccgcaaccggcagagtgagcggaaatgtggtgtacggaggcggcaatgatctggtcgatgtgaacggcccaagcgccgggatcgatggcagcctcgaccaaggcgacggcaacaatattttccggctcaacctgggcagtatcaccgggtcggtcagccagggctcgggcgccgatatcgcgcagatttccgggggccaggcaggtaaagtcacccaggggtcaggcatcgaccattttgccatgagcggcggcaccatcgcctcgctggaacagggcgacgggctggacgtgttcttcatgagcggcggtacgatcaccggggctttcgaggacggcgacgaggcgacaatgaccgaaggcatcatcggccgggtcaacatgaaactcgatgacaaccggttcgatatgtctggcggtacgatcatcggcaatctggtgactggcttcggcagggacactgtcctgatctggggtaaggcgttggtcggcggcaatatcagtgtcagtggcggtgacgatcagataatcatctccggtggtaccgtcaacgggcagttgttactcagctttggcaatgatgacttggtctggtccggcggcaacctgcattcctcagtgctgatgggggaaggcgacgataccgcattgcttcaggggctggtggctgcgcaggtggcggcggcgcaattattggatgggggcctgggcaccgacaccctgaccctggacaacaccaaggtcggtgaccctgccctcttcacccagtgggaaagcatccgcctggacaacggctcgcaaatgaccctgggcggggcgttgaagctgggggacagcgaaaccggtaccggcaccttgtccatagatggcagcagtgcgctgctggtcggcacgggcagcgtcgacccgttcaccgctggccagcgggtcaatgtgatcaacagcggcaccctcgacatgaccaccggcagctccaccgccagcgacaccttgaccatcaacggcaattacaacggcaacggtgggcgtctggcgttgcaaaccgtgctgggggcagacaactcggccagcgacaaactggtggtcagcaacggcacgctgcaaggcaacacccaactgctggtcaccaaccttggcggcgctggcgccgcgacgttgcaggacggcatccaggtggtgcaagcgctcaatggcgcgagcgggacaggtacggcctttaccctgggcaatacggtcaccgccggggcgtttgactactacctgttcaaaggtggggtcaccaccggaaccgagcagaattactacctgcgctccacagttccggtcacgccgctgcccgaacccggggagccggtcacgcccttgccggaaccggtagttgaaaccccaccactgccatctaaccccaccgacaaggagatcccgatctaccgtcccgaagtgccgctgtacgctgcgctgtttcccgccgccgagcaaatcgtgcaaggcatgctcggtacttatcacgagcgcatgggcgatcagagccgccagcaacataccggtatcatgccggcgggttggggccgggtctacggcaacagcagccgccagagttacgccggtacggtcagcccgaccctggacggttcgctgacaggctttcaagtgggcaccgatgtgttcgccagccacctggacaacggcctgctgcagcgcctcgggttcttcgtcggtcatagccgcctcaagggcaatgtgaaaggcttcaacggcggctgggaggacaaggacgccggcaagaccacattgcgcggcgatagcctgggggcctactggacgctgatcggcgccaaccaggcttacctcgacctggtgctgatgggtactcgctttgatggcaacaccgagtcggaccgtggcgtgaagatgaaaacccgcgggcataacgtcaccgcctccgccgaagtcggctggccgctggcgctgagcgccgactgggtcgtggagccccaggcgcagttgatcgtcggcaaaaccaagctggatagccagaatgatggaatttcagacgtttcctatgacgccgataccaacgtcaccacgcgcctgggcgtgcgcctgcgcggcgattacaaggtcaatggcatgccgctgcagccctatgtgagggccaatgtctggcacgccagcgccggggacaatagcgtttttttcaaccatgagacccgtatcgacaccgagcagaaatccaccactgtggatgtcagccttggggctaccctggaagttgcacagggtgtgagcctgtatggtgaggtcggcaccgaaaagaatctggacagcaatatgctccgcggccgccaaggcacgttcggtctgagaatggcgttctgaggcgatctttgtaccgcagtgtgtacgagagccactgcggtacataaccctcacacaactatttttaccaagttggccccctgaacgcatgaaaactgcagaacggtgccccgtcggagaagtccggcgggcatcaaataatggctaaacgcctgcccgcaacctatggaaaatttcgttaactaattcttccccaaggctttttcctacggattcaatctgccacactgatgagaataattatcaacagatttattattcgccacggatggcctctggggagccctataacaatgtttgtgcaacaacgcggcggcaacgttttttcacccagcttgatggcaattgctatctgcctggcaacctcgcacgcggccctggccgccgatgccgaagcaccggccaccattgaactgggcgccaccgaggtctccggccaacagctgggccaaacgaccgagggcaccgtgtcgtataccaccggctccatgagcaccgcgaccaagctgcccctgacgatgcgtgaaaccccgcaggccgtgaccgtgatcacgcgccagcgcatggatgaccaggcgatgaccagcatcaacgatgtggtcaacgccacgcccgggttgttcctgaactactccaacggccctggccgccaagcctttaccgcccgcggtttcgacattgacaacctcatgtatgacggtatccccagtggttataacggcgcgtcggtaggcgcgcagccgaacctggcgatgttcgatcgcgtcgaggtagtgcgcggcgccaccgggctggtgaccggcgcgggcaacccttcggcggccatcaacctgatccgcaagcggccgttgtatgagcagaaactcaccctgaccggcgccgccggcagctgggacgactaccgcggcgagctggatgcctccagcccactcaacgacagtggtacctggcgcggccgggtcgtgacctcctaccgcgacgccaacagcttcatcgataacgccgagcaggatcacggcctgttctatgcggtgaccgaagccgacctgagcgaagacaccagcctgaccctcggtttctcgaaccagaaggacaagactaactacttctggggctcgtcgatgatcggccaggatggtcaccacctgaacctgtcgcgctcctacaacccgggcaccgactgggagaacaaagaccaggaaatcaacacggtattcgccgagctgcgccaacgcctggccaatgactggaacctgcaggtcaacgccaattattccgaacaggatgcattgttttccggctcttaccagtcgcgctggaccaacaacactctggcccgcacggtgtaccaggccacttatgatgaaaaccaggcgggtctcgacgcctttgccagcggcccgttccaggcattcgggcgcacccacgaactggtggtgggcgccagcaagcgcatctacgacatgaccacccgcaactacagcccgtacgacatgaactggccgctcaatgccggcaagccgaatttcgtccacaccaacaacgagcgcgacgtcaccacccaggatggtttctacctgaccacgcgcctgagcctggccgacccgctcaagctgatcctcggcgggcgcctggactggtacgactatgacaaccgcgatggcgacggcgattacaaggtcactcgcaacctcacccgctacgccggcctgatctacgagctggacgaccagcactcggtgtatgtcagctacagcgatatcttcacgccacagaaggaaaagaacaccagcgcgaccccgctcaagccgattgtcggcaagaactatgaagtgggtatcaagggcgaatacctgggtggtgcgctgaatgcgagcctggcggtattccgcgtcgaccaggaaaaccgcggcgtacagatcgtcgtgccggattgcccgcaggcgtcctgctaccaggcctcgggcgaaatccgcagccagggcatcgacttcgaactgcaaggcgccttgactgagaactggcaggtcggcggtggttatacctacgcgcgcacccacaccatcaaggacgacgccaacccgcagaaggtcaacaagcagttcgacaccgacaccccggagcatctgtttaagctgaccacccgctataacttccagggcccgctggaaaaacttcgcgtgggcggcaacatttcctggcagagccgcatgtacaacgacatcgcactggcagatggcagccaatatcggctcaagcaaggcggctatgccgtcaccgacctgatggccggctaccgggtcaaccagcacctggacctgcagctcaacgccaacaacatcttcgaccgcaagtactaccaggccattgccaactctgcgagctatggcggtgattcctatggcgctccgcgcaacatgatgttgaccgccaagtacagcttctaaagcgcccatgccgccacggctgcctgttcgggcagccgttctaaagtccgcaataggcctgccgataaagcgttggcaaccgcaaaaatcccgaacatctgcttcactccacagcggcaggccttcgtggcacgctgcgtgcttgctagacctcggcccaccctcatggagtaagagtgaatgcccgtccgcccccgttttattgagcactaccgcaaggccgaccgcatcatgctggcattgatctggctgatgtcgctattctccctgggcttggcgttctggcatgacacctggctacaggcgctgatcgtcggtggcggcaccggcgtggtgctgaccgcgctctaccgcgtcatcggcggcacccgtgtgatgcgctgtgcactgggcgccggcctgatggtgatggcggcgctgcacatcaaccaggcgcatggggtgatcgaagcccacttcggcatcttcgcattactggcggtgttgaccttctaccgtgactggctgccgatcctggtggcggcgctgaccatcgccgcgcatcatctggtgttccacgcgttgcagcatcagggttttccggtgtttgtgatggagcatcacggcggctggacgatgatcttcgttcacgcgttctacgtggtgatggaaaccgtcgccctgctctacctggcggtgcatagccaggctgaggcggtcgagagccaggaaatgctcgagaagatgctcgccgtcacctcgcagctcaccgtggaatcggccaaaggcgaaggcaagttgcgagtctccctggccacgcgtttcgaccacttcctgcaacagctcacccacctcatcgatggcgttgcccgcgattcccacggccttgggcaactcggccaggaactggccaccgccagcggcaccctggaaaaaggcgcgcaccatcaactggcgcagatcggcgagatgaccggttcgatgcagcgcctggaagccgccaccggtcacatcacggtgcaggtcgaacaagcggtggaacacgcaggccaggccagccagcaaattatccgcggccaggaaagcgtcggtcgcgcccagcatgaaatcagccaattggcgtcacgcatcaatgacactgaatccaccgtgcaatccctggccgtgcaggccgagcaaatcggctcggtgctggaagtgatcagcagcatcgccaaccagaccaacctgttggccctcaacgccgccatcgaagccgcccgcgccggcgagcagggccggggctttgccgtagtggccgatgaggtacgcagcctggcccagcgcactgccctgtccacccaggaaatcaagaccatcatcgagggcctgcaacagggcagccgccaggccgtcgaagccatgcacgccagccgcgaaggcgtggagcgttgtgtggaagacagccagttggcggtggacatgctccacgccgtgggccaggacattgcccacattgaccaactcaacggccatatcgtcaccaccacccgcgagcagacgtcggcgaacctggaaattgtcgagcgcttgcagtctgtgcaaaccatcgcccaaagcaccgctgacgacgtcgagaccctcgcccgcagcagcgaacgcctgccgccgattgcggtgcggctggatgcgctggggcgcaggtttcatccttaagtagagcaccagacacacgtgggtcaaaatgtgggagggggcttgcccccggtggccataggtatctacacaaggtcggctgtcaggccgccatcggaggcaagcctcctcccacagttggaccgcggctagagtgcccgccaccggtcgagctattaaagcaaccgacaacctcctacactgccgacattcatacttacctgcgcagcctcgcttttctgcccgcctcgcctcctatcaggactccagacatgcgcctgcccgacttcatccttgagcacctcgagccgatcctgcaggcctgggaagatttcgccagaaccatcaagacgccgggcggggacctcgatagcgtggcgctgcgcgatcatgccgagcagatgttgcgggcaatcgtgaccgacttgcgcaccacgcagaccaagcgagagcaaaccgccaaggcccaagggctgattccggccgatgaccaggaaaccgccgctgaaacccacgcaatgacgcgcctgatggccggtttcacgattgatcaaatggtctcggaataccgcgcactcagaaccagtgtggtgagccaatggatgagaaaagtcaacgagggcacgccgatcaatgtcgacgacatgacccggttccacgaggccatcgatcaggcgctcgccgagtccatcgccagctattcacgtgcggtcgaggcatcacgcaatgtgttcctgggcatactcggccacgacctgcgcacgccgttgggcgcgatcctgctgggagccgacgtgctcaggcgttcaaaggacatcggcccccgggacaacaaaattgccaaccagatgtacaccagcgtgcgccgagcgagccagattgtgggcgacctgcttgacctgacacgttgccagatgggtccgggcatcccggtaaaaaccgcggatatcgatctcgcaccgctgtgccagcgagtagtggaagaaatccaggcgtttcatccagaggccaatgtcgtgttcgaaatgaaggctgcggtttcaggaaaatttgacggcgccagaatggagcaagtcttctcgaacatcatcagcaacgcggtggagcatggggacaccaccttcccgatcaaggtcgagctaggcaccgtggaggcgtgcgcggtattcaccgtgcacaaccgcggcgaggcgatacccgaagacgtgctgcccttcatattcaaccccatgggccgtttctcccagcgctcgacaatcgatctaggctccgcagaaggattgggcctgggccttttcatcgcctcggaaatcgtcgcatcccatgccggatccatcgatgtcagctcggatgcagaacagggcacggtctttagcgtgagggttcccctcgacagtgcccccgacatcctcaacccaccttgataaccaccttcccaaacgcgcccctggccagatgctcgtaagcttcacgcgcctgtgcaaacggatagacccggtcgataacagggcggatatcgtgttggttgaggaactcattcatccggtcgaacgatgagcgtggcgctacggcaatgccacgcagtgtcgtctggcggaagatcagcggcatgaggtcaagcgctacagtctgcccggtcaagaaaccgatctgtgcaatgcgcccggatgccttggtggccgcgaccgactgattgatgccgttgccccccgcgacatcgagcagcagatcgacacccttgcctgcggtgagtttcagcacctcgtccgcccagtctggcgtcgtccggtaattgatcccggctactgcacccaggcgcttgacggcgtgcaggttgtcgtcgctgctagacgttgcgatcacctttgcgccaagcgccgtggcaatctgtaccgcgaagatggagaccccacccgtgccctggaccaacacggtttgccccggttggatctggccgaaatccaccaatgagtaccaggcggtgagcgcggcaataggcaacgtagcggcctcttcatcgctcatattggcgggtgcggctacggcgctgtcctggtgaatgatcatgtactcggccaggccgcccggcagcggcgaaccgaagcagtaatccggttcgtgggggcccggttcgccatccagccaacgcgaatacaggtgagagttaacgcggtcaccgaccttgaagcgcgtcacgctgtcccccactgctaccacggtgccagcagcgtcgcttaccgggatcaatggtttgggcaccttgtgcggctcatagatgccgtcgacgatggccttgtcgcgaaagttcagggataccgcgccgaccttgaccagcaactcgccagcttgcggatgtggggtgggcgcctcgtccagttgcaggttatcgaggccgaagtctttcagtaaccacgctttcatgatgaatctcccaatgcaggtaatgaccgcaaaccgcaatcgatctgccttgggtccatcattcgccattggccgcgcgcaataaatgcgcaaaaaaacacaggattgttctatcctgatataacaatcgccaccggaaatcgtcatggaattgctgcaatcaatgcgcctgttcgcccggctggcggagcttggcagtttcaccaaaaccgctgaatcgctggacattggccgcccgcaggtcacccggtatatccaggagctggaagcatcactaggtgtgcgcctgttccagcgcaccacccgcaaggtggcgctcaccgccgagggcgagcgcttctatgttcgggtgcaggaaatcctcgcggatatcaacgccgccaccagtatgttcgaccgcaccggggcaaccctgggtggccgtctgcgcatcgatatcccgagcgctttcgcacaactggaattcatcaacagcctcaagggcttcaccgacaatttccccggcatcaacctggtactgggggtgactgatcgaaccgttgatttgatcggtgagggcatcgactgtgcgttacgcatcggcgacttgcctgactcgagcctcattgcccgccctatcgcgcaagcaatcatggtgacctgcgcggccccagactatctgcacgcacaaggtcgccccgagtgcctggaagacctggccagacatcgaggggtcaactttctgtccggccaaaacaaccggaccttgccttggcatttcatggtcaagggccaggaccagaccttcgtcagccacgcgggcatcaccgtcaccgaatcgaatgcctatgtgcaatgtggcgtgtcaggcttcggcatcatccaggcgcccgggatcaccgtggccgaacacctgcacagtggcgcgctggtggagatcctgcacgcctatcgccctgccccgcgcccggtatcgctgttgtatccaagtcggacacacctggccccacaggtgcaggtgtttgttgaatggctacaggagcactttgtgcagttacatgcccagtggctggggcaatgtcgttgacatgacctctctgatcacttggcgaaaccagatggagcgaccatccatttgatccgtgcgccgatacagcatagagatcggttccagcggcagttccataggggcatcagtcacctcaaggccatacagtggcgcgatgctgttgtgcaggtggctacgaactcaagctggtcgggccaagctaaagatcagtggtcgcaggcggttattcacgccatgcgccaagtgcagtcatacgccaaagttaaacgcaattgagatccgcggccgcgagccttcaaagcgtcgtaccgagtgcatcagccaggaagggaacatgacaaaggtgccactggccgccgcgcaggtgctactgaacccggcagtcagggcgaactcagtggcaaacctcaccaacgtctcgcaggccgcgccgtcccactccgggaaatcatgggcggactgccaaccgccggtattgctgcgctgcgccccctgggtgtcggcggccaggcgctgggcaatcagcgctttgagctcgccgttgagccattgcgcgtccggcacctggatgccggccaacgggcttggaacagccggcggatggtgatgagctgcggatccaaccgctgatgacaacgctgcattgaggcactaccagattacgcaagtggctgaaaaacataccgaaggagcgcaggcagtggtgtaaacctttgctaataacttgagggttattgatcgccggagtgcctctgcgacgctttctgcaagcgctccagcacctcatcacacgctgctgcccacgcctgcggcgcacctttgtcgcgcagcacttcgagcccggcagccgtaaaggtgcccggtgtcgcgatggcattgcccaaggtgtccatgcgcgcctggggctgatgaccggcgctggccaggcagtcctgcatattgcccatcaccaattgccgggcatgctccgaactcagtcctttatcggtaaaccaccgttggagatcattgagaaagaaatagaaccaaccgttcatgcaggccgcgacggtggccagttcgaaggcgttttcctgatccagcacgatcaacgtcccaagggtgcccaacaacgcctcaaggggctgccccgctggcgtaaccaccacggtcgactggttgatctgcgcggcataggacagcatcgcccgcaccggctgcgcctttgggaagcaacgcgccaagtcatccagcttcatgccggcgaccagggaaaccaggggttgccccggcttgaggcgtacctcccgggaaagcgcctccaccacctcggggcgcacacccaggaacaacaaatccgcctgatcgaccacatcttggttgtcggccatgacctcgcaagcccaggccctgcccaactgctgtgcacgctcatggttgcgtggcgagagcagcacccgcccactgaacccgccgcgacgcaggccgatcaccactttttcagtcaattcgccgacgcccaggatgccgatgctcagcaaggtgtttcctccgtttcgaaagcccgtgatgggtgtcgcagcatcatagccagattacaaggcagcgggccaacgcaaggattgtccaaccgcgccacgtagccttatgctcatgcctctgccacctgtcacctggagccgccatggacctcgccaccctcgccctctttctccccgcctgcttcgccctgaacatggcgcccggccccaataacctgctgtcggtgagcaacgccactcgctacggctaccgcacctcctgcctggccggtctcggccgcttgctggccttcgccggcatgatcgccctcgccgctgcagggttggcggtggtgctgcagacgtcggaattgttgttctacgcaatcaagattctcggcgcggcgtatctgctttacctggcctatcagctatggcgtgcggacccacaggcacagacgcaaacggccaccagcaaagtcggcttattggccttggcgcgacaggagttcctggtggcggcgggcaaccccaaggctatcctgatcttcaccgccttcctcccccagttcgtggtgccaggccaacctatcaccacgcaattcgccctgctgggcgcgatgttcctggcgctggaatgggtcgccatcagcgcctacgcctatatgggcctgcatatgcgccgctggttcgccgagccacgtggcaagcgcctgttcaatcgttgctgcgcggggttgttgtcggcggcggcgacggtgttgttgactgcgcgcagggcttgagcgccagcatcaatccactgcaaacacaggcgtcggatagaaacacaatcgaattactccttcatcctgctgctacgccgcaatcaagcggctggctgaggtgcgcagcagcaaacgcgattagatcgaaacgcagcgcccaaccgccatcagccaggcccaggcaaggtcagtgcgggtctattccagcgccggtatgaagttgtagctcacgatatcgataccgcaactcgccaggtcgcgcacgcggcgatgtacccgtcacgccgggtcgcagccgcgtttgaacttcacttccgtggggcctgaatcaaagaatagaacatgcggatatggaaataagggccctacacatcgataatgccaattcgatatcaccttactaacccaacacgcgaagaccaaaatgacagctgctattgagaccgaccgctttaaagccaaaaccaaatcaaaaaaaacttacatcgtcattgaaaaaaccaaggaaactaaagagccaagaggccttggcgaacagacggttatcacctcgcaaaaaacatactttttagacacgggagaaaaggtcaacaaagttaatagcacagactttctgatcatcaaaaaagacctcttaatacgcaaggtagagccattcttcagcaagccatttatcgttgacattaaaactctttttgacggccttaaaaacctggcattatgtcttgctatgcttgtggcgcttccaataatgcaagcaatggcggcgttaacctatgatcacagattttttgttgtcgcttttacctgggccgctttagtggtgattatcgtgctcgctggatacaattttatatggctctataaaacaatggaggcaaaaccaaaatctaaagttttagataaagctgcttggtttgtgacctttttaattgtagcgtttattttcttttgtgcgatagctatcacgtacccgaaattggtactcgcaacgtcgggttcgagttccgtgatcgactccattaatgcaatacccaaccaagtttccacccctcttttgaataacctctgttctaaatcctgagacatcgccaaatgaccgcttttggccggttgctgcgctcagtgacttgcagcaatcggacaagagcagcccgctggccctgcaagagctgtattaccgccttctgcgaggcgtggcagtgaccgcgtcgccagttcgggtgtccaccacccaaagacaccagccgggctcgctgccctgcgtgaaaatccaaagagcggcccactatcgataagtatccacctcttgagccggataaaactcgcccttcttccccatcttttccagccgttgccgcgcgatcaactccacgctggccactgcggcctgatcgtcagggttaaccaactgcaagcacaggcgtcgcacattctgatcgtgggtaccctcgctgagcatttcgtgggtgaagacttgttcgccacgccataggcatagctgggtatgcgtgccgccgagccatatctcgttgatggatctaaggtcagtggtagccagttgatccacggtgattgtcttgtccattgccctgtaccttacccatgattagatacaggtagacttccaggcacagtcgctcgttcccagcgtgtgcggttcaactgcgtcaatgggcagtgacgtcgagggttcaagactcaggtgtccgtaagcagcatgatatgggtagcgtgggcatcatctgttcgcttgaaaccacagtgcgtataaaacgcgtttccttcaggcgtatcagtggaaagacgcacgatctgaaacctgacagcggcatgtgcaaccagcgcctttactagcgtctgacccacatgttgcccccttgacgaagctgcgacgtatacccgtcgcagtctagccgcattatttccagcatatggatcaactgacagacctccaatgcctatcagttgctggttcaaataagccgccatcaggcactcgccgggggcatcaaagcggtttgctccagagtgccactcggtaaccaggcgggtgaggaacctgaaaccttcaccaacggcctctttctccaacgccaggatctgtggtggaagctgcgcgatctgttgaatctcaaatcgtttcataacgcccctatcctggtatgagctcgttttaatgggcagggttccagctagactggtttacacctcactcacctggacaatcgtcttgccaaagttacgtcccttgagttggtcgatcaaagcttgcggtgcggtatgcaacccataggtaatctgttcgcgataactcaattttccatcggcgatccactggcccgcctcctcgagaaaatcagctagctgctcttgagcatattccgtctggatgaaaccacgcagggtgaggctcttgcccataatctgcgccatcgtattggagaggcgatcggtgttttcctgggcaccggacggtttctcgtattgagaaataaccccgcacacaggtacgcgagcgtaagtattcaagagcggcagcacggcatcccagatttttccgccgacactttcaaagtagacgtcaatcccgtccgggcaggctttggccagttgttccgcgaagtctggcgcgttgtaatcggccactgcatcgaaatgcagctcgtccttcacgtaagagagcttctgcgccccggtagtgatgcctaccgctcgtgcaccacgcagacgggcgatttgtccgaccatagagccgaccgcgccgctggcagccgcaaccactacggtttcgcccggcttgggcttgccaatgttacgcaagcccgcataggccgtgaaaccagtcattccaagcacgcccagtgcggtggaaggcggcgccaggtctggatcaagtcgacgcaggtcgctgccgtctgaaacagcaaagcgtttccatccggaaaaagccaatacccaagcaccgacttgccaatctgggtgatgggactctctcacacgggacaccgtagcaccgacgatgacctggtcgatctcgataggatcgttgtaggacttttcagccctcatccaccagcgcatataggggtcaatcgagaggtaaatggtttccagcagaacttcgcgctcgccaggtatcggtactgctacatcctcaagacgaaggtcggatggcttcaaatctccatctggacgcgccgccaatacaacctgctgattcgatagttttgtcatgacattctcgcgcttaggttgagcaaatgatgcggcaggcagctgctgtcgcactcgcatacaaaatgtatgcgattaatgtattaacatacgccctgcatgtcaatgcattcatgatctagtgaggagagcctgatggcgcgacaaaaacgtgcagatatgattgcgtcaacgcgcagcaaattgatcgcggcaggccgtaaagcttttgcagagaagggctacgccgaaactgccatggaggatctgaccgcggatgccgaactgacacgcggcgcgctctatcaccacttcggtggcaagaaaggcctgctggaagccgtgattgctcagatagacgaagaatcctcggcgcgcctacgtgcagtcgtggaaacagcagatacgccgtgggagggtttcgttgaggagtgcgtcgagtggatcaagctggcgcttgaaccggaaattcaacgtatcgtgctgctggatggccctgcggttcttggcgacccggcgcgggccgccagccaaagcgcgtgcctggccagcaccatgcacagcattcaggtgttgatcgatcagaacgtcatcaaacccgtggatgcacaggcgactgcctatctggtcaacggcgcagccttgaatgcgtctctgtggatcgcgagtgcggctgatccacacctggcatcgacgcaagcaatcgccagctttcgtattttgctatcggggctgctgcgataggggagtaagcttgctctccctggagcctgacagtcgaccgctatctaactgatgctctacgatccaaatgtggggcttgcccgcgaagacgtgagaccagcaaacattgatgttggctgacccacagctattgggagcaagccccctcccacatttggatcgcggcgcatttattggatactgacacctgttcgcctgcaaaaatgggccttgtgaaatggaagtcatctcatgttcgaacgcaacaaactggtgccggagttaatggtcaccaacctgcagggcagcttggctttttgggtttcttgcctggggttcaaagtagcttatcaacgcccggaagatgggtttgcataccttgatttgaatggcgctcaagtaatgcttgagcagattgatccgcacgcgggtcaatggctgacggcgccgttgaccaggccgtttggaagaggcatgaacctacagattgatgttgaagctgtcgcccccatcatccaaaaacttgatcaggctggtgtttcactctatcgagaatgcaaagacacctggtatcgggcagaaaatgtagaagtaggccagagagaattcatcgtccaggatgccgacggttatctcgtaaggttggtagagcggttgggcgagcgtccgctctcggtcgaaaatggtcgtcagtgagcggcagctatcggccaaaagcggacgaccaactcggttctggtttcgcccagcttgcctcctccgcaagtgcaagctggctcacttctctgcctcttggatgcgcctggtatgtcaagtcggctaaaggccacgcccccgatgcgcattgattcggctcacgtttaggtttgaactatccgcaatgtccggatagccacctattgctggaattctgaatacgctaagctaaaaggcatccaatgctctacacagccctgccttctcaacaggctcgttttcaggttttccagctgggtttaagcgctgcaacgcgaccaggcactggccaccgtccagcaggatcagttcgtaatcttgcccggccttgggggtgaagtgaaagctatgcctgcagctataggaattgccgccagaaacatagccctcactctggaagttcatggcaaaaggcttgttcgccggcaccttcagttcgctacgcgccgagccttgcgcctccacccggcggttgctctcgggcatgcccaggctgcggccattattctgagccgcaaagccggattcggacacggccatcaccccggcgccaggcacacgccagtcgatgcagtcacggcccggcacaccgcgcgccacgccattggtgatcacgcgcaagcgtgcggtatcccctgctgtgggttcaacatagggcgtgttgtaagcacggatattggaaatattgccgcagccactcacggccacggccaggccggctatcagaaacgctctcatggaagtccttttttgaggcttaacggcagtgataagggctttcgctgctcagttcctcgccggtccgggcatcgcgaatgatgaccgtcgcccccggcgcattgaggcagaacgcattgcgtatggggtaaatgttatggccctcggcggtgaacgtgccgagcttggttaacggggcgccggaggcgtcctgagccgtcacggtgtactcacccgacatggtcagacagccgctcagtaacagcagcaaggtggcgcagactgcatatttcacaggtgatgtccctatcgtgttgagtgacgaaccctcaaaaagagggcggtttttttgtggtttcattgcgccgactcacaggccttcaacggttcttgggtgcgcaacgcacagacgtcaaaaccatcacgccgggtgtagcccgagcgcttcatacacacaaagcgctgcgcccgctcctggaagctggcattgggatcgatgccggagccattcttctcaccgcaagccaacatggaggtcaagacatccttgctgctcgcgccgggtttctcccataagtccgcatcagccgccgggggctgaaagggctcgctgaaacaggcggtgacgagggtagcaagcagcagcgccaatgccataggtttaagccacatgatcaatctccttattttctcgggctgacaggcaccagcaccggcttgccttgcggccaatatcttgcgcaggcttgcgcaccactgccataacagctgtgcatggtcgtatcaccggtgaagacattgcccaactccttgagcaagctgctgccctcaggtattacgccgccagtacccgggttattgcccatgaagaaccacctgcccaccgggtcgttgttatgaacttcgtatttaagaaccatcttcgcctgttcgactgggtcggtgacggccgaacggttttgcaaaaaggccaactgttcatcggcggtgtaaacattgaacgctccaccgaagttatacaccgtagtcttgctgagtaacccggcagcatcaggcatgttgtaaatggattgtcgggagttaccaccggtcatagtgccgcgactgtgttcagtcaggtgcaagccagtggcgccatagtcgagctgcaactggcgcgaggccgcggtgtagttggtcaagccgaaaaagtcgttatccatcgccttctgatacccagcaatcaacagctccgacagggtattgtccgccttgggaaaccacatgaaatactgtggcccggtcgcgccagggtcgcgatgctgagccgcgtatttagccgcggctttgtcgtcgttgaaaatgccattgagggctacgttgactacgttgttttcatccgcctgcagatgttgcctttctgcatcacccactacacggaacaacggcttttggtccgcgccttccttcacattgccctgttcatccagctccagcgccaacatctgtggcggcgttttgaacatggtgcgatacgccttatcggtaaactgcaccccttggcgataggcctcattcttgatcgactgctccgcctcggcggtacgctgcagtttgtccaggtcctgacgctcggcgccaacatgggagtgggcggtgtcacggttaaggctggccacggtttgactggcatcacggccggtcaattgctgctggcgataggcatcggtaatgaggatattgccggcactcaccgcgctcagcgtgttgccctcggaagagtccgaagccttccctgcatccaggtagttgctgaacaaggccttgctggcgccgtacatgccctggccgacaaagtcgctgctgagggtgagcccactgctgtcggcgctggccttggcgctgttgtgcaggtcagcggtggtcaatgagccggtactcaagctgttcttgccatcggcaatcgccttgtcgttgctggcgatcacgccgcccaccaagtgggtgttgcccttgacccggatatcaaaaccaccgtccccggcccgaatgccgctctgctcagtgacactttcaaagttggatttctgaatgcctttgttctgactcaacgtgaagctcgatgagccgatgcagaatggcggcacgcaaatactcacgcccacgcccaggctagtctgtttggccttgtaggtactggtgtcctgcaggctttcgacactgaaatcaccgcccacatcggccgtgacttgcttgccactcaccactgcgcccttgagtcgggtatcgccaccggaatcgagcgagaccttattaccggcgtccacatgggtattgctccagaccacatcatcgccatcggccttgccgcggttttgggacgcccctgcgttaaaactgatgccagtggtttggccgccgatggcaatgccaatcccaaggctggcgttgctgcccttttcggtcgtgcgctgttgcaccgtgttttgcgcggccagcaaggcaatagcgccgtcggccttgaggttaacatcatggccggcggtgatctggctgccttgtaaggtcaggttactgttcttgccggcgccggccgcggtaatgttgacatcaccaccggccaacaccgacgagctggcggtcgaattggaggtctgctcggttttactttccttcttgctggtgccggccgaaatgctgatattaatgccgccggccatggaccggtccttgtcatactggatatagccgttgcccgcccccatcagggtgttgacaagcgccagtgttttgagccggccatcatcggtgcggtcggacgcggttttcatgcgctgggcggtctgcacggcttcgatcaccgggttggttacggtaatcgtgaggccgccttgcttgaacttggtctcctgggtgatgtgttgctggtcacgggcctcaaggatatcgaccaaccgcgcggcaatgttcacatcgcccttgggcgccgtcacttggctgccgacctggcggtaggcattgccggccaggatactcacgttgccatcggtggcgccgatggtgctggccgccgccgtttcactggcggtacggtttttgtcgctgcgctgctggctgccgatggtcaccgcgatggcgccaccgctgaacagcccgctttgcttgacctccttgaagtgctgttcgctgagctggtcggtggcggccaccacattcacatcgtgcccggctaccagggtggtgccactggtggagaccacgttactgccgcgcacattcaagtcattgtcggccttgacccacgcggtctcgccactgagggtggtggcctgggcgcgggtttcactcacggtgtcgcgggttgtagtggtcttgctggagaacaagctgttactgccggtgaccttatgggcctcgtcgacaaagttgtagctctggctggtgcttaaattgacgtcgcggcctgtcgaaacggtgaccccgccctgctcgctgacgaccttggcgcctcgggcattgaggtcattgtccgcgatcaggcgtacctcgccctcacccttgataacactgccgacatcggtgcggctcgcgtccttgcgccagttgctggcgttccattgcacgctttgttcacggctctgggtcaccgtgcccaggttgatatcgtggccagcaaccaccgtggtcttgccgtccttgccggaactgacgatccgcgccgcactcaggttgatatcgcgcgccgcgttcaccaccagttcacccttggcatcggagacaaacaacccggcaacccgcgaaatacccgtggcggtgccctgggcactttcggtgttgcgcgtggtggacaccatgttgatatcgcgaccggcaaccgtattcaagcgcgtggaggcatcgatcaacccgccgaggttgttcaagtcggtgcgggcttttacctccacctcgccaccggtcaggcgcccgcccaggttctgcaggttgtcggcggaaatcgccagcacgctgcgcccggcgatcgtgccgcggttaaccaggtcgccttgtagcttgaggtcgactacgttgcccgccattagtgcaccggagccatccaggtcgccgtcgcgcacccgcacatacacctgcggcaccaacgcctgcgtcacgctgccgtcggcaagggtcacgtccttcttcaccagccagacgatgtcgctggtcaactgggccatttgctcagggctgagcgccacacccggcaccagcttccacttgccggcgtaggtcagcgcactgtcgagcaacgcgcggtactgggtctcatcattggcgtagccgtcgaggaagcgtctgccggtgagttgggcaatctgttcgcggatcagtttttgctcatagaaaccatcgcccagccgcgtaagggtcaggcccggatccagttgcagccgatccagcatgtagttggaagacagccaggaacgataactggtgaaacgcgggtcgctctccaccagatagttcgggttggcctggggattgaggtggaacaggctgttgtccggcacctgcacattaagcccgccggtacggattgactcacctacgcctcccgccgccgtcgcttgcagcgccgccacttccagcaccgggccaggcgctcggccattgcccacattgaccttggccgcactggcaccgccggcagcctgatcgacgctactggtcaggcgagtgccgagttgcaggccactgccggtatgggcggtgttttgcaggtactgggttggccgcaggaaaatatccgtgacgctggcggccgggttgtaggcggctgtcgaacggccctgacggtcacggcccttgcgatggatgcgatacaaatggctgaacgtgccactgtccgtcaccgtctgctgcccggtgacttcggtattgttgagctgtccgatagtgcccaccaacgtgccgccggcgatgatccggctcttgtcgttcaacaccgaattggcggtcagcagcattgagccgccggaaaggatttcacccgggtccgaggtgaggatctgggtctgggtagtggtacgagtgtagtcgtagcggttgtagttatcggccacgccctcggagctgaccaagtggctgacttcgtcgttgtagagtgagatctgatccgggcgatagcgattggcagagccggtgtgctggaactcctggacgccttcgcggctgacctcaaccacttgggtgctgaagtgttcgttggtattgcgcaactcggcactgttaaggctcagcccgccgagtgcttcgatacttgcgctggcgttatgcaccagcccggcctggccggtggcctgcccctgggcatccagcgcgccgccgatcaacaagtcaccggcactgaaaagcatggcgtgctcacggttgaccagcgtcccgacgccaatgtccaggcgttcgcgcgcggcgatcacggccgctcgggcatcttccacatcattggtcagttgccccgccgcaatggatacgtgatcaccataaatacggccgctgccaaggttgttgagcacctgggtattgattcgggtgatctgggcatcgatcaagccacggttattcagggtatcccccacatcaaggttcaattgcgcggcactgatctcaccgttggcgcggttttcaaccccaccgctcaatacccgcaattgcttgccggcctgaaccccaccctggttgtcgagcgtgccttgcagggtcacctctagattaccgttggcttgcagtttgccggtattgaccaaccccgaagccaggttgaggctgatgtcgcccaggctaaacacgcggccatcgccactgaggctggcgctggtcaggccgagccgttctccggcgatcaatgtaccggcactgttaagcagcgcttggtctgcgttgatcgacacttgcttgctcgacgagatcaggcccgcactgttgtccaactgcccggtactgttgacgctcagcaactggtcggcacgaatggcacccgagcggttaagcaactgcgccaggttcagggctaacgactgcccctctacgccctggttgctcccctgggtctgctggttatccaactgtcctgcatcgaccgtcaaggtgcccccggcacgcagcaggccgccgacgttatcgaggtgaccgctgccgatgtccagccgcgcgttccccagactctgcagctggccgccgcgattgctcaggccgccagcggttagcagcaggctcttttcactgctgagtacaccggcgtcgaggttatcgacctgcgcggcatggatcgccacgtcgcctttactgccgataaagccggcgttgttgttcaggttgccggagcgcagcgtgataccggcctgcccgaggatgccattggcgctgcccgagtcagtattggtcaacgtttgcccatgggtgtcgagtgtgatcgcaccgctaccctggataagcccggcctggttcttgagctcaccactgcgcaggtccacggtgccgctgccgataatggcgccgcgctggtttgacaggccttgcccggcactgtcgagcaacaaggccgcgccactgatcaacccatcgtcgttattcaggcccaggctggtaattgtcacgccttgccgggcctgcaccacaccgccgatgttatcgaacgcgccctggctcaccgtcagcaccagcggcccgccgaccgaacccacggtgccctgccggttacgcaatgcgtcggcgctgacactgagtgcgccgatggccgccagcgtgccgtggtcattgttcacctgcccgccggacagcgtgaggctgtcgcccgcagtgatcttgccttgcgcgttgagcaactgcccggtactcaactgtgcgcccttggctgcggccagcgtgcctgcactgttgtccaacagcgtatgcgcggtgatcttgaggttgccggccaccgccgcctgaaccgcgccgccttgattgagcaagcgatcagccgtcaggctgatatcactgtcactggccactgtggcgcccgtgttgtccagcaggcccgtggtgttgatgcgcaacgtgcccgcgccggtctgcaggatgttcccctgccgattggacagttggttggcgtcgatttgaatctgccgggctacggtggtggcgccgtccagtaccgcgtcggcaacggtgacttgcagtagaccattgctctgcaggctgccttgggcacctgtcagcgcctggccctgaagggtcaggctgcccgtgccggcgtgctcgatcctgcccttggcattggacaggcgcgccgccgaaaggcgtacgtcggtcgcattgctcgcgatgcgtccttcggtgttatccaggctgtcggacacagcaatcaccgtggcgcccttgccgacctggacgatttcaccttggcggttggacaggctgccggcggccaattgcacaccttcggtgttgattttggcactgtcggtggtcagggtttgtcgcaccgctgtgctcaacgtccctgtcgcgtccaacgctgcaccgcttaagtcagcgccgcccgtgcgggcagtgagcatgacattgtgcgcagcgatcttactcgcattgaggtcaaggttctcggcgctcaactgcagatccccggcagcaatcgccgagccttggtgcttgagcgtctggctggcgctgacgcgtagtgcaccattgccactgaccgcgccgtcagctgccacacctgcgcccaatatcgacttgctggcgttgtcgatggtttgggcggtcagggtcaagtcctgctgcgcagccaccaccccttggttgttgatatcgccacgactggacagcgtcgcggcgcccttgctgtacagcgaaccgctgttatcgatgcccagctggctgtccacctgcaggttctgactgctgctgatttgcccgctgttgcccaggcgcccgtcggcgctgatgaccacatcgccggcactcgaacctatttgcccggcattgcgcacgcccaggccggcttcggtacccaccaacttgattttgccggcatacatgccacccagctgcgccacgtcaatggcgacctggggcttatcgccggaaccgttgatgaccgtcgcctgggtattgtcggcattgacctggttggcgccactggtcacccgcaggtccttggcccaaataccggtattgacctcgaccgagcgtgcgatgacatcggtaaagtcggtctgcgatgcgtccaggcccttgccggagataaccaccttgccgctttcaacgcggtagccttgcaattggccgtcctgcatctgcgcactgccgctggtcaaggtggcacggttagcgttgataaaaccacagccgtcacaggcgatgcccgacgggttggcgatcaccacctgggctcggtcaccggcgacttcgatgtaaccacgcaattggctggggttgctgctgttgacctcattaaggatcactcgcgccgtaccgccggccaaatgcgcattgccctcaatccagccacccagctgagtttgggtattggtgcgcgcattgttaaggatcgcgccttgggcattaacgtcgaactggctgtaggtgttacgtgacacccctgccgcactcggggcctgaatgttgacttggggcacaccgtttgcggcgttgataatcaccggttgctggccgggcgcagcgccacggtcagccacaatatcgccccaggccaacggcgaggccaatgtgatcaagcccaacgccgccatcaatgagaaccgcaggggacgcagtgtcagcacagtattcaagacgacaggggcgacaccgatcccggtgcctgaggcttttttgctgcccagcacgttttcggccactaccatcagcaggccacgggctttgttaaaaacgatcctgtagaggtgtttgttcatgacgatccctgtgtcttgaaagctctaaaatgccgcaagtactacgattggcgggcaacggccgcgatcggccacttcaagcgcgccagagcagcaccttgaaaccgcttgatccgtaacccgcgctcgttgccccggtgatacagagcgctgaaccggctgtcggcaaacaaatggcgctgcactaagcgtgcaaggcgggcgctgtgaccaaaaggcgccacccagtccaggaaccacagtcgctcgccgctgttccagtcgtgcgcaggcaggctgatggcaggattttgcacatagcgctgctcggcctcgacgctgaaccaacaccaggcggcgtaaaacaccgggcgccccgattcgtagccgatgatgaactggcggttggcaatagctggcaacagcagcgcgttcagggtgtgcagcggcacatcgcgatggctcgccgagtgcatccacagccatacggcggcacccagcgcctgggcctcgttccatggcttttcgctgaacgccggcgcgatcagctcaaggttatcgagttgcatggcaaaccctcacatcgaccacgtcaggctgaaacctgccgtggtactggcagtctcgaagcccttgggtttgctgatcggttgaccgacaaacacgtcgtaagacacttgccggtagccaccgcgcaatcccatcacgtacccagccagatgatcaccaatgaggtattggcttgaaggcccgcccaccttgccgtagtcaacacccaggtaggtttcctgcccggagtcgcccagcgccaggccgaggtcgttacgcaccagccaaccacggtcggccgacaaaatgttttcaccgtcaaacccgcgcacgctgtagcgcccgccgatcgagaaacgatcctgcggcaccaacgccgtgcggttccactgcgcacgccaggccgcggtgtaacgcaagcgctgcgtggcaaggccaaacggtacggaaaattgcgcgtcggcgttgatgatctgcgaacgcgaggtcccttcgtcaaacgcctcctcaggcgcagcgattgcgttgcgcgcacctgtgccccggcgatagctggtgcccagatcgagcgtggcggtaccgatgaactcccgatgactcagccccagcgcccagcctgccatgcgtcggcgctgaatttcgatctcggtatcgtcgatatagttttgcgaagtgcgcgtccagccactgagcttgagcgtggttttgcgcacggcatcgcgatacagcaagcgagacgcgctgatctcattgtttttgctttctccggtgtacttgtaagtctggttggccccagcgaccgtctggtgatagtcatactcgctggacgtgacgccaaacagccaataaccgtaggggacagagtagtgcaaggtatggcccttggaaccacgattacccgcgtcccccccgcccaagtcgtggttgaagctggcgtagaacaaatcgttcaggctcagcaggttgtccaacgacaccgaagccgaacccaggtatttacctgtggcgtcggttcccgaatcatctaccgacacgctcaaacgcacgggaagtgcctgtttccacgcgataaccaagtcactgtcgcccggctttgcgtccattccctgggccgcggcgatttggatatccgcctcagccgtgggcacgcgtttgaagttttccaacgcttgctcaagatcacgcaggttcagcaggtcacctgttttggcaggcaccgcgttccaggcattggctcgggtagaggtgccttcggcgaagcggatggaatgaatgcgccccggaatcagggtcagttgcagcacaccgctgtttaaatcctgaggcggtgcaagcacgcgtgtcgtgacaaacccgcgctcgatgattgcattctggattcgcttcatcgtcaggttgatgccttgggcacccagacattgaccggtggccgggtcatttttgggatcggcgctgcgcagtgcccattgaaaatcttcagccaactcgccgttcaagacgacctgacgaatcaggaaacagggggattcacgcttctcgagcaaaaccccggcggaggatgagggcggcgcctcaaggcgcacatccggcgacggctcaagttgctcgcgcaacgctcgctcgcggtcctgctgcaatagcaactgttgggcaggtgcgggagggtcagcggcctgcacgccgaaactgctgatcaaaccgaacaacaatacggccaccgaatgaagggacggtggcagttttctaacaggcaagtacaacgtaccgaaacgggccaggtactccttaggccggaaacctactttcatttcgcatccctgtgaaatcttcctgcgggtgcagcatgcaccagaacggcacgtgatctgcgagaattgcctctgacaggcaactcccctatgaacaactgttgctcattaaagttcaaggacgcgtgagaaatttcctacacttaatttccccccggcttcttagacccctctaagagagtactcttggccggtgagcgaccgtcgctctgattagccatccttgtctttccacacgtggaggacttgttatgaacatcatcgctacctgcggccgtcagccctggaacaaaggaaaactagtagggcagaaagccccactccgactgagagatatctgggccatccgagtaaggcttcaaattgcggaaagaacccgggatctggctctcttcgatctggccatcgacagtaagcttcgagcctgcgacttaaccaagctccgcgtgcgcgatgtcgcccatggcgaacacgtatcatcacgagccatggtgatgcagcagaaaacgcagcgaccagtgcagtttgagatcactgagcaaacacggtcagctctcgtggcatggatacatcaggcacaactacgcagcgaggactgcctttttcctagtcggctacatacctcagaccatctatccactcgtcaatacgctcgtattgtcaaaggctgggtgaaagccgtaggccttgatccagccatgtatggcactcacacaatgagacgtacgaaggcatcactaatctatcgcagaacgaagaacctacgggcggttcagttgctgctcggccatacgaagctggagagcactgttcgatatctggggattgaggtcgatggcgccctggagatggcggaacagactgaggtttgatcatgcatagcgacggtcggagtcagaccgtcgctaaccggccagaagcggacatcccagtccacataccgccagcgtcacacttcatgcattggagagtcaccactgactgggtgaaaccttctcccactgccaaaaagcacggcaataagagcttacgcttacttataaactcattgaggcttagtaatgtcgaccaacctacccgacttcaccacacgtttgctgatcgacgcaggaatcgcaaaagggatgcgaattctggacgttggctgcggctcgggggatgtttcatttctgttgtgtgatttggtagagaatgacgcagagatcatcggaatcgatcgtgacgccgcagccatcgccagtgcacgccagcgcaatgcatcacgaaaccacccttcgctgaaatttctgcagtgtgatgtttcagaactgcaggactctctcggcacttttgacgcaatcgttgggcggcgtgtcctgatgtatcagaaggatgcggtggcaacgattcgtgcgctgtcgaagtacttgcgccccactggcatcgtggtctttcaagagcacgatacgaccatggtacccacaagcctggatcccttccctttgcataaaagggcgcaatcctggatacaagaaatgattgctcgcgaaggcgccgatctacacatcggttttaatctgcacagcatttttacacaggcaggcttgactgttgaaagcgtgcgggctgaatgcctgatacaaacacctgatacaccctacagccttggcgccatcgttcgagcgtgcttaccgcgaatcactgcattaggagtggccagtgtagaagacgtcgatattgaaacgctgcaagagcgcttggaccaggagcgttcagcctcttcaggcatctacatcggcgatgtgatgttcgggagttgggcacgcaaagtttgacacccaatacattaccatcggctcgttactcggcagtcccacggccctaaatggtcaggcacccccgagcaacgacaccgatgatcgtcccggcatcaccccttggtcagatcaaccaacggcgcctgccgcacctcagtcttccgcccggcctgaatctcgctcacctgcttcaaggccttatctaccgccgccttatccgccaacaagctatagctgatgcggaactgcttgtgttccttcggcccaatagtcggtaccaggttcagtggacgctgataccggcggttataggaaaagctcgtgcccggttccagccctgtgacatagccctggccttgggtatccgtgtttttccacaaggaaaacaccggcagtgtctgtgtattgaagcccaccgaaacgcccaggctgccggccttgttatgcaacacggtcaacgtatcgcccttggcgtcggcatacggcaccacgttgtaaaccgtttcatcgtagtccttggtgggtgcgcggtacgtttgccagtcggccagttcgcccttggccttgtcgttgaacggcgacacctgtttcaccggcgcggcgaaacgagcgccctgctccaggaacggcgtgctgaagttactgtgatacagcgcctggtattccttcggatagtcgccgttgttggtcagggtgtcgttgagggcgaacaccacgctgccagcctcggtgaccagttcggtcgcgacggagaagtcgaccttcttgaacgcctgctctttcagctcgccacgcagggtgatggcgtacggtggtttttcatcgatgtgcagggtgactttgttcgccggaatgttggcggcccgaccgtgcagggtcagcagttcgccgttgtcgatgccggggtggccgacccattcgtatccgcagcgggtcaccaactcattgaaaccttccaaccagcccaggccaccacggccattgagttcgatgaaagacggattgaccacctccttgaccggcgaatcccaacccatgcgcacatcgccgaccgaagcctgcaagacgttcatcccgcgagtcggcaccaccgatagtttcatcgtgccgttatcgatatcgacgatgctgacgccctcctgccgaccgccgtgcaaggtgcgcagggtgacgctgaagggtttgtcggcttgtatgccgagctgctggctggtgacctgccagttctgggcggctttgtcggtgtcgagcaggacgtaatcccaggccatggcgtgggaggcggcggaaagtgtgctgagggcgatgaagagtttgattggggtcatggcggtagcctttcttggagttgtagtcgttttataaactcgatgaaacgtttcagcaagcttaaaaagctacacaatgcaggtaaccaccagcatagagcggggagagattgaagattgagtcggtgccatcgcgagtagattggaccgaaaaacgggttgagcggcatgggcttcaacatattcggccggagtggtttgaaccatttgctagctagaggtaatcgcaaatagttttttgcacaaataggcatcctcccttggaatgaaatcttcaggtttttcattgcaggaaaacgcttcgaaaaggtggttgataattttcttcgcctggtccgcagaaaggatacgtgtgtctatcaggtcaagaagagcctcggctatctcgtttaaactaatgcagtattcttcagcagcaatcctaagcactgctcgcacttccctatatttatcatctgaatttacgttgcttatcagaaagttaagtggctcttccagaatttcaaaaggataaatcttttgatacctgtcgcagtactctataagggcccgcttaactttcacgccatcaaattcttgagagccaacctctaacagagcattaatcttcgtattagatatccagtttttcatcgcggagtccatcttagttaacgcttattcacgggagtgcccgcccaccttgtggctgaaatccacccggtaaaatacccatcgtctaaaagatccacaatcacacctcatcaacccccatgccgctccaccaaaaaatccacaaacgccctcacccgcgccggcatcgcccctccccccacaaacaccgcatgaatcggctccacatcccccgggttaaactcctcaagcaataccaccaactccccccgcctcacctcctccaccacactaaacgccccaatccgcgcaatccccgcccccagctttgccaactgcgccaacgcctccccactattgccctcaatcgtccccgtcactttcaacgaaaactcccgcccctccacccgaaacggccaatccggcgccgcccggcggaagttgaagcgcaggcagttgtggttgagtaaatcctgcggcacaaccggggtgccgtggcgcgccaggtagtcaggtgaggcgacgataacctggccggtggagccgatgtggcgggcggtcagggggctgtcgacgagtgggccgaagcggatggcgacgtcggcctggccgccgaggatgtccacgacttcatcgccgagcatcaggtcgacgacgatggcggaatagcgggcgctgaacgcggcgatcaacggcacgatggtcatacggccatgggccagggcggcgctgactcgcaggcggccgcggggggcgccttggtcggtgatggcgtcttcgacttcggccatgtccgcaaggatgcgccgggcgccgcgcaggtaggcttcgccttcggcggtgaaggtgatggcgcgggtggtgcgcagcagcagtcgggtgccgatgcgccgttcggtgcgggtgatgatgcggctgatggacgatggcgtcagccccagggctcgcgccgcgccggacaggctgccgtgctcggcgaccatggcgaacacttccatctcacccgaacgtccaccaatgtccatttgtgcctcctgcgcaaagctgtagttccgaaccaagggctactgctgcaaaaggctggattgtagcatttgacacacagatgaggagtcaaccatgcgtatcaatccaccccttgtagccttgtccatcggtgcctttggcatcggggtcacggagtttgcacccatgggcatgttgcccggtattgccgccgatcttggcgtatccattcccgccgcggggctgttggtgagcgcctatgccatgggcgtgctgatcggcgcgccgatcatgaccctcgccacggccagggtgccacgccgttacctgttgatcgggctgatggcgattttcaccctgggtaatctgctctcggcgttggccaccaactaccagaccttgatgattgccaggctggtgacatcgctgaaccacggggcgttcttcggcattggttcgattgtggcggcgagtgtggtagcaccagagaaacgtgcgggagcggtcgcggcgatgttcctggggctgaccttggcgaccattggcggtgtgcccctggccacttggtttggcgagaactttggttggcgcacggcgttctggggcatcagtgggttaggcgcagtggtgatggcggcgctgtggtgggccttgcccgatgctcccgcgccgaaaggcggaagcctgatggcggaaattcgcgtactaggccgcgggccggtgctggctgcgttggcgctgaccgtggtgggttccagtgcaatgtttacggtgttcacctatatcgcaccgattctgcgtgacgtcacccacgcctcgaccaacttcgtcaccggcatgctcgtgctgttcggtgtcggcctgaccctgggcaacgtgtggggtggcaagtctgcggaccgttcggtggaccgtaccttgatcacctccctggtggtgttgatcgccgtgctgctagccttctcggtgctgatgcaatggccgctgcctgctgccgtgtcgatcctgctgtggggcgccgcgagttttgccttggtgccgccgttgcagatgcgtgtgatggaagccgccaaggatgcgcctaacctggcttccgcgatgaacatcggtgcgtttaatttcggtaatgcgattggcgcggcgttgggtggcgcggtgatcaacgccgggctgggctacccggccatttccctggcaggcgcgctgatggccggcctgggtttgctgatggtgctgggtttgagctggcgttcgcggcatacccggtcacgcacttgcggggacatctgcttgccggcgatagtggacgagcgcgcttaaaccaggagaacggcccatgacccgcgaccaactcgccagcttctaccaaggctatatcgattgtctgaaccgtcaggattggcagcacctgggcgattttgtccaccctgatgtgacctacaacgggagcccggttggcctggagggctaccgggcgatgctggagcgcgacttccgggaaatccccgacctggtgttccgcgttcagctgctggttgccgacccgccgacggtcgccagtcggctgaactttagggtcagtcccaggggcgagtttttcgggctgccgatcaacggcaggacggtcgtattcgacgagaacgttttttacgaatgcgtcgacggtaaattcgcccgcgtctggtcggtgatcgataaggcagcggtcgcccatcagctgaaagggaacgccggctgacagggcggcaccctcgtctagacttcatactcctattaacccgaggagtttgcgatgaacaacaaaaataccgtctgcctctggtacaacggcgacgctgtggaggctgccactttttacgccgaaaccttccccgacagcaaagtgaacgcggtgcactacgcccctggcgattacccctccggtaaacagggcgatgcattgacggtggaattcaccgtcatgggcatcccgtgcatcggcctgaacggcggttcggcgttcaagcacagcgaggcgttttcctttcaggtgtccacggacgaccaggaggaaaccgaccggttgtggaatgccatcgttggcaatggcggaaaggaaagtgcctgcggctggtgcaaggacaaatggggtttgtcatggcagatctcgccacgggtgttggtcgatgcggtgaccagcaaggacaccgccgtcgccaagcgtgcgtttgaggcgatgatgaagatgaccaaaatcaacatagcgactatcgacgctgccattgccggtgactgatgtgggagcggcctcgctaaagctcgagcgctcctacatttgatctgcgtcggcacgccaatttgagtccccacgcgcatcgcccatgcgccaaaaaaagtcatgcatcggaccgccaggttgcgacctgggcgataccggcctatgttcgaagtcatgcattttgctgtccccctaccctacgcccatcccgtaaccaggtgacgacatgcccacaccttcacgccctgccgtacttgagctgatcggtaacacaccgctggtcaaggtcagccgcttcgacactggcccttgcacactgtttctcaagcttgaatcacaaaaccccggcggttccatcaaggaccgcatcggcctggcgatgatcgacgccgccgaacgtgacggccgcttgcgccctggtggcaccatcatcgaagccaccgccggcaacaccggcctgggcctggcgctggtgggccgggccaagggctaccgggtggtgctggtggtgcccgacaagatgtccacggaaaaagtcctgcacctcaaggccatgggcgccgaggtgcacatcacccgttccgatgtgggcaagggccaccccgagtattaccaggatgtggctgcacgcctggccaaggatattcccgactcgttctttgccgaccagttcaacaacccggccaacccgttggctcacgagaccagcaccgcgccggagatctgggcgcagacccagcatgatgtggatgcgattgtggtgggcgtcggctcggccggcaccctcaccgggctgacccgtttcttcaagcgcgtacagccagacctggccatggtactggccgacccggtgggttcggtaatggccgaatacagccgcagcggccagctggaaacgcccggctcctgggccgtggaaggcatcggcgaggatttcatcccctcgattgccgacctctccagcgtgcgccacgcctactccatcagcgatgaagaaagcttcgaccacgcccgccagttgctccaggccgaaggcattctcgggggctcatccaccggcaccctgctagccgccgccctgcgttactgccgtgagcaaaccacgcccaagcgtgtggtgaccttcgtctgcgacaccggcacgcggtacttgtcgaaggtctacaacgatcaatggatgaacgacgccggcctgttgcagtacaagcattacggcgacctgcgcgacctgatcgcccgccgcttcgaagacggccgcgtgatcagcgtcagccccgacgacaccctgctcaccgccttccagcgcatgcgcctggcggatgtgtcgcaactgccggtgctggtagacggccaacagctggtgggcgtcatcgatgagtccgatatcctgctgggcttgcaccacgacgccgcggatttttccatgaccgtcgccagcgccatgaccgacaccttgcacaccctggcccccagcgccagcctggccgaactgcaggcagaactggatcgcggcctggtcgccatcattgctgacgcctcaggcttccatggcctgattacccgcgtcgacctgcttaaccacctacggagatcccttgcatgagtcagcccgataaaagcgcgtttgccacccgtgtgatccatgccgggcagtcacccgacccgaccacgggcgcgctgatgccgccaatctacgccaactccacttacctgcaagacagccccggtgtgcacaagggcttcgactacgggcgctcccacaaccccacgcgttttgccctggagcgctgcgtagccgaccttgaaggcggcagccaggcgtttgcatttgcctcggggctggcggcgatttccacggtgctggagctgctggatgccggcgcacatattgtctcgggcaatgacttgtatggcggcacgttccggctgttcgacaaggtacgccagcgcagtgccgggcaccgtttcagctatgtcgacctgagcgacttgtcggcctttgaagcgtcgttgcaggacgacacgcgcatggtctgggtcgagaccccgagcaatccgctgctgagcctcaccgacctgcgcgccgtcgcacgtatctgccgtgcccgcgggattgtctgcgtggccgacaacaccttcgccagcccgtggatccagcggccgctggaactgggtttcgatattgtggtgcactccactaccaagtacctgaatgggcattcggatgtgatcggtggtatcgccgttgtgggcgacaaccctgagctggcagaacgcttgggctttctgcagaactcagtgggcgctattgccgggccgttcgacgcgtttctgaccttgcgcggggtaaagaccctggcgctgcgcatggagcgccattgcagcaatgccctggacctggccacctggctggaacaacagcctcaggtatcgcgtgttcactacccaggcttgaaatcccacccacagcacgagttggcaaaacagcagatgcgcgggtttggcgggatgatttcggtggatttgaacagcgacctggccggtgcaacgcgcttcctggaaaacgtcaagatcttcgccctggccgagagcctggggggcgtggaaagcctgatcgaacacccggcgatcatgacccatgcgagcatcccggcggcgacgcgggcgcagttggggattggcgatgggttggtgcggttgtcggtgggggttgaagatgtggaggatctgcgcaaggatctggcccaagccctggcgcacatctaacgccaaacatcgatcaaaatgtgggagggggcttgcccccgatggcggtgcatcagtcagcttatttgcaactgacccaccgctatcgggagcaagccccctcccacattgaatgcgcaatcagctcgagattatgttagtgcgggttgagaatgtggaggacctgcgcgcgaattcagcccgagccctggcatacatctaacgccaaacatcgatcaaaatgtgggagggggcttgcccccgatagcggtgcatcagtcagcttatttgcaactgacccaccgctatcgggagcaagcccccacccacattgaatgcgcaatcagctcaagattatgttggcccgcgccgcatgcagcttcttgtagctgtcgatcaggcgcaaatgccgatccagcccttccagcttcatgctggtcggcgtcaacccatagaaccgcacgctgccgtccaccgagccgatcaccgcatccatgcgctcattgccaaacatgcgccggaagttggcttcgtagtcggccagctccaggtcgtcatccagttccatctccagtaccgcgttcatcgcctggtaaaacaggccacgctcggcggtgttgtcgttgtactgcaggaacatctccacgcattccttggcctcttcatactgcttcaaggccaggaagatcagcagtttcagctccagaatggtcagttggccccaggccgtgttgtcatcgaactcgatgccgatcagggtagtgatatcggtgtagtcgtccagctcgctttcgatcaggcgctcgaccagtgcctgcaactcgtcctcgtcgaggcggtgcaggttgaggatgtcttcgcggaaaaacagcgccttgttggtgttgtcccagatcaggtcgtccaccgggtagatttccgagtagtccggcaccaggatgcggcaggcggtggcacccaggtgctcgtacaccgccatgtacgactctttgcccatgccttcaaggatgccgaacagcgtcgcggcctcctgggcgttggagtcttcgccgtggccggagaagtcccactcgacgaattcataatcggactgggcactgaaaaagcgccacgacaccacgccgctggagtcgataaagtgctcgacgaagttgttcggctcggtgaccgcctggccttcgaaggtcggctgcggcaggtcgttcaagccttcgaagctgcggccctgcagcagctcggtgaggctgcgctccagcgccacttccaggcttgggtgcgcgccgaacgaggcgaacacgccaccggtgcgtgggttcatcaaggtcacgcacatcaccgggaactcaccgcccagggacgcatccttgaccagcaccgggaagccctgggcctccaggccctgaatgcccgccagaatgcccgggtacttggccaacacttcggccggtacgtccggcagcgcgaattcgccttcgatgatttcgcgcttcaccgcccgctcgaaaatctccgacaggcactgcacctgggcttcggccaaggtgttgccggcgctcatgccgttgctcaggtagaggttttcgatcaggttggaagggaaatacaccacttcaccgtcggactggcgcacaaacggcaacgagacaatgccgcgggcttcgttaccggaattggtgtcgaacaggtgcgagccgcgcagctcgccctcgcggttgtaaatcttcaggcagtaggcatcgaggatttcactcggcagctcatcgtccgggcccggctggaaccagcgctcatccgggtaatgcacgaacggcgcattggccagctcctcgccccagaactggtcgttgtagaagaagttgcagttgagccgttcgatgaactcacccagcgccgacgccagggcgccctccttcgttgcgcccttgccgttggtaaagcacatcggtgaatgggcatcgcggatatgcagtgaccagacgttgggcacgatattgcgccacgaagcgatctcgatcttcatgcccaggccggcgaggatcgcggacatgttggcgatggtctgctccagcggtaggtccttgccggcgatgtaggtgccggcctcggacgtcgagttgggcatcagcaacgcctgggcgtcggcgtcgagattctctacctcttcaatcacaaactccggcccggcctgcacgactttcttcacggtgcaacggtcgatggaacgcaggatgccctggcgatccttgtcggagatatccgtaggcagctcgacctggatcttgaagatctggttgtagcggttttccgggtcgacaatgttgttctgcgacaggcgaatattctccgtgggaatattgcgcgtctggcagtacaacttcacaaagtacgccgcacacaacgccgacgaagccaggaagtaatcgaatggccccggtgccgaaccatcgcccttgtagcggatgggctggtcggcaatgaccgtgaagtcatcgaacttggcttcaagccgaaggttgtcgagaaagttgaccttaatttccatgcgggcacaccagaataacgagctaaacaaattggccgccattatgaagattttcgccgggaagtctcagggttttgcgtgtgggctgccgatcggtgtcgctatgccagcagcctttaggcccctggcatagcattgcgccaggctaaggttggcttgagctcaggcgtcgcgccaggctcgtgcggttgatagtcagctcactgctgacgtccggcccgtgatagaccatggacgtttcgtggtgcacgtaatcgcccgaacgtgcggcgctcaaccaattgaacgagccgacgcagagtaactcctcatcggccatcaccagcttgctgtgcaccttgttgaccacgcgcacctgcacggcatgctgtttgagcgccgcaatcgcctccttgaattcagcgattttgcccgggttgccttcggaccggccggggttgatgtcggtattgaagcgcaagtcggtgtagaccgtcacctgcacgccccgctgcaccgtgccgaccattgcatccaaggcgccgctttcgcgcatgccgcgcaacttgacccagggcgtcacaatctgcacttgctggcgtgccgtttccagggtgcgtaacaggaaccggtcatgctcggcaaattcatgcaggtgactcaagccagtgcgcgcggtaagcaaatccacccgaggttggaagtcgaacgccagtgcgttctccgggctgtgcaacaggtactgggccaggcgcccacgaggcttactggcgggtatctggctgaacaggtccatgtcgccgaacaccaggaaactgtctttggcgcgagacacggccacgttcaacatgctgtcccgacggtcgatgaacgcgccgtcggcgtgcttggagtacaccgccgagaaaatcaccacgggccgctcggcgccctggaaagagtgcaccgtgccgacggtcatttcaccgtcaagtttgccagtgcgaatgcccaatgcgctgcaggcctcgatgatcgcccgggtctgggcgccgaagggggttatcaccccaagaatctcccagagctctttgtcgtagcgctcaacgagctgctgttcgttggccttgatccaggccgcaatggtctgtgcctcaagcaggttatgacggctgccaccctgtttctgctggcacatcccgtcgatgtgcaggtagcccagccccggcaagccaccttgcggcttggcgccccggcgcggttgcagcttgcccttgtagcagagggcgttgcagtaatcgatgatcgagtcatagcaacggcggtgttcgtagaggtaaaggccgcgcgcgaggtcagggtcgtagtgatagcggctggtcgactgcgcaatcgccatgacactgccattggcggcgctgcgcccgctgtcacagaacgcctcgtaatcgtcgtccacgctgctgcgtgacaacaggccggcgctgagcaaattgccgatatccactgctgccggtatcgaccagatgggttcgatctgctgagtgtcgccgatcaccagagcttgcctggccagggcgaaagacggcgccgccacctcaggaagcacttggcctgcttcgtcgacgatcagcaggtcgatgaagttcagcgcatagtctttgacataaccatcgccatcacgacggctgcacgacagctcgcccggtaatcggtgaaacgtcgcgaccacacaaggcgtgagtttcatccagcgccgccagtttttttccagggtcttgcggccattttttttacggcttttgaggatcagcggcaactcctcggcgacttccatcaaccaacgcccctcccaataatgggtggtcagcaggaaggtctcgaagcgcaacgaagtgtccgcccaggcatcacagtcctccagcgtcacctgtgcggcaggcttgccggtcgcgcggggtaatacgccaatcaccgcctgccagttcaacagctcgcgctgctcgccgcgcagcaactcgtccacccgctcccgctgagcttggagtgttctcaggctttgcgcggcgtggctcacggcggcggtcaggcggcgctccatgtcatgcacatcgacggcgctttgcagctcagtgtctgcctcatcgacgtgaagcttggccaggcgcaggcgcttggcggcaatcgggccgaaccagccaaacagcgtgtagatcaacgattcatgggccaggtagtgcttgaagtctttcaagcgtgcctgggtgctcgccagctgttcagtctgcagccgcagctgggtttcaaggcgactgatggccgcccgtgggtcatcgccgagcagatcctggatagctttgcgggcagccaccagccgtggccaagtttgctcgatcgcggcgagttgctgctggcgcaggcgaatttcggcctggagcttgtccacggtatttttcagcgtgggttgcgggtcgccagcaaaggccatcgccgcgcggcccaggtaagcctgctgggccctgtcgagataggcctgcgactcaagctcaaggaaaaagctcttggtctggtaagtgcgcgccatctccgcttcggccgaggccttgggaaagtaaacgccgaagctattgatgtcgggcaaccagcgcccggcgaagggcccggtgcccgcggcgaagtctttaccgaacgccttgatgatattggtgaccgcttgattgttcgtcgagctggcgacaatcaccggcggttcgccgccttctgcggcagccttggcccagagcgaggccaccacagagaggaccaaggtggttttcccggtgcccgggggcccgttgaccgccaggatatccccggtattcccggccaacaggtgcgccaggctatcgcgctgggcaggcgccagcgcgtattcgtcaccggcatgcccgcgtcggctggcgaacaggctgttggccgcaaggcacggctcatcggcggtggggccacgctgtgcaaatcgctcgaacaatggcgcatcgggcttgctggcacgcaggtgatcgtagagcgcaacgatgttgatgctgaaaccgtcagccttctgctccttgaacaggtaacagtagttgaccgggtcaaagccgtcttccacaccgtcccaagcgttgcacaccgtgtggaacatgttcttgcagtagcgcaggtagctgatccacttttcgcgatactgctccgggtccacgtcggtaccggagggcagcggttcgaaccggggcgcctcttgggcggccagaaaacggtccaggtcgtactgtgcaccgagggtgaaattgtcataatccaacggctcgaggatgtcacggggcaccaacgccggcccggtcgcgtagatgcgcccgtcgcgggtgaccgacacacggcaaagaatcggtgtgatgaacgccggcaacccattgcgcgccttgcggtgttccgggcgcgaggcatagacaaacggccgcaaggtcacgtcaacgtgaagcaactgcgcaggttcgccggcaaatagcagctccacctgctcagccggcaaacagcccgcggccaaggcggccatgggcaagaccgtataggttttgacatggctgttgaataaagcgccattgccgttttcggcatcggccagggagtttcgccagtagttcgcgagcttcagagagtaatcgttcatcgtcctgattcatgtagaccgtgactcactgtcacagccggtggttggggaattgagaacgagggtagcgtttcagcagccagaaggccaatccagagccgttcgctgattgcctggcgctcagcaagcgccgagggtcagggcgatcttctgtgggagggggcttgctcccgatagcggtcgatcagtgacaaataagctcactgacacaccgctatcgggagcaagccccctcccacatttagattgcgccaggccagttgaataacggtcaagcgtcaaactgccattggcccatcatattttcgaacaggccactgtataagccccacatcggctgatatgtttcgcgcctcacccgcaaaaggacaggccatggaaccgttagcgacgaacgctgcactggtgatcgtcggggtcatcaccaacaactccgtggaggccactgtgcgctcaggcggcaacctggggtttgatgtgatcgtggcggcggatgcctgttttaccttcgatcaagccgacctgtcgggacgcctgtggccggctgaagatgtgcatgcgttgtcgctcagtaacctggcgatggactatgccagggtattccagaccagcgagatcctggcgagtcattaacaaggaagcggatatgcatcgaggcatgcgcattgtagtgattggcgccggtatcgtgggggcttcactggcctatcacctggccggcaagggcgcgaatgtgacggtggtcgaggccggcgaagtcgcgtccggggtcacggccacctcatttgcctggctcaacacgacccacgacgcacccgaccccattgccactttgcgcagtgcagcgattgacgcgtatcaccgcctggagcatgagctgcccgccgtgaagatacgctggacgggcgccctgtgttacggcgcagacattcagcctggggcggattcacggatcactcgccagcgtatccaggcacttgagccgcgtttgagaaacccgcctgagcaggcccaattcaaagccgaagaaggcgcactcgacgcggtacacaccacccatgccttaatggaaggtgcccaagcccacggtgccacgctgctgacccacacccaggtgttgggtttcaggatgcagggctcacaggtcaccggcgttgaaaccagcctgggcgtcatcgatgccgacgtggtggtgctcgcagccggcaccggaatccccgcgctgacgaagctgttgggtgtgcccctgccgattgaagcctcccccgcgatctttatccgctacaacgccccacccggcatcgtgcgcacgcttatttccaaccctgcaatggaggtgcgcgaaagtgctgaggggacctggctggcagccgaagactatctggacgacgccccggaaaaccaggcggccgccatcgcccggcgcaccgcccaggctattgcggatgaactcgaaggggtcacgttcatcgaaccacaattggcctgcgtcgggctgcggcccatcccggccgatggcattccgatcattggccaattgccaggcatcagcggtgtgtacgtctgcgcgatgcatcctggcgtgacgctggcagccatcgtggggagtcttgccagcgaagagatcatggaggatagggtctgccctgccctggcgccttgccggcccgagcggttcttccaacctgaaaacggttagaaggcgccgacgtcctcgagcatttccagcagcccctgcggccacaccgtgtccgtcgtagtgcgcagctcctctgccgaccaccaacgatgatccgccatcacctgggtctcctcagccgtccactcggccctggacagcgcctcgctgggcgcctgcaccacgaaatagcgctcgatcgccaacacggtttcgccgctgggcagcatcaatgggaaactgcgttctgccacggattcgccaacgctgctgacagtgatgccagtctcttcgcgcagttcacggattgcggcgctgtgataggtttccccggcttcaacaccaccgcccggcgtagcccagtaattcctgccagccaatgcgccgtctttatgcacgaagcggaacagcagcacctgctttgcagggcttatcaccattagtcgtgcggctttgcgttcacgcatttgattgattcctttccctgagcgccgaaaccatccaactcaaaaacgcccgtagccgcgtggaaaacacctcgcactcagcgctggggttacgcgcttcaaacaggaagtacgcgatttgcacgcgcatcgaggggtactgttgaacaaacagcgcgacgtactcttccagggtatgcggccacatgtgcgcatcgtctgcgcgcaaggtgtgagtggcccggatcaaggctcgcgatgcttcacgctgcaggcgatgacgtgcgtgttcagtaccggcctgttcgatacgcacgagatacgccgtgagcacttgctcgaagtcaccattgaccgccatggcgatggcgcgggacgggcgaaacgggtcgaagtgccgtgcaaggtcttcgccccatacacagcggcaatgatgcttgagccagaagccccaactgttgcggttttccggcgccaacacttgagcgtgatgaccgatatcgaagtcgatcttggtcacttgcggatgccgttgttccaaggcaattcgggtcgtttcaatttgctcgagcaccgcagcatccgggggatcgttgagtatcaacgagaggtcgagatcagcaaccccgacctcggcctggcctcgtgcgacgctgccatacagataaatcccatgcagcccgaacgccgcctgggacagggttgcgcagacatccgccagcacgggctggaactcgatttgtacgggaacatcggcgacggtgaggataaacccgtcggcatcgacgcccgtggtttgctggagggtcacgggtgatgcacctcaatcaccaggccttcctcttcactcggcacactaaagtggcgagtgatgaggtcgaattcagcgtcagttgcagcaaagtcatgctcgccctgggcgttgcgcgcatgcaggcgggcacggcaggtcgcatcgtccagttccagataatgcaggcggtggggcaccttggccgcctgggccaggccgagcaaccactcacggttggccagggtgttggccgggaaatccaggaccacattcacgccggattccaacagattgaccaccagcggcccgagtacaccgcgcacccgctgggcacagcgcaggtagtcggcgatggcctggatctcaccggggtaaagactggccagccagtggtcttcgctgagcacaatagctcggtgctcggcggccagggtcttggcgagcgtggacttgccggaggcgatcttgccgcacagcagatgcagggttggcataaggcgtttcctcttttcggcccggcaggatgaatcatgcagccgcggccgtaaacacatccagttgaatcctggtttgcaagcgaggtcacctataaagagacgacaacgcaacgggagacctttatgaaccttgcaatgacactcttcagcctgtttgccggttggatggcaattgtaatgtcgatgctgtggggcgtgctgcgggtactgcaccggcatcatgcttagcactccagacggccgttactttgtggtcaaggggcaactgtggcgctgtaccaatccggccttggatgaggcaacccggcaacattgggttaatgcactgatggatgcacgccgggcggtcaaggcggtcaaggcggccaagggcgccgctgacgcccaggcattgaaagccgcccggcagcaggtgcagcatgccaaggtcgcattgggcgagcgtgggccggcgtggtggcacgatggcgctccggattacaaccgctgcaaagtcagcaataccccctacgcggcatggttcgaaaaacatctcgacacgacctcccagtgaactttcttataaatgccatgctcctttcctatgcgaagtcagcgcgccctgagcccagggtgcagaacgataaggagccgccacccccatgaccaccctccccacttaccccgtcgtcagacctggcccattgcatgggaccttgctggcaggcaccgtgccgctgtttctcggggccctgctcagtgatatcgcctacggccagacctaccagatccaatgggccaacttcgcctcatggctgatcgccggggcgctggtgttctgcggttttgccctgctgtttgcgctggtcaacctggtgcgcgccgaacataagggcgggcgacctatggcttatttcctgctgttgctgggcacctgggtgcttgggttggtcaacgccttccagcatgccaaggacgcgtacgccatgatgcctacaggcttggtgctatcggcaattgtcaccgtgctggcgatcgtcgcgacctggatcggcctgaccaacctgcgctcaggagttgcccgatgaaaaccctcaacacattgaccctgctcagcgcagccctgctgctcactgcctgtggtggcgaaggcgacaagacccaggctcgcggccctgaccctaaactgcctgaacaacaaagcagcctgttgccgagcatgaagattgcgcagcccaccccgtggggcgagcaaaagcccaacgtgcccgaaggctacagcgtgaccgccatcgccaccgacctggcgatcccgcgccagaccctggtgctgcccaacggtgacatcctggtggccgaaggccgtggcggcagtgcggccaagctcaagcccaaggacgtgatcgccagcgtgatcaaggcccagggcaataccaaggtcaagggcggcaaccgcattaccctgctgcgtgacgccgacggtgacggcacctatgagctcaagacggtgttcgccgacaacctcaacgcgccctatggcctggcgttcgccgacggcaaactctatgtagccaaccaggacgcactggtgcgcttcgactacgccgacggccagaccaaggccagtgcgccgccggtcaaagtcaccgacctgccggcgcagatcaaccaccactggaccaagtcactggccgtgagtgacgacggacgtcagctgtatgtaggcatcggctccaacagcaacatcaccgaacgcggcatggaagtggagattgaccgcgccatggtctggcagatcgacgcgactaccggggctcacaggccctacgcaaccggcttgcgcaaccccacggcgctgaccattcaaccgggtaccgggcaactgtggacggtggtcaacgaacgcgatgaactcggccccgacctggtgccggactacctgacgtcggtgcgagaaggcgccttctacggctggccgtacagctattggggccagaacgtcgacccacgggcacaaccacagaacccggccaaggtggcggcggcgatcaagcccgattacagcctgggctcccacgtggctgcattgggcgtggatttttccattccggccatgggtgaaaaatttgccgatggcgtgtttgtcggcgaacacggcagctggaaccgcgacaatccggtgggctacaaggtgatcttcgtgccgttcagcaatggcaagcctgctggcgaacccatcgacttcgccaccggatttcgcggtgacgatggcaagacccgtgggcgcccggtgggcgtgacggtggaccccaaaggtgcgctgatcattgccgatgacctggccaatactgtttggcgagtcacccgtaaccgttaaccggatatgacaggggtggcgacgcccctgtcagccatcactgtgcaattgcgcttgcagccacgctagcagcgcttcgacctcgtcccgactgcccgccccttgctgcttgtagaccgaaattgcctcaggcagaaatacgctttcagcgcagggccggaccaatgccccactctcgatcagccggcttgcggtacgacgccagcccatggcgacaccgtgcccctccaccgcggcctgcaacatcagcgggtagctgtcgaaagtggcactgcgcgcatccctggccaacacccgaccgaacacctgcagccactcattccactccatcaagtgcggaggctcggagctgtggtgcaaaaatgtgcagggctgtaattcattcaggggtaacggctgctccgggcaaaggtaggccgggctgcacaccgggaacacctcgtcggaggcggtgaacatcagcctatgggcgccactggcgcgccgggtactttgcagggccacatcgaaatggctatcgaaatgggtgataggccgcgtgcagctcaccacctggatttcaatctgcgggtattgctggtggaacgtcgacaagcgcggcatcagccaatagaacgcctcgcacaactggcacagcaacaccacccggttgcgttgcggggaggcacgcaggttagccgcgccatcgctgatgctttgcaacgcaaggctgaccacccgccccaattcacgcccctcttgcgtgaggaacaccgcacggttgcgccggatgaacagcttcacccccaggttgtcttccagcccacgaatctgccggctgacagccgcctgtgtgatgtgcagctcatcggccgccctggagaaactctccaggcgcgcggccgcttcaaacggcaacaaactggcaaggggcggtagggttttgccgagtagattcataatttgaggttatgcattcaaggccgagaactcgtttgtagcacacccacgcggctgggcaccatggatgcattacttcatggatcaacctgatgagcacttcccccacctcagtttctatcggcgtgatattcgcggtggtcgccaccctcggctgggcgctgaattttattgcgccctacgtcaccggggcttacagcctctacgacctgatggccgtgcgcttcttgatagccggtgcgctcggtgtcgtctggatggtcctgtgccgggcgcaactgcctgtgctaagcccaggccagcggctgttcgcggcggtactgggcgcattggggtgcctgggctatggcgtctgtatcgccgccggcgtgatattcggcggcccggtattgacgccagcctgcgtcggcatggtcccggtgttactggccctggtaggcaacgccagccataagaccctgcgttggcgccagttggtgatgccgctgtcttgcctcacggtggggctgttgctggccaacatcagcagcctgcaccagccctcgctgggtgctggttcctggctggccggactgtgcttctcgttgggtgcggtggccctatggctggggttcagcgtgatcaaccaaaagcagctggcgcgcctgccggcctgcgcgaccggcctgtggaccgccctgatgctggtgggtgcaggcgtcgcggcgctgtgcctgctgccctggatatacgcgctaggcttattgcagttgccaacccttggcgctgcctggagccaggcatggccgctgtatgcctggagcctggtgatcgcggtgatgtccaccgtcgtcggcgcgtgggcctggaacgcagcgacgcggcgcctgcccatggtgctgagcggtcaattgattgcccttgaatccttgttcgccaccctgctcggcctttggtttcaccagcgctggccgacgcccctggaagtcgcgggcctggccgccgtgctgattggcgtggtgatggcggtgcgtatcatcctggcgcaggaaaaacctgcggcaacccacccaaccttgggggagctccaacatgactgactcaagtgacgccctggcactgcccgaagcctttgatttccgtggccaagccgtgcgctggggccaactcggcacacaggggccggccctggtgatggtgcacggcacaccattctctgcccacgtatggcgccgcatcgcgccattgttcgcccggcactgtcgagtcttctattacgacctgctgggctacggccagtcgcaaaaagcgccggggcaggacgtctccctcggcgtgcaaaacatcctgctcgccgcgctgctccaacactggcgactggagcagccccatgtactcgcccatgactttggcggtgccacggcactacgggcacatctgttggatggctgcgactacgccagcctgaccttgatcgatcccgtcgccattgcgccctggggttcgccgctggtgcagcatgtgcgcggccacgaacgggcattcagcgacgcgccggcttatatccatgaagcgattgtgcgtgcctatctccagggcgccgcattcaagccgctgcctgccgaggtgctgcaagcctatgtcacgccatggaccggcgagagtggccaggcagccttttatcgtcagattgcacaaatggatcagcgttataccgacgccattgaagtacaacttgccagcatccgctgcccggtgcagttgctctggggtgaggaggatcagtggatctcggtggcgcaaggcgatgcactggctggcagattggccggggcacgctacctgcgcgtcccccatgccgggcatctggtgcaagaagatgctccagagtccatagttgccgcgctgatggcgtttctacacttgcctgctgcgaccactagagatcagtgatttccttgtggcgcggcaccaatgccttcatcacgctccaggccaccagataggccagggcgcagatggcaaacatgatcatgtagccggtgtggatgtcgttgatcgacttgtagtagtcgaacacccagccgccgatcttggtcatgaccacgccgcccaggccaccggccatgccaccgatgccgaccaccgaggcaacggttttctgcgggaacatgtcggacacagtggtgaagatattgcatgaccacgcctggtgcgccgaggcgcccacgccgatgagcagcaccggcacccagaagctcaggtaacccaacggctgcgccagcaacaccaccagcgggaacagcgcaatcaccagcatggctttcatgcgcccgtcatagggtgcatcgccacgcgccatgaaatagctggggaaccagccgccaccgatgctgccgaccatggtcatgctgtacagcaccgccagcggcatgacgatatcggcgcctttcatgccgtactgtgccgacaggtaggtgggcagccagaacagaaagaaccaccacacgccatcggtcatgaacttgccaaaggcgaacgcccaggtctggcggtaagtcagcagcttgaaccaggagattttctttgcggtggtgcctgtaggcactggggtgaaaggttgtacggtctggtcgctgcggatataggccagttcttcggccgacaggcgtttttgctgttccggtttttcgtacaccgcagcccagaccgcgacccacaagaaccccagcatgccgatgaccatgaaggccgcttcccagccccacaggccggcaatcagtggcacgcagatcggcgccaggatcgcaccgacgttggcaccggagttgaaaatgccggtggccagtgagcgttctttcttggggaaatattcggcagtcgccttgatcgcaatagggaagttgcctgcttcgccaatcgccaatacagcgcgggacagcatgaaaccggcaatcgacactgggatcactgccaggccgattgccccgctgatcgcagcgatgccctcgcccatcggcaccgaaaacgcatgcatgatcgccccggtggaccagatcccaatcgccaccacgtaagcggccttggtgccgatcttgtcgacaaaccgcccggcaaacagcatggagatggcatagacaaactggaacaccgccgcgatgttggcgtaatcggtgttgctccagccaaattgtgtcgagagttgcggtgccaacaggctgagcacctggcggtcgaggtagttgaccgtggtggcgaaaaacagcatcgcgcagatcgtccagcgatagctgccgactgcctggccgacacgatgggcactgatgggctcgttcagattcatggcatcactttttatttttgttagatagaacatatgtaacgtcatatgtcgtcgtacaactgcgacttttatatcgggacgcccacgcagtgtcaatcggaaagagtgccgcttatcgaggagttagaccggtatgaaaaaggtcagctttgtgcagttgtaggatgacaaacccgcatcaccaagctaggtgcctggcctggcacgtcgtccaacaggccgacaggttgcatgccgatcttttccagcacacggatcgacgctacatggtcgggtcgtaccaggccgaagacttctggcagaccgagggtttcaaacgccagcaccaacgcatcacgccccacctcggtggcgtagccctgcccccaggcttcgacggcaaagcgatagccgaggttgacgcgtcgttgtgtcagatagttgagctgcgcaatgccgccaaacccgatgatatgtccgggcgcttctttgcgggcgatcgcccaccagccgtagccgtgactggcccattgttccatccaatgggccagcaagcgctgggccgccgcgagatccggcatgggcccggccgggttgaacaaattggtctgcgggtcgccgaagatcgcgagcaatcgctgaacatcagccggctgcggttggcggtagctgaggcgtgaatggcggtttggcatacaaatggcgttcctgtttgcggcataggcctgcgagccgagtttagccaatatcgccatcgtcgccgcagtcagttaagcgaacgaaatgctcaaaacagcgacgacccaatgtggaagggggcttgccctcgatagcggtgtgccagacgcctatttgttaactgacccaccgccatcgggggcaagccccctcccacatttaaatttggttaaggcgtggattcgcacgccggcgcgagggcactgataacgatattttcgcaaacgcgagaaaaagtacccgacggggtgaattatttcgtgtcctcttgtatctgaactgacagagtggtgccatcgtagcgatggcacctcccctgttcagctttaagagtggcccgcatgaaattacggaaaaaacgcgtcaaacccatcggattgaaagacatcaccattgtcgacgacagcaagatgcgcaaagcaatcactgctgccgcactgggcaatgccatggaatggttcgactttggtgtgtatggctttgtcgcctacgtgctgggcaaggtattcttccccgacgcgtctcccagcgtgcaaatgattgctgcactgggcaccttctccgtgcccttcctgattcgcccactgggtggcctgttctttggcgctctgggcgataagtatgggcggcaaaaagtcctcgccgccaccatcgtgatcatgtccctgagcaccttcgccattggcttgattcccggctatgcctccatcggcatctgggcgccgattttgctgctgttgtgcaaaatggcccaaggcttctcggtgggtggcgagtacacgggcgcatcgatcttcgtcgctgagtacgctccggaccgcaagcgcggcttcctcggcagttggctggacttcggttcgattgccggtttcgtgcttggcgcaggtgtggtggtattgatctccaccgtgctcggcgaagcggaattcgaatcctggggctggcgcctgccgttcttcctcgccctgcccctgggcatgatcggcctgtacctgcgccatgcgctggaagagaccccggcgttccagcaacacgtcgacaagctcgaacagggcgaccgcgaaggcctgacccacggccctcgagtgtctttcaaggaaatcgccaccaagcactggcgcagcctgttgacctgcatcggtatcgtcgcggccaccaacgtgacctactacatgctgctcacctacatgccgagctacctgtcccacaacctgcactacgccgaaaacagcggcgtgttgatcatcatcgcaatcatggtcggcatgttgttcgtgcagccgttcattggctttgtcagcgacaagatcggccgcaagccgttcatcatcgccggcagcattggcctgctgttcctgtcgatcccggcgttcatgctgatcaccagcggcaagaccgggctgattttcagcggcctgctgatcctggccattgtgctgaacttctttatcggcgtgatggcctccaccttaccggcaatgttccctactcacctgcgctacagcgccctggccagtgcattcaacgtctcggtgctgatcgccggcgtcacgccaaccgtcgtcgcctggctggtggaaagcaccaacgacctgtacatgcccgcctactacctgatggtgttcgccgtggtcggcctggtcactggcctgaccatgaaggaaaccgccaacaagcccctacgcggcgccgcacctgcggcttccgacatggcggaagccaaggagctgctgcaggagcatcacgacaatatcgagcagaaaatcgaagacatcgatgccgagattgccgcgctgcaagccaagcgtgaaaacctggtgcagcagcatccacggattaactaagacctgactgtgcatggccgctgcgagcggccatgccattggagtgttcagcatgattccaagcgtcaccgcacaatcgctactcagcgcagacgaacgcgctgctatcgcagaaatcgaagccacaacgaacattctcaagctggtcacgcgcttgaccggcatgagatttgccggcattgccaaatttaccgacctggaatgggtggtctgctcggcctacgaccctctgcaaatgggcatcaatgtcgacgatgtactcgacctggaaaccactctgtgcagtgagttctgcatcaacccccaggccatgttcatcccgcagatcagtcaaaacggccgttttgcgtcgcgcccggtggtcaagcaatacgccattgaaagctatgccggcgcgccgatctttctgcccgatgggcgcctgtttggagcgctgtgtgcgctggattcgcgggcaatgctgttcgacgaccccaacctgcccgagaccctgagcttgtttgcgcggcttatcggctgcattttctacgctaatctgagcccggcggatcactgacatccgacctgccccgtaacaaggcgatatcgcgcttgggcgccaagccaaacagccgactgtactcacggctgaactgtgacgggctctcatagcccactttgaacgcggcgctggacacgtcccggtgctcgttcaacatcaagcgtcgcgcctcgttcaaccgcagccatttctgatattgcaaaggactcattgcggtcaattgccggaaatgatgatgaaaggttgccgcgctcatctgcacgcgggctgccaattcttccacacgcagtgcagcggcaaaattcaacttcagccaatcaatggccttggcgatgcgatagccctgcccgtccaccgagcatatctggcgcaggcgagcggcctgatcgcttttcaataggcggtaatgaatctcgcgctggaccagcggcgcaagcaccgatatcgcttcgggctcgtccagcagcgccaccaaacgcgcgaagccagccagcatgccgccggtcaccgagccaataccaacgcccttcatcgttgcgcgttcacgggtcggcggcagatcaccctgggcaatcagctcggccagcatgcgcaggtccaatttgaacgtcaggcccaggcagggttgctcggggctggcaaccagcacttgtgaattggccggaatgtccagcgacgtcaccagaaagcgggaggcgtcgtaggggtagccctcaccgccgacccacaactgcttctcgccctgcaccaccagcacgatgcacggttcgaccatgcataccaccggcgcagcgggttgttcacgccgataaaaacccagcccggcaatcggcatggaatagtcgccgggcgccggggtgcgcgaatctatggactgaatcagcgcatccagcagcgattgagtgttggtcatgacaggcccttgcagttcttcatgcaactttacctgcgtacctccaaggcgtcgccgcaaatggctgaaactcagaggatcaggcaagtaatccgctgaaacgtactacagaagctttgcctgcctggggaaaatggaccgacacctcgccaaggaacattcctatgaaatacctgctgagccttttgcaatgatgtccaacgcctgggaaccgcaacgttggggcgcagtgctggcgatgtcgctcgccgcgttcgcactggtcgcctccgaattcatgcccgtcagtctgctgacgcccctggccgccgacctgcacatcagcgaaggccaggccggccagggcatttccgtatcgggtgtgtttgccctgctcaccagcctggtgatcgcctcgattgccgcacgggtggaccgcaaaagcctgttgatggcactgacgctgctaatgatcatctccggcacggtggtggcgtttgcgccgacctactgggtgttcatgctcggccgtgggttgatcggcgtggcgattggcggcttctggtcgctgtcggcagccacggccatgcgcctggtgtcgcaggcccacgtaccgcgagccttggccatcgtcaatggcggcaacgccctggcgacggtaattgcggcgccgctgggcagctttctcggcggcataatcggctggcgcggggcgtttttctgcgtggtgcctgtggccgtgattgcactggtgtggctgctggtcagcctgccagcgttgaagcccaccggcaaagcgaaaaccggcaacgcattgcgcctgatgaaaaactcgacggtagccctgggcatgctcgcggtcagcgtgttcttcatgggccagttcatgttgttcacctacctgcgcccgttcctggaaagtgtcacgcgggtcgaggtgtccacgttgtcgttgatactgctggtactcggcctggcaggtctggcaggcacgttcttgattgaccgtctcctgaagcacaacctttacccgacgctgattgccatcccactgatcatggcaggcatcgccctggcgctggtggcattcggcagttcaacgctgatgactacgctgctgctgggcagttggggtctggtagcaaccgccgcgcccgtaggctggtggacctggctggcaaaaaccttgcccgacgacgccgaggccggaggcggattgatggtcgccatcattcaattggcgattgcagccggcgccacggtcggtggcgtggcgttcgacctgagcggctaccaggctacctttgagctgagcgctggattgctgatagtcgccacgctgctggcctacctggcttcacgccacccagcgcgtatgcacgttatcaaaggcgctacctgaaaaactggctcggcgtgcgcccaaactgcttcttgaacatactggtaaacgcactcgggctttcataccccagttcaaacgccacatcgataatcttctcccccaccgcaatgcgctccagcgccagcagcagccgcgcctgctggcgccattggccgaaggtcatgccggtttccttgcggaacaggcgctggatggtggtttggtccagccccaggcgcgcactccagtgcgcgacggtggaggcatctcccggttcgttctgcaacgccaggcaaatctggctcaggcgcgggtcggcaggctgtggcagggacagtggcaaggctggaaggttggccagttcgtcgaggatcaggtgcatgatccgggcatcgcgtgagtcctcggcatagggcggtttcaggctgaccgaggccttgatcagctcgctcaacaatggggaaaccgtcaccgtcttcggctcggccggcaggttcgggaagctgtccgggcgcacgaacacactgcgcatcttcaacgtgcctacgcagcgcaatgagtgaacttgaccacagggcatccaaaagccacgattgggcggtaccgtccattgccgcagggccgaatacaccaccatgacgccgccgatggcgtacagcagttgatgcttgttgtggctgtgttcagggatcacccagttttccggataatcggtggccgagctgatgacagcccagtcgccctcgtcaatatcccgaagaaatttatccagtgatctgatcattttgccctttttgcgatggtttctgcccgaattgcgcgagacaggctttttcttcgaatttagcatagctttcgaaacaattagaaatggctgccagctaaagtactgtctgcccctgtttgctgccttgtatggaatgcctgcatgtcgagccttactgcgacacccgccgctgccacaaccacgccccagataagccccctggtgatgcgcgtcctcggcgcctgtgccctggcgcatatggtcaatgacctgatccaggccgtgctgccgtcggtctacccgatgctcaaggccaactacggcctgagcttcacccaggtcggcctgatcaccctgaccttccagttgaccgcctccttgctgcaaccctggatcggctatcacaccgaccgtcatcccaagccgtggctgctgccagcgggcatggtgtgcaccttggtcggtattttgatgctggcgtttgtcggcagcttcccggcgattctgctcgcggcggggttggtgggcgttggctcgtcgactttccacccagaaacctcccgcgtcgcccgcctggcctccggtggccgctatggcctggcgcaatcgaccttccaggtcggtggcaacaccggcagcgccttcggcccgttgctggcggcggccatcatcattccctacggccaaagccatatcgcctggttcggtctgttcgcagtgttcgcgatcctggtgctgtacggattgagccgctggtaccgccaccacctcaacctgttcaagctcaagcaaggcagccaggcgacccatggcctttccaagggccgcgtgacctttgccctggtggtcctggccgtgctggtgttctccaaatactggtacatgaccagcctgaccagctacttcaccttctacctgattgagaagttccagctgtcggttgccagctcgcagatgtacctgttcctgttcctcggcgcggtggcggtcggcaccttcgccggtggcccgatcggcgacaagatcggccgcaagaaagtcatctggttctcgatcctcggtgccgcgccgttcaccctcgccctgccctacgtcgacctgttctggaccgccgtgctcagcgtgatcatcggctttgtcatcgcctcggcgttctcggccatcgtggtatttgcccaggagctggtgccaggcaatgtgggcatgatcgccgggatattcttcggcctgatgttcggtttcagcgggatcggtgcggcgctgctcggcatgctcgccgaccatcatggcatcgagtacgtctacaagctgtgctctttcctgccgttggtgggcatcctgacgatattgctgccttcgaccaagggcgtgtgatttctgggtgcacccaaaagtagataaatgatacgccgcgatccaaatgtgggagggggcttgcccgcgaagacgtcagcccagcaaacattgatgttggctgaaccaccgctatcgggagcaagccccacattggatcgcgggcgcatcagtcggatcatcggcggctgtcaggccgctgcgggagcaagctcctcccacaccccatcgatcacaagtaagtcccgctacaggtcataacggaccgccacactgcgcccggagttcaccgactccagcgcacaatcagccagatgcagggcatacaacccatcacgcatgccagtaggcaactcacgcccctcactcagcgcctcgatgaactgcgccagctcattgcgataagcatccgcataacgttcaaggaaaaagtgctgcagcggctccagcgcttcggtgtgttcggcgctccagtgacgcagggtgctgggacgatggttatcggtaagcaatacaccactggcgccggagacttctacgcgctggtcgtagccatacacagcctggcgacagcagttgatatggcattgcttgcccgaggcggtgcgcagcaagaccatcacgctgtcgtagtcgccaatctgttccagcgtcggatctaccaggcggctggcgtaggcgctgacttgcaccggttcttcgccgagcaagtggcgggcggtgtcgaagtcgtgaatggtcatgtcgcgcaggatgccaccggaatgttccaggtaatcacgcggggccaggcccgggtcgcggctggtgatgatcacttggcgcacggcgccgatctggcccgcatccagggcctggcgcaggcgcagcatgtcggggtcgaagcgccggttgaagccgagcatcacccggccgccctggcgctccacggtgtgcgccgcgctgcgcgccttggcgatatccaggtcgatgggtttttcgcagagtaccgccttgccctgggccacggcggcgagcaacagctcgatgtgggtgtcggtgggggtgccgatcaccaccgcatcgatgtcctcgcggctcagtacggcggtgcagtcatacgccgcttcgcatcccagctgcgtactgagggcatcgacgccttctcgccaagggtcggccaccagcaccagcgtggcgttgggatgggcggcgacgttggcggcgtggatcttggcgatgcgcccggcacctagaacggcgatacgtagcatggtcgaactcctggatcgttattggatttgtagtttcagaacttcagtccggcaggttgaacggcgtgacgatctgcacctgtgagggcgcaatcggcccggccttccatagccggtggtattgcaggatgtgcaggaacacgtggcgggcatcgatctgcaggttgtgatcgatgatcgccgcgactttttcttccctcagcagttggcggttttcttcgtcgaggtcgtggccgataaagacttccaatgggcgacgctgtgcggcaaaggcatcgacgatcgcacggttgccgccgccgacgctgtaaaccgccttgagcccgggatgctggtgcaaggcttgggtcacccgctcaaaggtgcgctcgtatacgccatagccgccgctgatatccagcacccgcaagtgctcggcgcggccacgcagccaggcgcgaaagcccatctcgcgttcttcttcgccacggaatagttcactgccgatcaccaccgccacgtcctggggctggctgggcagccagcgcgacatcaggtaggcggcggtctggccggcagtgcgattgtccatgcccacatagccgatgcgttcgctttggggcaggtccgtcaccaaggtcaccaccggaatgccggcggcaatcagttgcttcaccgcctggttcaccgccggctcatcggcggccttgagcaccacgccctggctgcccgtgtcgaggcagcgcagcaattggtcgtacatggcctggggctcgatttcttcgaacaggtgaaagcgcggcgcaatgcgaaatggcgcgaggctggccaactgcgccacgattgccgcctgcaccgccgcgctgaaacgctggggcgtgtgcatgatgacgtccacatggaaggtgcgccccacggccaggccgtttttctcctgggactccaactcctccagtgcctgctcgatacgtcgccgggtttgcgcatgcacgctgccacgctggtgcaacacgcgatcgaccgtggccttactgacgccggcctgggtggcgagttgcttgatggaaaaatgctttgcgcgttcgagcatgggcttcgcctgaggtgtttttgaggtcttttttgggcgttactgaggttttgcaatgctagtctcagttttgtccggcgtcgagccgggccggcaaaacaacaaaactcccaggagagcccaatgccccacaccgaccttaagacctcgttcaacggtcagtactttgtcgttaccggcagcacccagggtctcggtgcgaccgtagcccataccctggctcgccgtggcgcagccgggctgatcatttgcgggcgccgccgtgccgagggcgaagagcaggtacgccagctggcacggctggattgccaggctttttttgtcgaggccgacctggaaaaggtcgaggactgccgcacgatcatcgaggctgcgcgcagccatttcggcaccttgcacggcttggtgaactgcgccggcatgtctgaccgcggcaccatcctcgacacctcgccggaactgttcgagcgtttgtttgcggtgaatgtgcgcgcgccgtttttcctgatgcaggaagcactcaagctgatgatcagcaatggcgtggaaggcgcggtggtgaatatccagagcgttaccgggcatggcggccaatcgttcttgagtgcctacgccgcgtccaagggcgcactggcgatcctgaccaagaacgtcgccttcagtgcattgcgcaaccgcatccgtgtgaatggcttgaatatcggctggatggacacgccccacgaggaccagatacagcgtcagtaccacggcgcccaggacggctggctggcagaggccgaacgcgcccaaccgtttggacgcctgctcaagcccgaagaagtggcgcgcagcgtggcgtttctgttgtccgctgagtcgggaatgatgagcggcgcggtgatcgacctggagcaaggggtggttggctgcaccgacagcagcacgccgcaaccccaccaggccctgagcctccccggaggtgtgtgatgcctgccttcgtaaccggcgacgccgtgcgcctggccgatttcagccggatctgcgcacagcgtaccaacaccagcgactacccgctgtgccttgaggtgcaaggcaacgtgccgatttatcaggcccacaccttgcgcaacagtgaccgcctggccgtcatgaacgaactgcatcacctgttccgtgacggtcccggcgtgatggtggtgcgccaagcctatgaagacttggaagtggtggaccgccacagccgggtgttcgaagcgatctttgcccatgaagccgcccatggcgtggccgccgatcactttgccaaggccggcagcaacggacgcatctggaatgtgctgcaaaaagctgccgtgcagtcacccgaatcctttgccgagtactacgccaaccccctgctggggttgattgccgaggcctggttgggcccgggcttccaggtcacggcacaggtcaatgtggtgcgccccggtggccaggcacagcagccgcaccgcgactatcacctgggcttccagaccaatgaagtagtcgagcgttttccgctgccgctgcatgtgttgtcgcagtatttgacgctccagggtgccatcgcccattcggatatgccgctggaaaccggcccgacccagctgttgccgttttcccaacagtacgccttgggttatctggcctggcgtcgctcggactttatcgactactttcagcaacacgcagtgcaattgccgctgaacaagggcgacttgctgttcttcaacccggcgctgttccatgccgccggcaccaaccgcaccactgaccgccagcgcatggccaacctgctgcaaatctcatcggcgttcggcaagccgatggaagccgtcgaccgcgaccgcatgatgctggcggtctacccagtgctgctggccaatcccaacctggatgcccaagccgtgatcgcctgcaccgcagatggctactccttccccaccaacctcgacaccgacccaccgtcgcagggcctggctccgcaaaccgggcagcagctgatgctgcaagccctcaacgaacgctggccgtgctcggacttcgctgctgccttggcgcattggcgggccaagcgccaagcgtgaatctcgatgctttgacaacaacaaaaacaacggagcaaaccatgaaaaagcaactccttgcagcactgctgacctttgcgatcagcccctgggccctggctgatattcgtatcggcgtgagcatcgcccaggtggatgacgtgttcctcgcgcaaatgcgcgactacatggccacccacgccaaggaactgcccgacgtcaccctgcaatttgaagacgcccagggcgatgtggtgcgccagctcaaccaggtacaaaactttgccgcccagggcatggacgcgatcatcgtcaacgcggtggacaccgccgccactcagaaaatgacgctcaatgcccagcaggccaagatcccgctggtgtatgtcaaccgtcgcccggagttcaaggaggtgccggcaggcgtgggctatgtaggctcggacgagatcaaggcgggggaaatccagatgcgctacctggccgagaaaatgggcggcaagggcaacctggcgatcatgctcgggctgctgtccaacaatgccacccacaaccgcacgctgggggtcaagactgtgctcaaggactaccccgatatcaagattgtcgaggaacaaagtgccgaatggcagcgcagcaaggcgattgacctgatgaacaactggatcgtatccgggcgcaaaatcgatgccgtggcggcgaatgccgatgaaatggcgatcggcgcggccatggccatcagccaggcaggcatgcagccgggcaaggacatcctggtggccggcagcgacggcggcgcggctgggttggatgcggtgaaaaaaggccagttgctggtcaccgtgtaccaggacaacaagggccaggcggtgggctccatcgacctggcggtgaagatggtcaagaagcagccgtacacggcggaactgacgattccttatcagcaaatcaccaaggacaactaccaggcgttcctcaacccctgataggccgcgcaatatcggtggcgaggggcttgcgcccttgccacacgcttagttgagtgctcgacgggaaaacccattgaccacgatgtaaagcagcggccccaccgacacaaacaccgccgtcaacaaaaagtacggcaacaccgacgccagcgaccgccctcgcccacgcgcatcgcggtacatccacacacacgccagcaccgccatcaaatacaggtcgatcaccacctgcgccgtatcgggccgcgacatcagttcccgtccaaacgccaacagcgattgctcagccgtgagcatcgtccccaccgtgtagagggtaaatcccagcaaggcagccagggcgatatagggtctgtgcatggtctcttccttgaagtgcaatggtagtcatcgcgcccaccatagcgacaaagctctatcgctcgcaatcgcgctgacgtgttcatctggccgatcatgcacgccgcctacccagtgcatgccacgctggttttgtgaaatatctgtacgtagactgccgccatacccccacttgaaggcggcgaaaaaaacctgatgcaagttactgaagtctccattgcccaattgcgcgctgcgctggaagccggtcagaccacggcagttgaactggtccaggcctacctggcgcggatcgatgcctacgatggcccgcataccgccaccgcattgaatgccgtggtggtacgcaacctcgacgccctcaaggaagccgaagcctctgacgcgcgccgtgccaagggccagaccctggggccgctggatggcattccctacaccgccaaggacagctatctggtcaagggcctgactgctgcatccggcagcccggcgtttgccaagctggtcgcccagcgtgatgccttcaccatcgagcgcctgcgtgccggcggcgccatctgcctgggcaagaccaacatgccgccgatggccaatggcggcatgcagcgtggcgtgtatggccgcgccgaaagcccctacaacgccgactacctcaccgcgccgtttgcctctggctcctccaatggtgccggtaccgccactgccgccagctttgcagcgtttggcctggccgaggaaacctggtcgagcggtcgcggcccggcctccaataacggtctgtgtgcctacaccccttcccgtggcgtgatttcggtacgcggcaactggccgttgaccccgaccatggacgtcgtggtgccctatgcgcgcaccatggctgacctgctcgaagtgctcgatgtggtggtggccgaagaccccgacaagcgcggcgacctgtggcgcctgcagccctgggtgccgatccccagcgtcacgtcggtgcgcccggcttcgtacgccgccctggcggtaggcagcgcaagcctggccggcaaacgctttggcgtgccgcgcatgtacatcaatgccgaccctgaagccggcaccagcgaaaaacccggtatcggcgggccgaccgggcaaaagatccacacccgtgccacggtgatcgagttgtggcaagccgcgcgccaggccctggaagctgccggggccgaagtgatcgaggtggacttcccgctggtatccaactgcgaaggcgaccgtcccggcgcaccgacggtgttcacccgtggcctggtgtccaaggagtttctccacgatgagttgtgggagctgtccgcgtgggcgttcgacgacttcctgcgcgctaacggcgacccgagcctgaatcgcctggccgacgtggatgggccgaagatcttcccccacgaccctggcaccctgcccaaccgcgaagacgacctggccgccggcatggacgaatacgtgcgcatggcccaacgcggcatcactccatgggaccagatcagcaccctgcccgatggcctgcgtggccttgagcaaacccggcgtatcgacctggaagactggatggacaacctcggcctcgacgccgtgctgttcccgaccgtggccgatgtgggcccggcggatgccgatgtgaacgaagcgtctgccgacatcgcctggagcaacggcgtatgggtagccaacggcaacctcgcgattcgccacctgggcgtgcccaccgtcaccgtgccgatgggcgtgatggcggatatcggcatgccggtggggctgacgtttgccgggcgtgcctatgacgattcggcgctgctgcgctttgcctcggcgtttgaagccaccggcagtaaacggatgatcccgccgcgtacgccaccattggcggccagctaaacgcaattcaactgtgggagggggcttgctcccgatagcggtgtgtcagtaccagatgtgctgactgaactgccgatatcgggagcaagccccctcccacattttgagcgtattttcacatcaagcaccgtggctcaggagcgcggagcctcgcgacgccgccactcgtccaccacatcgcccatagtcttggggtcgccattgcgtatccacgccatgaatggacggttgaacttgaacctcggcccgcactgttcaagcatgaaacggcgaacgttctgagtgtttttgtagttgggagtcacgggtgtagcgcgggtgagagggccgctatgccagtcaaaatccattttgcaccttggcttatggagggggtgtttacccaccctaacctctaatcacttcacaccgctgcaaaattccactttctttccacgccgaaactattgcatggttgtacgacgacatacctcgtcgtatccaccccaacaaaaacaaggaaacacccatgcccaagctcaaagtgctgatcggttttctgtgcctgttctgcggctatgtcgccgccgcgcctgctaccgcagaaaaggacgtagcccaggcagtcgatcaattgacccaagccatgctgcacctggacctcaagcagcttcacgcattgacgtccgacaagctcacctacggccactccagcggcaaggtgcagaacaaggcgcaatttatcgccgacctggaaacacacaccagcgctttcaaaaccctggaaatgcagaaccagaccatcactctcaatggcgataccgccctggtgcgcaaccacttccatgccctggcggtgaacagcggtgtggacacgccaaccgatatcgacaacttccaggtctggcagaagcaaaatggcaaatggctgctgatcgggcgccaggcttacaagtactgagaacaggtcaccacgccaccaccttgcgcaccttcatcagggcttcacgcaactgcgccattgtcaccgaacccagggccaggcgcagtgcgtggggcacctgggccgagaccgcgaaaggctcggcggtggagacgcaaacaccgtcgcgctgcaaggtcatggcgacttgatcggcgcgcacatcctccgccagtggcaaccacaaaaaatacgatgacggatggctgatatacctcacccccgtcagcacctgcgccgccaacacctggcgggcctgggcatcctcgcgcttttgcgcttccagttgcgccaccgtaccgtcttcgagccaggccaccgcaatcgcactcatcacccccggtacgttccaggtggtggccatgatcgtacgttccaacgtgttcacccaagccgacggcgcagcgataaaacccacgcgcaaaccggtggcgacgctcttggacaacccgccgatatacaccgtgcgctccggggccagcgtcgccaacggcgcgggcgcatcgtcggcgagaaacgcgtaggcgccatcttcgatgatcatcaggttgtgctgccgtgcaatcgccaccaagcgctcgcgctgttccaggctcagcacccagcccagcgggttatgcagggtcggcatgctgtacaccgcacgtaccgggcgcctgcgacacaggttgtgcaggtggtccaggtccgggccgctggccgtgaccgggatggcgactatttccaggtgcagggtttcagccagcaccttgaagcccgagtaggtcagcgcatccaccgcgatcacatccccaggcttgagcaatgccatcagggtcaccgccagcccatgctgggcgccgctgacgaccagtacttgctcggcatccaccgtcagccctcggttcaacaagtgtcgcgctacagcggcgcgctcatgcacacgcccggcatggggctggtaacgcagcagcgcctccaggtcgccggacagcgccagttggcgcaacgccgtgcgcaacagttcggcctggcccggcaaggacgggtaattgaagttcagatccaacaggcccgccgccaccgtcatctgcccactgccctgccccggcggcaacgcaatctcgcgcacgaaggtgccgcgcccggtctcgccactgaccaggcccatggcttccaactcgctgtacacccggctggcagtcaccagcgccaagccatgctcggcggccaattgccgatgagtgggcaggcgcgtgccaggtggcatctgaccgctgcgaatggcctcggcgaaggtatcgaccagcgacttgtagcgggcacggggcataaagctgtatccatgacaattttttgattgccttaatcttcaaccctaggatagccgccacgcaatccccctttttcggacagccccttatggaacgtacctcccgcctcggcaccctggatagcagtacccagggctggatcaacggttttatcggcgtggtgattttcagcggctcgctgccggccacgcgcctggcggtgatggagttcgacccggtattcctcaccatgatccgcgcgaccctcgccgccttgctgggcataggcctgttgtggctgttcaaggagaaacgccctgcccgccagcaatgggcaccgctgatcatcgtcgccctcggcgtagtgatcggcttcccactgctgacggccctggccctgcaatacgtgacctcggcccactccatcgtcttcatcggcctgctgccactggccacggcggtgttcggcgtgctgcgtggcggtgagcggcccaggccggtgttctggttgttttcgatcctgggcagcctgttggtgatgggttatgccgtggcccaaggcttgagcgccgctcctgcgggagacttattgatgctgttggcagtgctggtatgcggcctgggttatgccgaaggcgccaaactgtcgcgcagcctcggcggctggcaggtgatctgctgggcgttggcggtgtcgttgccggtagtggcgccgctgagcctgctgctggcgccttcgtccttcaatggcatcagcctgccagcgtggctgagcctggggtacgtgtcgctgttcagcatgttgatcggctttgtgttctggtaccgcggcctggcccagggcggtattgctgcagtcggccagttgcagttgctgcaacctttcttcggcctggcgctggcggcgggcctgctgcacgaacaggtcagcctgggcatggtgctggtgacggtggcggtgatcggctgcgtggccggggcgaagaagtttgctcgctgacgcgcagcctgctaaacagaggcgtcgccccaagaacaacaaggactctacatgcacagcgcatctctgcaggacactaccgcgcctgaaggcatctgctatggctgcggtagcagcaacccccacggcctgcacatcaagagccgctgggccgacgatggcgtgcacgtcatcgccgagcatcagcccgaggctaaatacagcggctggccggacttggtctacggtggcctgatcgccatgctggtggactgccattccaactggaccgccatggcctaccactaccgtgccgagcaacgtgaacccggcagcctgccacgcattgactgcgtcaccggcaacctcggtatcaagttcatcaagcccacccccatgggtgtgcccctgaccctgcgtgcgcgggtcgaaggcgacgtcggacgcaaaagccgcgtggtctgcgaggtgtatgccggcgacgtactcaccgccatcggtgactcggtgttcgtgcgcgtcgacaccggccaactggccgcggccgcccatggtcgcgagccttgatcctggtctacagtgactgcaaccgctgaccgaggactgcacaatgacccgtctcaccgccaaggactttgcccccgaactgctggagctctacgacggctacgcccacggcaagctcaaccgccgcgaatttctcgaccgtgcggcgctgttcaccttcggcggcctcaccgcctcggcgctgctggcagccctgagccccaactacgccctggccgaacaagtgaaatttactgacccggacatcgtcgccgactacatcacctacccatcgcccaagggcaacggcacggtgcgcggctacctggtgcgcccggccaaggtcgccggcaagctgccggccgtggtggtggtgcatgaaaaccgtggcctgaacccctatgtcgaagacgttgcccggcgcttggccaaggccggctttatcgccctggccccggacggcctgacctcggtcggcggctaccccggcaacgacgaaaaaggcgtggcactgcaacagaccgtcgacccgaccaagctaatgaacgacttcttcgccgccatcgaatggctgatgcaccacgacagcagcaccggcaaggtcggcatcaccgggttctgctatggcggcggcgtgaccaatgcagcggctgtggcctacccggaactgggcgcggcggtgtcgttctacgggcgccaacccgatgccaaggatgtaccgcgcatcaaggcgccgatcatgctgcattacggtgagctggatacgcgaatcaatgagggctggccggcgtatgagcaggcattgaaagccgccggcaccacctatgaggcgtatatctacaagggcgccaaccacggctttcacaacgattcgacaccgcgctatgacgaagcagcagcgcacctcgcttgggagcgtaccctgggctggttccacaaatacctcgtctaacagaccctcccaggttaggcagcactcgtctgcaaccaacctttgaacgcgagcatcgccggtgtttcattgcgcgactgcaaacgggtcaaccaatagctgccagtcgtaattcctacctggaacggctggcggaacacatcgctctccaactgccgcgaaaacatcagcgccggcgccagcgccacgccgctgccttgcagggcggcttccatcatcgccagcgaggagtcgaacacgataccgcgcggcacccgcgtatcggtgggcaagccggcggcctggaaccacaggctccactcatcggcacggtaggagcgcagcaaggtgtgcttcaacacgtccgccgggctgtgcagttgctcggcaatctgcggtacgcacaacaccgtcaatggcgcctccagcaatgggcatgcatcggtgccgtgccaggcaccggcgccaaagcggatcgcgtagtcaaggccttcggcggccacatccacgcggttgttgtgggtggacaggcgcaggtcgataaacgggtagcgactgtggaaatccgccaggcgtggcaacagccagcccaccgcaaaggtgccgaccgcccccaccgtcagcacttcacggtaatgcccgccctcgaactggcccaacgtcagggcaatgcgatcaaaggcatcacgcagcacgggcagcagggtttcggcttcgctggtgagcatcaagccccgaggcaagcgcttgaacaacgtaacattgagttgggcttcgagacttttaacctgatggctgacggccgcctgggtcacgcacagctcaatggccgcacgggtaaagctcaaatggcgcgccgaggcttcgaaggcacgcagggcattgagcggcaagtgggaacgcagcaaggcttaccccaatttttctaatggctggtgcgagatatcatcgtttgcccgcgtcctgaaatccacctagatttgccacgcctgcgcaggttctgatcgtcatcactcttttacatggaagcgagtcaccatgaagcgtaacttacaaacactgctggtttccgcgttattactggggtctggcagttgcatggccgccgtcgatatacgccaggtcgtggacagcaacgtcaaagccttgatgcagcagcaagctatcccgggcttgtcggtggccatcgttaaccaaggcaaggtgcaatactttaactacggcgtagccgccaaggacacccaggcaccagtcaccgaagacaccctgttcgaaatcggctcggtgagtaaaaccttcacagccaccctcggcgggtatgcccaggccaccggcaagctcaagctgtcggacatggccagccaacacttgcccgccctggctggcagcgcgttcgatcacatcagcctgctgcaattggcgacctatacaccaggcggcctgcccctgcagttcccgaaaacagccgacagtgccaagaccatgctcggctacttccaacactggaagcccacttatgcgccgggcgaacaacgcctgtactccaaccccagcatcggcctgttcggctacctgacagcgcaaagcctgggccagccgttcaacgtcgccatggagaagaccctgctgcccaagctgggcctgaccaacacctatgtcagcgtgcgcagcgacaaagccggccaatatgcccaaggctatgacaagcagcaaaaccccgtacgcgtcagccccggcgccttgggcggcgaagcctacggcatcaagaccagcagccaggacctggcccgctacgttatcgccaacatgcacccgcaggccctggaacagccgctacaacaggccattgccgccactcacgccggctactacaccgtcaacggcatgacccagggcctgggttgggaacgctacccctaccccatcaccctgcaagcgttgatcgacggcaactccacgccgatggcgatggagccgcacaaggtcaactggctgagcccggcccaggcgcaaccggccaacgtgctgtacaacaagaccggctccactggtgggtttggtgcgtatgttgcgtatgtgccgagcaaggatgtgggcgtggtgatcctggcgaaccgcaactatccgaatgccgagcgggtgaaggtggcgcacgcgatcttgagtgcgctggataaataacaccgaacacaaaaaccctgtggtagggggcttgcccccgatggcggtggttcagttacagatgcattactgacactccctcatcgggagcaagccccctcccacatttttgactgcctttacattccgagccagtgcggcagtgcgagggaaatgaacggcaaataagtgaccatgatcaggaacaccaacagaatcagcaaccacggcatggccgcgcgaatggtctgccccagcgtcaacccggtcaccgccgaggtcacgaacaggttcaaccccacaggtggatgcaccaggccgatttccatattcaccaccatcacgatgcccaggtgaatcggatcaatgcccagcttcatcgcaatcgggaagaagatcggcgccaggatcagcacgatggccgacggctccatgaagctgccggcaatcagcagcaccacgttgaccatgatcaggaaaccaatcggcgtcagcccttcggagattacccacgccgtgatttcctgggggatctgctccgtggtcagcacatgggcaaacagcatggcgttggcgatgataaacatcagcatgatcgacagccgcccggattcgagcagaaccttggggcaatcgcgcagcttcatgtccttgtagatgaacagcgccacaaacgccgaatacacagccgccaccgccgctgcttcggtgggggtgaacatgccgctgtagatgccgccgaggatgatcaccaacagcaacaggccccagaacgcccggcgtgcgcaactcaaccactcgcgaaatgtcgcacgtggttgcgcgggtagcttcttgatacgcgcgacgatgtagatcgcgatcatcagcatcaggcccagcaacagtccggggatcaccccggccatgaacagcttgcccaccgaggtttcggtcgccgccgaatacaccaccatcacaatcgacggcggaatcaggatccccaaggtcccggcgttgcagatgatccccgcaccaaactccttcggataaccggaacgcaccatgcctgccacggcaatcgagcctaccgccgccaccgtggccggtgacgagccggacagcgccgcaaacaacatgcaggccagcactgccgcaatcgccaggccgccacggatgtggcccacacaggcattggcaaagtcgatcagccgctgggctacgccgccggtggtcatgaacgcgccggacagcaggaagaacggaatcgccaggaaggtgtaggcgtcggaggtttcaaacagcttgatcgccagggaactcaccgagtcctggctgaacatcagaatcgacaccgcaccggacagccccagggaaatcgcaatcggcacgcccaggaacatgaacacgaacaacagcaagaacagacagagcacggccatcagtgacgctcctcatggctgccggccaacttgctggcctcaccggcctcgtcggccagacccaacccgacctgtcggtgggtaaagatgcggtagaaaatttccaggtagcggatgaataccaaggcaaagccgatgggcacgatcaccacgatgtcgcccacatcgacgccgaactggtcgaggtcttcggcaccgatatgtgcggtcatcactgcactcacccacttgtagctggccaccatgaacaacccggcataggccaggcagcacaagcaagcgagcaggccgagcaggcgttgcaccgggcgcttggtcagcctgaccagcgcgtccacgccgaggtggccggcggtgcgtacaccgtaggaaatgccgaagaaaatcagccagccgaacatggccttggtcagcgccacgctccaagtcatgtcctgggcccaggtcatggtgccgtcgcccaggacgttgaagaaattgctgctccacgcccatttatccgccagggcgaagaacagggtgtagatgttgttgagcatgacgtagacgaatgtcaccagagtcatggcggcgagcaggaaggcaataaagccttcctccaagtgctcccagacgcgccttagcgtttgcatggcaaaacctcgcgaggcaaatgaaataccagggtggaacttgcccgaaatgtgggagggggcttgctcccgatagcagtgtgtcagcttgcagatctgtctctgatccaccgctatcgggagcaagccccctcccacattggatctcagtacaccctgggattattggttggaagcgtccgctgccttgatcaggtcagccccgatcgcgccttcgaacttctgccacaccgggcgcatggcttcgcgccaaagggtgcgttgctcaggcgtcagttcgatgatttcgctggtcttggcgtcgatgatcttctgcttggccgactggttcagcgcttcggcctgtttgttcacctcgacggtgacctcggccatgatctgctccagggtgctgcgggtatccggtggcaggccgttccaaaacttggcgttggtgatcaccatgtagtcgatcaagccatggttggattcggtgaagtacttctgcacctcgttgaccttctggctttcatagttcgaccaggtgttctcggtaccattcacggtgccggtctgcagcccttgatagacctcggcgaagctcatcttgcgcgggttggcacggatcgccttgaactgttcctcgagcacactggaggcttgcacgcggaacttcaggccacgggcgtccttgggttcatgcagggccttgttggcggagagctgcttgaggccgttgtgccaataggccaggccgaggatgttcttgtcctgcatcgaggtcagcagctgcttgccctcggcggcctggaaacggtcgacggcggccaggtcgttgaacaggaacggcaggtcgtagatctgcacttgcttggtgtactgctcgaacttggccagggacggcgccagcatctgcacatcgcccagcaacagcgcttccatttccttgccatcgccgaacagcgacgagttcgggtacacctcgaccttgaccttgccgggcaggcgttcttcggcgagtttcttgaacagcaacgcgccctggcccttgggggtgttttcggcgaccacgtgggcaaacttgatcacaatcgggtcggccgcctgggccaggcctgcggcaaacaaggtggcggcgcacagcagcgcccgagaaaacttgagcatgggaaatcaccttcttattgttgtgttgtcaggcaaggtgcctgatgtgacgcgtgttgagaatttcgaattctagatacctgcgttcggcctggccgaacaccaatctcaagaagaatggagaaccttgtgggaggggtttatccagttagagttgggcagccagcagtctttgtgcccgtaacagcaccggcgcatccaccatctgcccatcaatctgatacgcccctgccccatgggctccggcctccaccacgcgcttggcccatgccaggtcttcggcgctgggcgccagcgcctggtgaatcaccggaacctgcttgggatggatacacagcgccccggcaaagcccatttcataagcatgccggatcgagcagcgcaggccctcggggtcgtcgatgacggggtgtacgccgtccagcggtgcgaccagcccggcggcgcgcgaatgcacgatcagcgcgaggcgcgcctggtcgagcgcaaactcagcggcgcgggaatggctgctcaggttgaggtccagggccaggtccaagccaccgaacgacagccgctccaccagcggagcatgggcaatgtcggccaccgccaacaagccgcgagcgctttcgatgatcggccagatgggtttgccggtggccgctactacggcgacctgggctgcgctctcaaccttgggtagcagcacacccgcgacatttgcatgggccttgcagaacgccacatcctcaaaatgctcggcgtgctccggcgcattgatacgcacccacacctgggccccaggatgggcgtgcaagaactcccccaggttgtcccgggcctggcgcttgagcggttcttccactgcgtcttcaaaatccacgattaccgcgtcggcgccactggccagggctttggcaaaccgctccgggcggctgcccggcacaaataacgctgaacgtactaggggctttggcatcgctgaaattcctggttagataacgccgcgtgcacgcaggctgtcgatggtgtcggcgcaataacccagctggtcgaggataccctggctgtgttgtcccaaagccggcacgccatccatgcgcggggtaaacgcggcattgcgcgccggtggtaacagcgacggcaagggcccggccgggctatcgacttcgcgccagctgtcacgggccttgagttgcgggtggtcccacacgccttgcatatcgttgacccgagcgctggcgatctgcgcgtcctccaggcgctggatcaccgcctcggcgtccaactgggcaaagcttgcgacaatgatctggcgcaacgcgtcgcggttggccgaacgcttgaaattggcgctgaaacgttcgtccgtcgccagcgcgggggtgagcaataccttgtcgcagaacgccgcccactcacgctcgttctgcaacccgagcatcaccgtaccgccgtcaccggtgggaaacggcccatacgggtaaatcgtcgaatgcgccgcgccggcacgaggtggcggtggcgcgccgtcgaaggcgtagtacatcgggtagcccatccactccaccaggctttcgagcatgctcacgtcgatgcggctgcccttgccggtcttgccacgcagcagcagcgccgaaaggatgccgctgtaggcgtacatgccagcggagatatcggcgatggagcaaccggccttggccatttgctcgtcacccgggccaccagtcaccgagagaaagccgccttcactctggatcagcaggtcgtaggctttctttttctcgtagggcccgccttcgccgtagccggaaatatcacagacgatcagccgcgggaaacgctcatgcaacgcctcgaacgacaagcccatgcgcgccgccgcgccgggagccaggttctgcaccagcacatcggcatcggcgagcagcgcctcgagaatggcgcccgcctcgtactgcttgaggtccagggtcaggctctctttggaacggttggtccagacgaaatgcgacgccaggccgcgcacgcgttcgtcatagccccgggcaaagtcaccggcaccgggacgctcgaccttgatcacccgggcccccagatcggccagttggcgggtgcagaatggcgcggcaatcgcgtgctccaggctgacgacggtgatgccgtccagcggtcgttggttactcatgacaaatccctcaaagccaatgggccatggacgcggtttggcgcaggttccacacctgctcgatcaacccgctggcctgggtcgaggtgcgggcgttgctgaattgggtcaggcgctggaatttgtccgccagctccgagcgactcagggtgttgcccgggtcgcccttgggctcgtcgatggcgccgtgcagcgtgcggccgtcggtggtggtgacggtgacgcggcccagccagcgctgcgggtaggcagcatcgacctcggggtcgagagtcatgctgaccttgtcgcgaaaggccgcgacggcggggtcgttcaacgccagttcatggaactcaggcagcccagccttgccatgcacggcgatcaggccgagcacggtgcccatggagaatttggcctggtgcaccgtggtcggcaccgtcactcgaccgagcacatcgatggcgccttgatgcacgcgggtctgtacccgagcaatctgtgcggcgctcaagccctcgcgctgcatcaccgccagcagtgcatcggcggctggatgggtgtggcgacaggaagcgtggaatttgaacgaggtttccaccagcgcccaacggctgcctaggccggcggataatttgcctggttcggcatcagtggacatgcccgccgccagcccctggtcgccttccagaatattgcgtgcaccggtcaagccatcggcggtgagataggccgccagcaagccgtccgccgccgccttggccgtatgcagttgcttggagtcggcggcatcgcgcaagaactcccacagcccggccgcctgggtgccggcgctgccgagcaggttgatgaactgttcctggttgaaatcgagcaacttgcccaccgcgaccgccgccgccagggtgccgaccgtggccgtggtgtggaagatgcgatagtgggagcgacccatgaattcaccgatgcgaatcccagcctcataaccggccaccgaggccaacaacaactcgcggccagacttattgaggtcctgggcagcggccaaagcggcaggaaacaccaccgtggccgggtgcagcaccgagctgttgtgcaggtcatcctgctccaccagatgggatgaggccgcgttgaccagcgcggcaaaatacgcgctggtgccggtgccgttgacgatcacctgggccgggccgctgctcggccccatcttctgcgcataacgttcgaacagtggaatcggatgggcgccctggctggccagtgccgaagcgagccaatccagatacagctcttcgatgcgcaccagtaccggctcgggcacctgttgatacgtcagatcagcgaggaaacggcacagggcctgggtatcacgcatgctcaggccctcagaagctacgtggcagttcgagcaaatgctcggccacgtaggacaggatcaggttggtggagataggcgccacctggtacaggcgggtctcgcggaatttgcgctccacgtcgtattcgcaggcaaagccaaaaccgccgtgggtttgcagacaggcgttggccgcttcccaggacgccttggccgccaggtacttggccatgttggcgctggccccggcgtgcttgccgctgtcgtattcctcacaggcgcgccagcgcatcaggtcggccgcttcgatctcgatatgggcctctgcaatcgggaattgcacgccctggttctgcccgatgggccggccaaacaccacgcggtcgcgggcgtaggcgctggccttctcaataaaccagcgaccgtcaccgatgcattcggcggcgatcagggtgcgctcggcattcaggccatcgaggatgtacttgaagcccttgccctcctcgccaatcaggctgtcagcgggcaactcgaggttgtcgaagaacagctcgttggtctcgtggttgaccatattggcgatgggttgcacggtcagaccgttaccgatggcgtcgcgcaggtcaaccaggaagatcgacatgccttcggactttttcttcacctcggccaagggcgtggtgcgcgccagcaggatcatcaggtcggaatgctgcacccgcgagatccagactttctgaccgttgattacgtatttgtcgccacgcttgatcgcggtggtcttgatcctggtggtgtcggtgccggtggtgggctcggtgacgcccatcgattgcagacgcagctcaccgctggccagcttgggcaggtagaagcgtttctgcgcctcactgccgtgacgcaacagcgtgaacatgttgtacatctggccgtgcacggtgccagagttgccgccgcagcggttgacttcctcgaggatcaccgaggcttcggccagccccaggccggagccgccgtactcctcgggaatcatcgccgacagccaaccggcgtcggtcagcgccttgacgaaggcttcggggaagcccttttgttcatcgatgctgcgccaataggtggcatcgaactcggcgcacaaggcacgcacgccttcgcggatggcagtgagttcttcgttgtcattggggttcattaacggctctccgcctattgttcttggattattcgaaatacacctgggcggtctgcgccaggccttcggcattgccggcccagagttctgcgaccccggttgcggtgaggcgcccgcccacctcaaatggctgcggcgcaatcaacgggcgtatgccgcgatagctgaaacgacgcagcgtcgcgtccggatgcgcgcggcagaacgcccgcaggttcaaggtggcgatcagcgggccatgcaccaccaggccggcataaccttcggtaccggtgacataggggtagtcgtagtggatgcggtggccgttgaaggtcacggcgctgtagcggaacaacaaggtgggcgtcggctcgaccgtctccgtccattcgccctgggccagggcatcgccgctgccgggcttgggcggtgtcggttcgcggtaaacgatgtcctgttcctcgcggatcgccaggcggccgtcctgggagtagtcatggcgcacagtgacaaacagcaacgagccggtgcgcccggccttttcttcgacctgggtgatggtcgacatacgggtggccgcctcgccggcacgcagtgggtgcaggaattcgatacgcccaccggcccacatgcgattgcgattatcggccggcggcaggaagccgccgcgggcggggtgaccgtcgctacccaaggccgattccggcagcgcgtcctggaaaaagcaccattgccacagtggcgcaacggcttcgccctcggcgggcacagtttctccgaacgtagcggcgatacgcttgagcaggttatggctcaggtggtcgtgggcggtttcacttcggccgatccaatcagtggcactcatcgggtgcagatcctcaggcagtgggtgtctgctgccgatcatgcaagagcctggccgttctgagaatttgcatttcaataaaccagcgttcggttatgctgaacgccaacttacaaaaaaacgccgcatctccaatgtgggagggggcttgctcccgatggcggtgtatcagctagcacattgggtactgacccactgctatcgggagttttttatgcattttgatcttgccgacctgcgcctgtttatccatatcgccgagtcccccagcctgacccagggcgccaagcgagcgttcctctcgccggccgccgccagtgcgcggatcaaggccctggaaggccagctcgacacccgtctgttgtaccgcgacagccgtggggtagagatcaccccggcaggcgaacgcctgttgcatcacgcgcggttgatcatgcgccaggtggattacctgaaaagcgagttcacccaatacggcgtggattcggccgggcatatccgcatcttcgccaacaccacggcggtcaccgagttcttgccggaagtgctggcgggctttttgtcccagcggccgggggtgaccgttgacctgcaggagcgcctgtcccgggatatcgtgcgcggtgtgctcgatggcaccagtgacatgggtatcattgccggtcccgtagaggcatcggggttgcaagtgctgcatttcagcaccgatgagctggtgttgatggtgccggtcgggcatcccctggcagaccagccgtcggtcaccctggagcagaccctggcgtaccagcatatcggcctgcatgaaggcagcacgctgttgagctttttgcgcgaacacgtcgagcgcctgggcaagcagttgtcgctgcgcatccaagtctcgagtttcgaagcgatctgccggatggtcgaggccggggtgggcattggcatcattcccgagtccgctgccctgcgccacagccgcaccatgcagttggtgaccgtgaagctggatgagccctgggcgattcgcgagcgcagcatcctggtacgcgaattggaggcgctgccggggaccattcgcgcactgatcgctaccttgatgccggaaaacgcctaagcttgaacgtcaccttgccagaggagacgccccatgcaactcgaaggatcctgccattgtggcgctgtgacattcagcctgaccagcgcccatccctacccttaccagcgctgctactgctcgatctgccgcaagacccagggcggcggcggttatgcgatcaacctcggcggtgatgccaagagcttgaaggtacgcgggcgcaagcagatttccatctaccacgccaagctcaagcccgagggcgccagccgtgcccatgcgagcagcgccgagcggcatttctgctcccggtgcggcagcggcctgtggctgttcagcccgcagtggccggagctgatccacccgtttgcctcggccatcgacacgccgttgccggtgccgccggaacacacgcacctgatgctgggctccaaggcgccgtgggtggaggtcagtgtgcgcaagggtgacttgcggttcgatgaataccctgaggaatcgattgccgattggcatgagcgtttgggacttgtgggttaacagaggtttggaatgcgggaggggacttgccccctcccacagtgttgcgccgtacttaagtagtgtggagcagtagccgttaacagtctttgacagtttctcgacaaagcactcaaagattgttggcccccgcagccctagcattcgagcatccaaataccaatcgggtgctcttccatgtttcgcagattgcgcggtattccgctgttgggttgcctgctgggcagtatcggttgccactcgcagccgcctgccccgccgacgattcaaaaaggcgattacggcgcgatcatccgttacttgcaagcccgcattcccaaggacatggcgcgggaaaatgtagctggcttgtcgattgccctggtcaacggccaggagctgatctgggcccgtggctttggcttggccgataaggcccaaggggtgccggtcactgccaatacggcgtttcgtgccggcggcatctccaaactgatcaccgccaccgcggcgttgcaactggtagagcaacaacgcctggcactggatgcgccgatccagcaaaccctgcgcgaattctacgtacgctcacgctttcatagcgatcaaaccgacgctgatcgtgcgatcaccttgcggcgcttgctcagccatcaatccggtctacccagcgaacacctgcgcgaccttcgcagcacctacgccatggggcagatgccgatgcgcgtatcgggcgtgtggctgagcagcctgccaggttcccaggtggcttattccaacctcggttattcactggtgggcgccgccatcgaacgcagcagcggcaaaagtttcgaagcccaactgcaaagcagcctgctcaaacccttgcagatgaatcagtccagtttcctcggcaccggcgcgcaattgagctttcgcgccttgggctatgaggacggcagtgcgagcaccgacgcgcaggtgcgcgacctcgccgcgggcggcctgtgggccagccccaaggacctcagccactatgtgcagatgctgttcgccaaaggccgctacgaaggcaaccaggtgctggaaagcgcatcgattgacgcgatgttcacccagcaaaataccggcaacgccctggacttcgactgccagatgggcctgggctggttcctggcgccctgcggtgacgagccgattggtccgggcgtgcgtacctatcagcacagcggtggcggtgacgatttcgccgcgcaattgaccctgctgccggaccagcaactggccgtgatcatcatggccaacgacagcaatgccgaagagatggtggtgtcgctgtccaccgacagcctgcgcctgatgcttgaggcccagaccggaaaacccgtctgcgccgacgactgccatgcccccagccacggcctcaagctgcgtcatgtaccggcagccattgaccgcaggcgcctggccgggttctacgcgaccgcctggggcgtgttccgcatcaaggatgaccatgaacgcctggcgggtgaactggccggctatgacttcgagttattgcgcgatgaccaaggctggttgcgcgcgcagaaaaaggtcctcggtttctggctcaaggacctgggcgacctgggccgcatccagcttgatgtagtgaaagtacaaggccggcagatactcactgcacgcagtcacggccagcgcatcgccattggcgagcgcatcgaggcaccgcccttgcccacggcctgggccgacactatcggcacctaccaagtgcttaacacccatgaacccgacgcgccattgagcggcatcagcgtgcgcctggaagagggcttcctggtgattcgcggccaattgcatgacgagccgctgaccgactacatcctgctgcccgtggacaacgcccatgcggtgttggccggcagcggctacggcctgggagacaccgtcagccgccagatcaatggcctgagtgcctcgggctactccttcaaacgtacgcattcccccaacacccccctgaatttctaaccaggagcattccctgatgtacccaaagaacctgtgcctgtcattcacctccttgtgcctgctggccactgccggcacggccctggccgaagactggcaatacagcctcaaggccggcgtagccaatgcgccgcgctacagcggtagtgacgaacgcatgacagcccccgtgctgggcggcaaaatcatcagcccctggggcatcttcctcgacaccgacacggggctgggctggggctatgaaggcaatgccttgagcctcagcgcttacgtcggcgcaagcgattctcgtaaagataaaaaccaaagcatgcacgccggctccaaacgcctcaaaggcatgggcgagatcaaatcacgcccgcaactgggagtgagcgcggcctataacctcggtggcgtgatcatcggcgccagcctggaacacgcgctcaaggaagatgaccacaaagacaccggcaaggcctacacccacctggagctgagcctgggcaccaacctgtatgaaggccgcttcggttccgtcgatgccagcctcaatagccatttcggcgaccgcgactacctgcagacctggtacggcgtgaccaccggccaggccgcccgcagccgcttcaaggaatataaggccgcaggcggcaatatcagcaatggtatgaacctggtgtggagcttaccgatcaacgagcacactcagttctccaccttgctggatgtgcagtacctggcggataaagcgggcaagagcccgattgtagagcggcgcttgcagacgtcggtgatggggatggtggaatacaccttctgattcaagttggtaacccaatcaaattgtgggagggggcttgcatagtattcaaaaggtgttactcggcataagcccaggtcatccggaatgacgccccgccccactccgaatccagcacttgcacctgcccgccatgccattggctcacgcgcttgaccagtgccagccccaggccaaacccgccggtgcggcggtcgcggctggtgtcgaggcgcaggaagggttcgaagatcttggtgcggccttccagcggtacgcccgggccgtcgtcattgacccgcacttcgtaaccgctgccgaacttgaccagcgacacttccacacggcggtcggcataacgaatggcgttgcgcaacaggttgatcactgcgcgcgccataaagcgtggctcgatccggataaagtcgacctcacaggtgcgcagcgacaactgcaccccttccgcctcggcctccagggccacgctgccgatgacgctgtcgagccagctgtgggcctcgatattctcgcgggtcacctgggtggcgccacgctccaggctggcataggtcaacagctcggagaccatttcctccagctcgcccaggtcggaatacatatcgctgatcagctcacggctctggcgtgggtcgctttgctgcctgagttgatcgagctcgaacgacaagcgcgcaatgggtgtgcgcaattcatgggacacggcgttggtcagctcgcgctggttggcgatcaggctttcgatgcgctcggccatctggttgaagtgcccggccagttcgcgcacggtggaacgacgcggcagcaggatgcgcgaaccgagatcgttgtcgccaaagcgctgcgcggccaggcggatgtgctccaggtcgcgccagtgcggacgcacccagaaatacagaacgatggccaaactcacgccgaggaatccataggcccacaggtacagccatttgggctcttccggcagttggatctcgagcaattgcgggccgtcgtcgataggcgccaggaacttcatgaagtcctcgcgcaccaccacctggtcattggccagaagcttctgttcgcgctcgctcaggtgctgggcgtcacgcggcaccagtttcaggcgcaagccataatgcggttgcagctcgtccaggcgtgcctggcgcgcttcaccctgcaccggccgcagttgctccaccaaagcccaggccgggccgcgcagggcttcacggttataggtctcgttggactctggcatgtacgcgtccaggccgtagttgaccagccagatcgacccggccaggccgagcgcgaggatgacatagaggcgcagatacaatcgcagcatctaggcctcccacgcgaacggattgaacaggtagcccttgccccagatggtcttgatgcaaaccggctcgcgggggttgtcgttgagcttgccgcgcaatttgctgatatagacgtcgacgctgcgattgaggccgtcgaaggcaatgccgcgcatgcgattgaggatgtcatcgcgcgaaagaatcttgcccgagctgctggccagcaaccacagcagctcgaactccatggtggtgaggtcaatgttctcgccacccaggctgaccacccggcaactgcgatcgatcgacaagcggccgaactccagggcaccgcgtaccgtaggttcgggcacttggcggcgttgcaaggcgcgcaaacgcgccagcagcaccggcggcttgatcggcttgatcacgtaatcgtcagcgccggactcaaggccgaggatatggtccaggtcatcttccttggcggtgaggatcacgatgggcgtatccgacacattgcgaatctcgcggcatacatgcaacccgctctggcccggcagcatcaagtcgagcacgacaatctttggcttgaactcaatgaacgccgccaaggctttatcgccccggtggaccacccgtacctcaaaaccatgttgcgatagaaaatgtgcgatcagccctgccagcttctcatcgtcctcaacgagcaggaccttgcccagacccaggttttccataagttctcagtgtggataggcggattgaagtgtgggcattataggtggcaagctggccaacagaagccgctggccagtacgcaccgacgaagcttcatgcttttaagagtttttaacaaataacctgcaatcttttacgtcattcacagggagttccatgcgcaaggattacctggcgttcttcgtttcgctgttcctgtcacggttgggcgaccagatcctgttgttcattgtgccgctgatcgtgttccagaccaccaatagcgcgtcattggcgggcctggcgttttttgtcgagtcgctgccgcgctacctggcgtttccggtgtgcggagcgctctgcgacaggttttcgcctgtacgtatcctgcatatcagccaggtgtatcgggcgttggcctgtgtggcagcggtggggctgtatggactgttcgacggtatccattggttggtgatcctgtccgccgtgtgcggggtattgaccacccagggcatcatggcgcgcgaagtggtaatgccgcatatcttccagcattacacctacgccaagaccttgtcctactcacagatcgccgatcaaagcggcctggtgctcgggccgttgctggcagcattgatgctggaggtctgggcgtggccctgggtagtgctcggtgtcgccgcactgttcgtgctggcagacctggcaatgctggcctggcagcgcaacaccacggtgaacctgcagatccatgagcagcacccgggaatctggctgcaacccctgcgcaccgcgttcggccacatccgcagccgggtggagttgaaacgcatcatcaccctggcggtcggtgtgaatctgattgtcggggtgacgctggccacttcggccgcgatggtcaccggccattacgccgccgacaaggatgcctacgccctgctgcaagccgccggcgcgctggtcaccatcgtgattctgttttatctggcgcgctcagcgttgccgctgaaggtgatgggcgggctgtcgtattcgatgattgccgtcggcgcgctgatcactgcgatcagccccggcgtttgggcctacgccgtgggtttcctgctggtgaccggcttcgacaagatgttcaacgtatacctgcgcagcacccgtcaacgggtcattccagtacaggatttcggcaagacggtgggtgtgatcaccttgctcaacaacctggcccagccattggcgggcctgatgattgccgtgctggcagcgcccctgggcatgcgaacggtgatcctgctgctggccggcatcaccgccttgctcggtgtggccgtggcctcaggctggcacgccactgtgaaagcggaactcgatgtcgggtgattcgatcagttcctgctcggccgccctcacccgctcgataacctgggcgatgtccttggcgtcgccatactggtacgccagcttcaagtagccctggaagtgccgcgcctcgcttttcaacaggccgaagtagaacttgccgagttcttcgtccagatgcggcaccaacgcttcgaaacgctcgcaactgcgtgcttcgataaaagcgccgaccaccagggtgtccaccagcttgaccggctcatggctgcgcaccactttgcgcaagcccgacgcataacggccggcgtgcagttggcgcagctcgaccttgcgctttttcatcaggcgcatgacttgctcatggtgcaccagctcttcgcgggccaggcgcgacatcatgttgatcaggtcaacgtgggcgtgatacttggccatcaggctcagggcggtgctggccgctttgaattcgcagttcttgtggtcgatcagcagggtatcctgatcggcaagggcagcctgcacccaggcgtcaggggtgcggcagccgaggaattcatggatttcgggcaggttcatcgggctcacgggtaaaggatcacaaaaggccgccgattataccgaccccgtcaaagaccaccagccaccggccttgatgtgtatcaacatgacgtctgacgggcagcaactatagttgttgcatgccccttcctggagatcctgatcatgcaagccatccgcagcattctggtggtcatcgagcccgagcattcggaaagcctggccctcaagcgcgccaagctgatcgccggggtgaccgacgcacacctgcacctgctggtctgcgacaagaaccatgagcattcggcgctcttgagcgtgctcaaggaaggtttaaggaacgacggctacagcgtctccaccgaacaggcgtggaacgacagcctgcatgaaaccatcatcgatgtgcagcaagccgagggctgcggcctggtgatcaagcaacactttcccgacagcccgctgaaaaaggccctgctgacgccagcggactggaaactgctgcgctattgcccgacgccggtgctgctggtcaagaccgccacgccatgggccggcggggtgattctggcggctatcgatgtgggcaacaccgacggcgaacaccgctcgctgcacaattcgatcatcgaccacgggtttgatatcgccagcctggccaaggcgcagctgcatgtgatcagcgcccacccgtcgccaatgctgtcggcggcggatcccaccttccagctcaaggaaaccatcgaggcgcgctatcgcgagcagtgccgggcgttccaggctgagttcgacgtggacgaaaggcacctgcatatcaaggaaggcccggccgatgtgctgatcccgcacatcgcccatcagttgcaagcggcagtgaccatcatcggcaccgtggcgcgcaccgggatttccggggcgttgattggcaatacggcggaggtggtgctggatgcggtgcaaagcgatgtgctggtgctcaagccgcaggagttgatggatcatctgcaagaactggcaaccaagccctgaagaacaatagagggcaaaatgtgggagggggcttgctcccgattgcagtgggtcagtgaaggatgggctgactgacacactgctatcgggagcaagccccctcccacatttggatgcatgctgtcaggtagatagcgcatctttcaagaatcccggggcgatatagcgctggtaatgcgcttcggagaggataaagaactcccgatcaatggcatcgcgcagttccggcaaagcccaatcgcgaaactccggcaacagcaccatgccgtacgcctccaggttattgatcacccgcgccccgcgtgcaatcagctggtaggcccagcagtattcggactggtgcggcacaaagcgaatcttgcgttgctccaactgcccgcgcagggtcttggggtcgaagacctccactttgccggccatgacctgcaccagcagttgctcaagcctgcgccagactgcgcgtttttcctcttcgttatagccgttccactggatcacttcgtggtggaagcgcttgcagccgcggcacacgagatcgccgtagaccgtggagcacaggccgacgcagggagtcttgatggtttggttgggcatggtcaacaacacgcaaatcagcgaaacagtgcgccatgttagccctttgtctaaggttgatcacccagcaaacttggccaggcaacttacctttagatttttttgccgtagaatcacccggccttgtaaggcgccaataatccgctggaagctgttttcaaagcgtcacgagcacagtcgttccttcagaacggtgttggcgtgggctcgacccggtaggtcagaacccgcgccaaccctcatcagctccgttctgcaggcgtaaaactttgaaagcagcttctgtaaaggaatgacggcagcgctggctttgcggctcaaaaagcccccgagcgcatgcgtgccgttcatgcctggatgagcgtcccgtgggaccactgatgagggtaataactgtgcttgaagcctaccgcaaacatatcgaagagcgtgccgccctgggtatcgttccccagccgcttaacgccgaacaaaccgcaggcctggtcgagctgctgaaaaatcctccggctggcgaagaagaattcctcgttgacctgatcaccaaccgcattccaccaggcgttgacgaagctgcctacgtcaaggccggtttcctgtctgccctggccaagggcgaagccacttcccccctgatcgacaagaaacgcgctgttgaactgctcggcaccatgcaaggcggctacaacatcgtgacgttggtcgagctgctggacgacgccaccctggcgcccgtcgcggccgcccagctcaagcacaccctgctgatgttcgacgcattccacgacgtggctgaaaaagcccgcaatggcaacgagcatgccaagggcgtgatccagtcctgggccgacggcgagtggttccgcaaccgccctaccctggccgacaagatcagcctgcgtgtgttcaaggtcaccggcgaaaccaacaccgacgacctttccccggcgcctgacgcctggtcccgccctgacatcccgctgcacgccctggccatgttgaaaatggcccgtgaaggcatcgtgccggacgagcaaggcaagaccggcccgatgaagcagatcgaagagatgcgcggccaaggcttcccgatcgcctacgtcggtgacgtggtcggtaccggttcgtcgcgtaagtcggcaaccaactcggtactgtggttcttcggtgacgacgtgccttacgtgccgaacaagcgtgccggcgggttctgcttcggcagcaagatcgctccgatcttctacaacaccatggaagatgcgggcgcactgccgatcgaattcgacgtgaccaacatgaacatgggcgacgtgatcgacctgtaccctcatgctggcaaagtctgcaagcacggcaccgatgaagtcctgaccaccttcgaaatgaagaccccggtgctgttggacgaagttcgcgccggcggccgtatcccgctgatcatcggtcgtggtctgaccgacaaggcccgtgcagaactgggcctgggccctaccgacctgttcaagctgcctgaagcgcctgtcgacaccggtaaaggcttcaccctggcacagaaaatggtcggcaaggcctgcggcctgccagaaggcaaaggcgttcgtcctggcacctactgcgagccgaagatgaccaccgtgggctcccaggacaccacaggtcccatgacccgtgatgaactcaaggacctggcgtgcctgggcttctcgaccgacctggtgatgcagtccttctgccacaccgcggcctatcctaagccgatcgacgtgaccacccaccacaccctgcctgacttcatcatgacccgtggcggtgtatcgctgcgtccaggcgacggcatcatccacagctggctgaaccgcatgctgctgccggacaccgtcggcaccggtggtgactcccacacccgtttcccgatgggcatctcgttccccgcaggttctggcctggtcgcgtttgccgcagccactggcgtgatgccactggacatgccggaatcgatcctggtgcgcttcaaaggcaagatgaagcctggcatcaccttgcgtgacctggtgcatgccattccttactacgcgatccaggctggcctgctgaccgtagagaagaaaggcaagaagaacgccttctccgggcgcatcctggaaatcgaaggcctgaacgacctgacgctggaacaggctttcgagctgtccgacgcctcggccgaacgttcggctgccggctgcaccatcaagctgtccaaggactccgtcaccgagtacctgaactccaacatcaccctgctgcgctggatgatcggcgaaggctacggcgatgcacgcaccctggaacgtcgcgcccaagcgatggaagcctgggttgccaacccggagctgatggaagccgatgccgacgccgaatacgccgaaatcatcgagatcgacctggccgagatcaacgagccgatcctctgcgcgccaaacgacccggacgacgcccgtctgctgtccagcgttgccggcgagaagatcgacgaagtgttcatcggttcgtgcatgaccaacatcggtcacttccgcgctgccggtaagctgctggagcaggtcaagggccagctgccaacccgcctgtggctgtcgccaccgaccaagatggacgcgcatcagctgaccgaggaaggctactacggcatctacggcaaggctggcgcacgcatggaaatgccgggctgctcgctgtgcatgggtaaccaggcacgggtagagccgaattcgaccgtggtgtcgacctcgacccgtaacttcccgaatcgcctgggtgacggtgccaacgtctacctggcttcggctgagctggcggcagtcgcttccactctgggtcgcctgccgaccgtcgaagagtacatgggctacgcagcgaaactggacaccatggccagcgacgtctatcgctacctgaacttcgaccagatcgccgagttccgcaagatcgcagcaagcgccaacatcccggtgattcaagcttaacggtgtgttgatgtgaaagacgccgcgtatcgcaagatacgcggcgttttttatgcccgtaatactgtgggagggggcttgctcctaatagcagtggctcagtcaattcatgggtgactgatacaccgctatcgggagcaagccccctcccacatttggatctctgttgccctcgcagactgtgtcaggcgttgagcaagcagcggatacaccagccaggctgtaattcggcatcagcaacaccaccaaacaactgtgggacggggcttgcccccgatagcagtggctcagtcaattcatgggtgactgatacaccgctatcgggagcaagccccctcccacatttggatctgtgtcgtccttgcaggccgtgtcaggccttaggcaatcagcgaatagaccaatgccgtaatggcaaccaagccgactgccgtgacaaacacattcgacgcctgcccacggtacttggccatggccggaaccttgcggatcgcgtacatcggcatcaggaacaggatcgacgcaatcaccggcccacccagggtctcgatcatgccgaggatactcgggttgagcgtggcgacgatccagcacaccaccagcatgaaggcggcggtcatgcggtccagggtcttcggtgccgggcggcggccggtcttgaccaccaggcccttgaggccctcgctggcaccgatgtagtggcccaggaacgacttggcaatcgccacgaacgcaatcaatggcgcagcgaaggcgatagtcgggttgtcgaagtggttggccaggtacgacaggatcgacaggttctgtgccttggcctcggccaactgcgcgggcgacagggtcaacacgcaactgaatacaaagaacagcaccatcgccaccatcagcaggtgcgcgcgagacaggatctgcgagctgcgctcctcggcatgtacaccgtactggcgcttctggtccaccgcaaaggccgagatgatcggcgagtggttgaacgaaaacaccatcaccggaatcgccagccatagcgtattaagcaacgccgaaggggccggcacttcgctggcggtgctgagaatgccaccgttccaatgcggaaccaggtacacggccaggaacagcaaggcgacgataaacggatacaccatcaggctcatggccttgacgatcacctgctcgccgcaacgcaccacggccagcaagccgaggatcagcacgaacgccaggatcgcccggggcggcggcatgatgtgcaactgatgctccatgaaactgctgacggtattggtcagggccacgctgtagatcaacaggatcgggaagatcgcgaagaagtacagcaacgtgatcagcgcaccggccttgatgccaaaatgctcttcgaccacatcggtgatatcggagccttcacggcccgacagcacgaaacgggtcagcccacggtgggcaaagaatgtcatcgggaaggccaacagcgccaggatcaccagcggccagaagccccccaggcccgcgttgatcggcaagaacaaagtaccggcgccaatggcggtaccgaacagcccgagcatccaggtcgtgtcctggcggctccagcttgtgagggttgcaggtgtcgttgcatagcgttcgtcgacgctattggcctgatcattcatccggtcggatctccgcattcacacggccaggacgagtcagaaaaacctgacaggcagcgccctggccataacaagggccggattgtccgggattctctcgaataagcaaagacttagctgaggaatggcggggcggccgccccgatggaactgttgcgctgcggccccgacaacggcaattaactctcattgagaagatgccaggcccggcatgggagcagaggaattcaaacagcagaggcgtatctgtacgtgagtaaaagagagaacacctaagtatcaattaatatgaatatccacaagaaaaagcctatttacataacattcaaatattattttggaagttactttttattactaatggtagcttttgttacaagggtttactcaagcattgagagccgcctttatcacgtctatattccaacccagcaaaccaagaccgccataatattaactatctgccaggtatcactccatgcaaaaacgctctgtttttttcacaatcgcacttcttgcagggttgctcaacccactcgtggcgcaagcacaatcgacagcgcaatatcctgatatacgcgcattcggcacatcgccccaatggttgaccaccaaagtttatatcgaaggtgcgcctgatatagacgtcaaggataagtacccaggcgtggttggcatctcgatgtgggatcccgaacgcaaccgctatgaattcttttataccgacactggtctctcgaaatacgatcacggtggtggtggatacttcatggtcacaggcgacaggaatacccatatcctggtgcctgacaaaggcccgcacaggagcatcgtcaggcggctggaagtcctgaacaatcaggaattcacttattcgcgggaagtacctcgcgacatggtgcagaccaacgaaaacgtacgaatctatgtggtgcatgcgccttacacggggccgataaaaaccacccctacccattaaccgtatccaacaatacttcccgcgcagtgcccgatcactgacttccccctcaaaaaaacgaagatctttacttatgaacaacccgctcaaatcactattaatctctactgtactgacgtccgcctttttttcaaccggcgttattgcccagactgcatcacctgcagccgtcaaagagactgctgctattaccgcagacaatgcactgctacttacagtgttcttgaggcacgatcaatcacgttcactgagtgaattgagggctcaacttcataagcaggatttcttcaagtcattcccaccaccgggaatagaggttgtcagctggaacatcaccatgggcatcggccacatcattgtgttgcgcttgcccgcgtccaaactggtggcgctcaacatggcgctggaaagtaccgcttggggcccttataaaacagagttctttcccagctacgattaccgggacatcttccaggggttacaaaagaaggcccaggaaagcaattaatcatttggcaactacgcggcgtctcctggaccgaagcgccgctccgagattgccaatcggttcggcgttgggcccaggcatctgttcgaccaggcaaacattcttttggccccccggttttagtgccacaaaaatcccgcataatcccaggatcgaaccccacagtaagagctgccccatgcccaacactgtcctggtcctggttgaaaccatcaacgaatacctgcaaatcatcgagagcaatgactttcacgtgatcctggcgccgacgcccgcagagcgggcacaggcgatcaaggcccacgcagggcagatcaaggccgtgctgacccgcgggcccctggggctgtacgccgaggaaatcgcagcgttgcccttgctggagatcatctgcgtgatcggtgccggctacgagcatgtagacctgcaggcggcgagcaaccgtgggatcgtggtgaccaatggtgccggggtcaacgcgccttcggtggccgaccacgccatggcattgctgctgtcactggtgcgcggcattccccagaccgatgcggccgtgcggcgcagcgaatggccgaagatgatgcgcccttcccttgcgggcaagcaattggggattctcgggctgggtgccgtgggcttggagatcgccaagcgtgccgcccttggcttcggcatggaggtcagttatcacaaccgccaaccccgcgatgatgtggattacacctattgctcaactgccgtagaactggctcgcacgtccgatttcctgatcctggccacgcccggtggagccagcacccgccacctgatcgataaacacgccctggatgcattgggccctaatggctatctggtcaatatcggccgcggcagcgtggtggtgaccgctgacctggtggccgcgctggaacaacggcgtatcggcggcgccgcgctggatgtattcgacgatgagcccaaggtgccggacgccctcaagcgcctgaacaataccgtgctcacctcccacgtggccggcctgtcaccggaagccgctcacgacacggtgcaacgggtggccgacaacctggtggaatactttgccggccgccctgtactgacgccggtcacgttgccagcgcccgcaaaatgaccaatcaggcacgctgatcacccttcaacacgctaacctattaaaccgccccgaccttgtcgctgggcggtggtgcgcattagattaggaaatagtccaaggcctttagaataagcagaagggataagcatggcgctgaacgaccaatcgacccagattcgccccggcgaagagcttgatgccagcctgatcgatccctacctcaaggctcatatcccaggcttgcagggaacgctcaagatcagccaattccccggcggcgcgtcaaacctgacctacctgctggaatacccgggccaggagttcgtgctacgccgcccaccgtttggccacaaggccaaatccgcccacgacatgggccgcgaataccgcattctcaatcaactcaaggatggcttcccgtactgccccaaggcttacgtgcactgcaccgatgagtcagtgatcggcgccgagttctatgtgatggaacgggtcaacggcatcatcctgcgctccgacctgccggccgaactggggctggacgcgaccaggactgaagccttgtgcaaaagcttcatcgacaagttcgtcgaactgcatcaggtcgactatgcggcctgcggcctggccgacctgggcaagcccgaaggctacgtagcaaggcagattcgcggttggagcgaccgttacgaaaaggccttgacccccgatgcaccaaaatgggaagccgtgcgtgcctggctcaatgacaaaatgcccgacgactacccgacctccagcatcgtgcacaacgactaccgcttcgacaacgtgatcctcgacccccgcaacccgatgcagatcatcggcgtgctggactgggaactgaccaccctgggcgacccgctgatggacctgggcaacaccctcgcctactggatcgaagccgccgacccggcgccggtgcaactgatgcgacgccagccgagcaacgccgcgggcatgctcacccgccgcgagttcgtcgactactacgccgagcgctccggcatccagattgacaatttcgatttctattacacctacggtctgttccgcctggccggcattgtgcagcagatctactaccgcttctttcacggccagacccaggacaaacgctttgcgcagttcatccatatgaacacattgcttgagcagatgagcctgaatgtcatcggcaaatccgcgctctgattgcaaccacaaggaaccctcatgtccaagaccaacctgttcgaccttgacggcaagattgctttcgtttccggcgccagccgtggcatcggcgaggccatcgccaagttgctggcccagcaaggcgcccatgtgattgtttccagccgcaaactggaaggttgccagcacgtggccgatgcaatcatcgccgacggcggcaaggctaccgccattgcctgccacattggggaaatggagcagatcgcccaggtgttcgccggcatccgcgagcagttcgggcgcctggatattctggtcaacaatgccgcgaccaacccacagttctgcaacgtgctggacacggacctcggtgcattccagaaaaccgttgacgtgaacattcgcggctacttcttcatgtcggtggaagccggcaagctgatgcgcgaaaacggcggcggcagcatcatcaacgtggcttcgatcaacggcatctcgccaggtgtgttccagggcatctattcggtgaccaaggccgccgtgatcaacatgaccaaggtgttcgccaaggagtgtgcggcgttcggcatccgttgcaacgcgctgctgcctggcctgaccgacaccaagttcgcctcggcgctggtcaagaacgactcgatcctgaaaacggccctggcgcagatcccgctcaagcgcgtggccgcccccagcgaaatggccggcgcggtgttgtacctggccagtgatgcatcgagctacaccaccggcgtgtcgctgaatgtggatgggggcttcctgtcctgacatcgcctgggtttcttcggatcggtttgcgcgtaaccttggcgcagatcgatctgtcccaggatgaaacatggaactgcacctcgtcatcaccggccgcaaggacctggctgcccagctttaccagcagttgcgcgaagccatcgccaccgggcgactctcggccggtgcacaactgcctcccagccggctgctcgccgagcaactgggcatatcgcgcaaaactgtctccgacacctacgctaccttgacttacgaaggcctgctggtcggcaagattggccggggcaccttcgtcaatgcgtgggcgccacagcccgaccgcgtgcagagcgccaccgacctggcctgcgccgccaacctgggcaagtgggcggcactgccctcgcccatgcgccaccccaccgacgacaatatcctgcgctacgaatttatcggcggcgccaccacgcgcaatcaattccctcaggaggaatggcggcgctgcacccagcatgccctgcgccgtatcgcccagcacagcggtttctacagccagcccgaaggcttgcccgccctgcgcagtgccatcgccgggcacatcgcgttttcccgcggggtcaaatgcctggaccgcgacatcgtggtcaccaatggcgcccagcaggccctcgacctgatcgcccgtgtggtgctggagccgggtagtatcgtggccatggaagacccgggctacagccccgcacgccaactgttcgtggccatgggcgcgagcgtcgccagtgtgccggtggacgaccagggcatccgggtcaaggacattcccgagggtacccggctcatctacgtgaccccgtcccaccagttcccactcggcatgcccatgagccagccacgccgcgaagccctgctggaacgggccatcgagcttggcgcgatcatcatcgaagacgactacgacagcgagttccgctacgcaggccgccccaccgactccctgcaaagcatggacacccgtggcgtggtggcctatgtcgggactttctcgaaaaccctgctgccagagttgcgcctgggctacgcggtgctgccgccggcgatttatgccgcggtgctcaaggccaagcaactgaccgaccagcactgttcgaccctgccgcaatgggcactggccaagttcatcagcgaaggctatttgctcaagcatatccgccgctgtcatggtgtttatgccgggcgccgccaacgcatcctgcaacgcctggccggtgatctgtcaccctggtttgaagcagtacccacggtggccggctttcacatggcagcgttgtgcaaagtgccggtggatatcacgctgctgatagaaatggcacgccaggccgaagtgggcttgtatccgctggacgtgttctaccacgacgcacctgctcgcccgggcctgatcatcggtttcggcgccattgaaaccctggacatcgacccggcgctggacaaggtccgcgacatcctccagcagattggctaaggttttttccggcgcattggtcattggtggcgtgcaggctacggcgtagggtgaagcggtctcgaactacctggaaccctcaccatgaaacgaatactcgccgccacgctgatgctcgcgtccctcagcgcctacgcccacgacccgatgtacaacaaggaaacgctcgaggtgctgcaagagcacgccttgaccaacgtgcccggcaagaaagtcctcatgctgaccgtggattacgcccccggccaggccacggtaccccatagccacaccggtactgccgtggcctatgtgctggagggccaggtcacgtcgcgggtcaacgatgagaaggcgatcacctacaaagccggggaatcgttctacgaaccggcgggctcgcggcactttgagtcaagcaatgccagccagacccaaccggcgaaactgctggtggtgatggtgatggatgacaaggctgaagtgctcacacccctgtcacagtaacccgccgcaccgctgaaccaatgtgggagggggcttgcccgcgacgacgtcggcccagcaaacattgatgttggctaagccaccgctatcgggggcaagccccctcccacgcccgattcaagggcgcttgaacgtgcaccgttgcgcttcgatgcgcgggcggcaaacgcagccttccagatgatcattgaccatgcccatcgcctgcatcagcgcgtacatggtggtcggaccgacaaaggtccagccacgcttcttcagggccttggacaggcgcaccgaagccggtgaggtcggattggctgtccagtacgcaatgtccaccaccgccgggcgctcttgctcggcgggctcgaatgcccacaaccagcgcgccagcgagccggtttcatctaccagctcacaggcccgacgcgcattgttgatcgtggaaacgatcttggcccgattgcgcacgatgcccgggtcacgcatcaagcgctcgacatccgcctcgccatactgcgccacccggcggaaatcaaaaccctcgaaggcctgccgaaaacgctcacgcttgcgcaggatggtgatccacgccatccccgcctggaagccctccaggcagatcttctcgtacaactggatgtcatcggccaccggcacgccccactcgtgatcgtggtaatgggggtattcgggggcggcgttgcgccaagagcaatgggcatgccctgctgcgtcggtggtcagtcctgattggtccatccatcacctcgtgtgccgagggcggatgatacgcaaaaaaattcaaaccccgccaaccgctcaagcaccggacttaccgacccactggtcagaccgggacccgccgaccgccgaatatttacttgtgatttgaaaaaagccaagcgtagactggccgcgcactggacttaccggtaagaccaaaacaattaagccctggaaccaccagggcaccgaatagagatccttcccatgctcagatggtgctcgcgttcgattttcctgcaagtcgtgattggcctgatcctgggcatagtctgcggcctggccctccccgaattctcctcgcaactcaaacccctgggcgacggctttatcaagctgatcaaaatgctgattggcctgattgtcttctgcgtggtggtcagcggtatttccggcgccggcgacttgaagaaagtcggacgcatcggcctcaagtcggtgatctactttgaagtgctcaccaccgttgccctggtgctcgggctgatcatggcgttcagcaccggcattggtagcggcgccaatattcatttggagcaactgtcgtctgctggcttgaacgaattggccgacaagggccagcacatcaagggcaccagccagttcctgatggacctgatccccaactcggtgatcggcgcattcgccgacaacaacgtgctgcaagtgctgctgttctcggtgctgttcggtagtgcgctgaacctggtgggcgaagcggccagcggcatctcgcgactgatcaacgagctgagccatgtaatcttccgcatcatgggcatgatcgtgcgcctggcgccgattggcgtgttcggcgcgatcgcgttcaccaccagcacctacggcctcgactccctgcaacatctgggcagcctggttgggctgttctatctgacctgctttgctttcgtcgcgctgatcctcggcctggtgatgcgcctgtcgggcctgcgcatgctgccgctgctcaagtacctgcgtgaagagctgctgatcgtgatgggcaccgcctcctccgatgccgtgctgccgcagatcatgcgcaagctcgaacacttagggattggcagctccaccgtgggcctggtgatccccaccgggtactcgttcaacctcgacggtttttccatctacctgaccctggccatcgtgtttatcgccaacgccaccggcacccccttgtcgatgaccgacttgctgaccatcctgctggtatcgctgatcacctccaaaggcgcccacggtattccgggctcggcgctggtgattctggcggcgacgctcacggcgatcccggcgatcccagtggtcggcctggtgctggtactggcagtggactggttcatgggcattggccgtgcattgaccaacctgatcggtaattgcgtggctaccgtggcgattgcgcgctgggagaaagacattgatatccaacgcgccaacaaggtgctggacggccagcaagggtatgccttccaggccaagaaaccggtactgccggcgcatcaggaattttaatgtgggaagggcttgccccctcccacactttgatcttcaacagtttgaacctcgtattcgcaacttcaaggagcacacgacgtgatcagcacttcaaccgtcgtcaattcagttgtagagaaactgcgcgccgcactcaagcgcggccagtggcggcgcggggaaatgctgcccggccagcgtgaattggctgaacagttgggcatcagccgtccgagcctgcgtgaagccgtgatcgtgctggaaacactcggcctggtgcgctccatgcccggcaaaggcgtcgttgtgctggaaaccagcgtcagcgagccgcaatcgagcgacgccgtggccgatgccagcctcgaagacatcctgcaactgcgctacaccctcgaaccttttatcgtgggcctggtggcccaatccatcagcagcaaggaagtcggccaattgcgcctgaccttgatggacatgagcgaagccctggatgctggcgatgccgaagccggcatgaacgcctatatcgatttccacgaagaactgttcgccctcacatccaacccgattttccagaatgtggtgcagcaaaccagcaacgcactcaagcaaagcgcacaagtgctgcgcaactcgcctgaacacctggctgagcgcctgcgggaaaacgaagccgtggtgcgcgccatccgcaacaagaacagcgccctggccagtgccgaaatgcgtcggcacattcttcaggaaggcttgcgcatgggcattcgcctgaatatcccggacgaccatctgggcagctgattttttggaggcaggccatgaatgctcacgctttgcactacgaaaccatccttgcgcccctgcgcctggtcggcggcaaaaagccttcggtggatgacatctaccctcgactgttcgacgccatcctggaacaacgcatcgcccctgccagtcgttttactgaggaaggcctggctgaaatctttggtgtgagccgcagtgtgattcgccgcgtgctggcaaagctatcccaacaacaagtgatcatcctgcgccccaaccaacgcgcccaggtggctgcgccgcacgccctgcaaacgcggcagatcctggaagcacggcgcatggtcgaaataaccttggttcaactggcgtgcgctcaagcaaagccgtcgcaaatacgccaactgcgcgaactgatcaaccgtgaacgtgactgcattgcccgtggacaacgcggggccgcacttcgcttgtcgggagaattccacctgcaattggcggcgatggcgaggaatgcgccactgtcgcaattcctcaatagcctggtgcctttgacggctctggctattgcgcattgcccaggtacagaccatacggcctgtacctgggaagaacacactgcgattgccgatgccgtggagcagcatgattgcgccaccgctgtagagcgaatgacccaacacctgaatcacctccaatgccgcctcatcgcccctgccctagatatatagcgccggcttaccgacatctttccatagtctggatttcgcactgattgagtgctttatgactggcattgaagatgatcattgatccaaaagtttacgagaacctgtacaccctggtcagccaattgaacgagcataaggcttctctgaccgagccgctaaagacttcattgaccgaactgaccaatgcctcgaaagccatcggaacagcgttattccaacaagaacgctttgacgaggccgagttttatttgacgttccctgggctggccggcgatgccgaagcgcaatacggcatggctatctgcagcggttaccaactcggagcgttccgctacccgttcccgcgaacagtgggatggctcaagctcgcagcggcacaggatcatgtcctggccttgatgtggctgggtgatagccaatcgctgactaaggctaaggccctgtccacggcgagcgcagcccagggtgacatacaaggcatgttcaatttgtataccttgacggaggacttcacctggctgaccaaggctgccgaaacgggcaaccccagagccttattcaaactcgcccaaacctaccgggaacacccaggactgatgcccaacgccgtagcgcgcacggcagaaattgaagtgctgtgtcaaagagccgctgatagcggatatccattggcactcgcggaccgtttgttctccccggcctcaaccgccacgatggttgaaaagcagcgaaggcttgctcaattggcgtggacaggtgaccaggacgggttgctggagtacggctatgcacttgccgcgcttgcacgagacaaaaccaggccggctcgcacctatggattggccagagatctgcccaaggcctatgccgcgctgaagttcgagtgggatagaacggctaacaccaggcctgttccagggttggaagagaccctcgctttcatcgctcatcagatgaatgcgactgaccatgatgccgtcccagctattgagtcggagctggcaagcaaaatagcctcggcgcctaaatactacgaacccaaggtagttgtaggttactcacccaattgatcgtgccttggcctggagcctgattagcgcggctgaaaaaaaacctcgtgtcttacgacacgaggttttttctggttttaacgctctgccagcaccttacagcaccgactgaccactcaacgccaggtccagcaactcccggttggccactgcgtacatggcgtagtccgtgccaacagcagcacgaatttccaccatcatcgcgcgccagcgatcagccatgtcctggtgctgctcaagccacagggccacgcgggcttccatgtcttgtggcgcgtcggccatttgcaggaccgagatagtgatcgcccgttgctgccagtccacgtcgtcgcggaaggcttcgcgggcctgggcctgccagttgttggctaccggcagatcgctgatctgctgcaggtaccacggcaggtccagggcgctgccgacggcgaagtaggccttggccacttcggcggcgtcatgcccggtcacgtcggcggcttcgatgatcggcagcaaggtgtacaggtgggttgtaccggccaccatgcgcgccagcaactccggcacaccggcttcggtgtacgcctggtagcgggtctgccaaccttcgcgggtcggaccttccagcaactcgtcgagcttgagacccaacgcggccaagtgcggaccgaagtgcgcggtgtcacgcccggcgtcctgctcgttgcgacggctgcgcaggaaccagcgcgtagcgcgacgacccaggcgcatcagctcatccatcagctccagttgcacgtcggcagagacctggtggtccagggcttcgatctggcggaaccagtgcggaaggtggaagatgtcgcgcacgatcacataggcgccggccacgttcgccgggctcatgccagtcgactccttgaggcgctgcacgaaggtgatgcccatgtggttgaccaggtcgttggcgatctgggtgctgacgatctcgcgcttgaggcggtgacgacgcatggcctcaccgaacttggccaccaggctcggcgggaacgcggtctccatgtcacgggtcaggtactcgtcatccggcacctgcgacttgagcagcgcctccttgaggtcgatcttgctgtacgagatcagcaccgacaactccggacgagtcaggcccttgccggtagaagcgcgctcgctgagctgttcctcggtcggcaggtactcgatggcgcggtccagcttgccacgaccttccagatcgctcatcaggcgtttgtactcggcggcacgctcgtaggcacggcgcgccgccagggacagggcctgggtctgcttgtagttgttgcccaacaccaggtggccgacttcgtcggtcatgctcgccagcaactggttgcgttgcttgtcggtcatgtcaccggcctgcaccacttcgttgagcaggatcttgatgttcacttcgtggtcggagcagtccacgccaccggcgttgtcgataaagtcggtgttggaaccgccgccattgaggccgaattccacacggcccagttgggtcatgccgaggttaccgccctcacccaccaccttgcagcgcagctcgttgccgttgacacgcagcgcgtcgttggccttgtcgcccacatcggcatgactctcggtgctggccttgacgtaggtaccgatgccgccgttccacaacaaatccactgtgtgccttgagcaaggcgttgagcagttcggtcggagtcagcttgtcggcctggatgtcgaagcgttccttcatctgtggcgagatggcgatgctcttggcgctgcgcgagaagataccgccgccttcggacatgatgctggtgtcgtagtcggtccacgacgaacgcggcagctcgaacaaacgcttgcgctcgacgaagctggtggccgggttagggttcgggtcgatgaagatatgcaggtggttgaaggctgcgaccagttgcagcttgtcggacatcagcaagccgttaccgaacacgtcaccggccatatcgccgacgcccaccacagtgatgctgtcttcctgcacgttgatgccgcgctcacggaagtgacgctgcacaccgacccacgcgcccttggcggtgatgcccattttcttgtggtcgtaaccggccgaaccgccggaggcaaatgcgtcgcccagccagaagccgtagtcgatggcaatgccgttggcgatgtcggagaaggtcgcagtgcccttgtccgccgccaccaccaggtaagggtcatcgctgtcatgacgcacgacgttggccggcggcaccagagcgccatccttcaagttgtcggtaatgtccagcaggccggaaatgaagatgcggtagcaggcgataccctcggccgcgatctcgtcacggctgccacccaatggcaggcgacgcggcaggaaaccgcccttggcacccaccggcacgatcaccgagttcttcacctgctgagcttttaccaggcccaatacttcggtacggaagtcttcttcacggtcggaccagcgcaggccgccacgggcgacattgccaaagcgcaggtgcacaccttcgacacgcggcgagtacacgaagatttcgaacttcggtaccggcttaggcagctcaggaatcgcatgcggattgaacttgaagctgaagtacgacttgttctggccgttggcgtcggtctggtagaagttggtacgcagcgtggccttgatcaggtccaggtagcgacgcaggatgcggtcttcattgagcacctgaacgtcgtccagggcggtgaggatcgcttgttccaggcgctgctgcttgtcttccaggtcgtcggcagtgagcttgcgtgccaggtagaagcgggtcttgaacaaccttgtcaactcgcgggcgatgtcggtgtggttgttcagggtgctggcgatatagcccaggtcgaagcccaggcggatctgcttgaggtagcgagcataagcacgcagcaacgcgacgtcgcgccatggcaggccggcggtcagcaccagccggttgaacgcatcgttctcggcatcgccgtggacgatatgcacgaacgcgtcctgcagggtgtcgttgagctgctggatatccaggttcacgccttcggcggcgatgaatgcaaagtcatggatccagaattcacggccattggcatggcgcaggcgatacgggaactcgcccagcacacgcaggccgaggttttccaggatcggcaacacgtcggacagtgccagcggggtatcggcgtggtaaagcttgcaatgcagctcacgctggccggagacctggcccaggggctgatagaagctcatcaccagcgggttggcttcggtgaggctgttgagatgctgcatgtcgaccacggccgaatgcgcggcgaaacgctcgcggtagccggccgggaagcctttcgggaagtccgccagcacgttggtgccatgggcttcaccgaagctttccaccaccaggctggcgtagtcgtcctgccagctgcggcaagcctgcaccacttctttttccagttgcagcgggtcgatgtccaggcggttcttcgggtcgacccgcaggatcagttgcacacgggccagtacggactcggagaagaaggtccagaactcgcagtccgaggccttgaggcgatccatcagcacttgctggatcttctggcgcacttcggtggaatagatgtcacgcggcacgtaggccaggcagtagcagaaacgaccgtacgggtccttgcgcaggaacacgcggatcttgttgcgttcctggatctgcacgattgacatcacggtgctgaacagctcgtcgaccggtgtctggaacaggtcgtcgcggggcagcacttcaaccacctgggccagctccttgcccaggtgcgccttggcctggaagcccgaacgacgttcgatctccgcgaccttgcggcggatgtaaggaatcacccgcacgctttcgccatacaccgaggaggtgtacaggcccatgaagcggtgttccttgatgaccttgccgtcggcgctgatttcacggatcgacacatagtccgggtaagccgggcggtgcacgcggcttgggtgtgcagccttggcgaacgacagcacggtcggttcgcgcaggtaggccacggcgtaatcttcgatgcgcaggtcttcggcggtgaggccggcgcgcagcagtttggtcagaccgaggaaggaactggcgtcatattcgatatgaccgccgtccgcctcgtcacgtaccacgaactcttcgtagccgaggaaggtgaagtggttgcccaccagccattcgaggaagttcttgatctcggctttttcttcgccgtcgatggcaaatgggctggcatcgataccagccagcaggtcctggaccttggctttcatcggctcgaaatcggcaactgccacgcgcacttcgcccagcacctgctcaagctctttgctcagcacgttcaattcggcggcgttggcgcaacggtcgatttccaggtacatcagcgattcttgcaggatgccgtcgccctgggtgccttttggcaggacttccaggagctcgcccttgctgccacgacgcacgctgagcacggtggtttgcagggtgtggatactgtagccgcggcggttcagctcggtgcgcaccgagtccaccaaaaaaggcaggtcatggtgcagcacttcgaccgcagtgtgggtcgattgccagccatgacgttcgtaatcggggttgtagacccgcacttggggctgggtgtgatcaaagcgctcaagcaggcgccaggcagacagagtgcaaccggccaggtcggaaaggcgacgctgggtcagttcatccagggaaatgatgccgaagaattgctcagcaaacagcgccacttgtggcagtgcctgttcactgatgtgctgggccagtgccgcttgcagttggtgctggaagtcggccttgctggctgcggtgaagaacgccatctgtggtactccgcttgggcttgttattgatggaagcgtcgcgtgttatccccttgcggggagaccgtcggctctgttcgtgggacacgataaacgaatcagggcgacaggtgggtgaagctggacaagacagtcaggtcacatacaacgtccataagatgtgcccctgccgggtgacggtacgacgggcaggtcaagcgcctggcgcggagcacatacgttgcgcagcttaacgagtgtacgaagactggtgcttgcgacgctgcgacatattcggtcatcggtaagcaggcaataggttgcaacttgggcaaccgcatttttccgtacaaaaaacctgcgtttttcaacccccgagtaccgaaaatgactgataccgcaccccaggtcatgcccggggcctgacacaccctgcagcataaaattcgccgtaatggcacaattgccagcgcaacaccctcctccacacaggatttcccatgctgcagctgaaaaccgacgccctgatggcaaccccgtgcgacgaagaagaagacaacatggccatgctctgctgccatggcaagaacggcgagatgttcatgctcagccgctacccagatgaagatgaagtagaactgacctgggattacgagccgtcgaccctggatggcctgaagatcaccctgagtgacacgaccttgctggtagatctcgccgcaggcgatgccgatgcattgggcggcaagaatcatctggagatcacccacgacacggccgcatccgacctggccgaagtggagaaaaccttgcagaacatcctcaaaggcactggtactttcatccggacttgagctgcacatagatcaaatgtgggagggggcttgccccggtagcggcgggtcagttcatacatctgtggctgacacaccgccatcgtgggcaagcccctcccacattgaccgtgttcccacacaaaaaccctacaagtttttctgaaaatacccgtgacgtcgttagtcgccacccccttcgatgcattaaagtaagcctcccaagcctgacgctcgtgctcgaccatcaggctcatctttccaggaaccgtcatcgatggaacatcgtgaagcgctgcttgcgctgcgaacctttctttctacgcagattctcggccaggaaaaactcatcgatcgcctgctgatcgccctgctcgccgacggccacatgctggtcgaaggcgcacccgggctggccaagaccaaggcgatcaaggagttggccgaaggcatcgaagcgcagttccatcgtatccagttcacccccgacctgttgccggccgacatcaccggcaccgagatctatcgcccggaaaccggcagtttcgtgttccagcaggggccgatctttcacaacctggtattggccgacgaaatcaaccgcgccccggccaaggtccagtcggccttacttgaggccatggccgagcgccaggtcagcgtgggccgcagtacctatgagctgtcgccgctgttcctggtgatggccacccagaacccgatcgagcaggaaggcacctacccgctgcccgaagcccagctcgaccgtttcctgatgcacgtcaagatcggcttcccggacgccgccgtcgaacgacgcatcctgcaacaggcccgcggcgaagcactcaatggcgaaaccaagcccgagcgccgcgtgagccagcaggcgatcttcgccgcgcgcaaggaaatcctcggcctgtacatggccgatgcggtggaggaatacctggtgcaactggtgatggccacgcgcaccccggccaagttcgacgcggaaatggccgagtggatcgcctacggcgccagcccacgtggttccatcgccctggaccgctgcgcccgcgcccatgcctggctggccggtcgcgacttcgtgagcccggaggatatccaggcggtgttgttcgacgtactgcgccaccgcatcatcctgtcgttcgaggccgaagccgccggggtggaccaggatcgcgtggtgcaacgcattcttgacgttgttgccgtcgcttgaagtcgatgaacgcaggcgatggtatccgcgtaaccctcagtgaactgattgagatgcgccaccacgtgcgtgaagtgcagttgttttctacgccgggccagcgcagcccattgatcggcctgcatcattccaagctgcgcgggcgcggtgtcgacttcgatcaggtacgcgtgtaccaggccggcgacgacgtgcgcaccatcgactggcgcgtcacggcgcgcacccaggagccgcacaccaagttgttccacgaagaacgcgaacggccgatcttcatcatggtcgagcagagctgccggctgtttttcggctcggggcagatgttcaagtcggtgctcgccgcccaggccgccagcctgatcggctgggcagcgctggggcataacgaccgggtcggcggcctggtattcggtgacagtgagcactacgagatcaagccgcggcgcagcaagcaaagcctgctgcagctactcaaccgcctggtgcgagtcaaccagagcctgaataccgaaagccgcccggaggccgacgccctgggcatggccctgcgccgtggtcgcgaggtgctgcgcccgggtagcctggggattgtgatctgcgatgaacgcgcactgaccgaaggcgccgagcagcagctgagcctgctgtcacgccattgcgacctgctgttgctgccgatctccgacccactggaccacgccctgcccgccgccgggctgctgcgtttcgccgaacgtggcgcgcaattggagctggacacgctgaacatcgacttgcgccaggcttacaaggcccaggccgaggcgcgtatcgcccgctgggagcggctcgcgcagaaattgcgcgtgctgctgatgcccttgagcacccagagtgaaatggtcgagcaactgcgcgaatacctcaacccgcaacgcccggttaaaaaacaatgagcagcctggaccaactgcaaccgctgattgccccgccagccattggtttctggcctccggcgccgggctggtggctattgctgctggtcatcccgctcctgggttggggcctgtggtccctgcgtcgcttgctgccgacccgtcgccctgtagcccgcgccgaacaaccgctggacccgttgcgcatcgccgccctggccgagctggcgctgatgcccaagccttacgacggcgcccccgccggcgcttggctgcagcaactcaacggcctgctcaagcgcctgtgtcgcaacgactacccttacagccagagccacaccctcaacgggcgcaaatggctggccttcctggataaccgctgccccgcggccggcctgacgcgctggatggtgctggtggaaggcgcctacaaacccgaatgcaaactcgatgacaaagccatcgccggcctgacccaggccgtcgacacctggattcgcaaacatgtttgagttcgcctggccgtggatcttcgccctgttgcctttgccctggttgatgcgcctggtgctgccggtggccgacagcggcgagccggcgttgaaagtcagttacctcagcgacctcgaaggcctggcccgccgtcgcgcccgcgccaacctgcccggctggcgccagcaagcgccgttcgtggtgctgtggctgttgctgctgaccgccgccgcccgcccgcaatggcttggcgaacccttgccgattgccgccagtggtcgggacttgctggtggcggtcgacgtgtccggatccatggatttccccgacatgcattggcagggcgacgacgtgagtcgcttatcgctggtcaagcacctgctcggggattttcttgaagaacgtgaaggtgaccgagtgggcttgatcctgttcggcacgcaagcctacctgcaagctccgttgacctttgaccggcgcaccgtgcgcacctggctggatgaagcgcgcatcggcattgccggcaaaaacaccgctatcggcgacgccattggcctggccctcaagcgcctgcgccagcgcccggcgcagagccgcgtgctgatcctgatcacagacggcgccaataacgcagggcagatcgacccgctgacagcggcgcgcctggcagccgaagagggtgtgaagatctacccgatcggcatcggtgccgaccccgagcaaaccggttccctgggcattctcggcgtgaacccgagcctggaccttgacgagccggcgctcaaggcattggccgaagccaccgggggccagtatttccgtgcccgtgatggcgaagaactgcaacagatcaaggacaccctcgacaccctcgagcccgtcgaacaacaaccgacccaagcgcgcccggcccacgcgttgtacagcgccccgttggccctggcgctgatcttgagcctgttgctggtgatccaggagcgttggccgaacaacgttttacaacgctggttcaacaagctgtcgagcaaggggatttttctgcaacaacatcctgaatggcgccagcgccttcagcgcctgcgtttgcggaggcgccgatgattgccctgtggccgcattggttgcgcccgtggtggctgttgctgttgccgctgcttggctggttgctgtggcagttgtggcaccggcaaaagcgcgccgggcgctggcagatgatcctgccgccggccttccatgccgtattgctcagtggtggcaatggtcgcgagagcaaatcaccctgggtggtgctgggtattgcctggctgttggccgtactggcgctgcttggccctagctggcaacgagtggaacagtccagccagaaaccctccgacccgttggtggtactgctggagctgaccccggaaatgctcgccaccgacagcccgcccaaccgcctggagcaggcgcggcgcaagctgtacgacttgctgcaagcgcgcagcgatgcgcaaaccgccatcgttgtgtatgccggcagcgcccacaccctggtgccgctctcggatgacctggccaccagccgcaacctgctcgaagccctgcgcccctcgatcatgcccgagcccggccaccgtgccgacctggcggttgaaaaggccatgggcctgctcaagcaaggcggcctgggccaggggcgcctgctgctggtcggttcctcgctgtcgaaacaggaacgccaaggcatccgcctgcaattgcaaagtgcccaggcaccgcccttgtcgatcctcggcatcggcagccgcgaaggtacgccagtgacccaggaaagcggcgagttcctcaaggacgaccagggcgcgatactggtgccgcgcctcgacagcccgaccctcaaggccttcgccagtgaaatgggcggccgctaccgtgcggcgcgcctggacgacaaggacctgcgccagctcggcctgctcgacagcgcacaagccctgcgcaacgacggccagttgctgcacctggaaacctgggccgaccagggttactggctgctcctgccgctgttgctgctggctgcctgcgccgggcgccgcggctggctgttctgcttgccgttgctgctgttgggcgcgccgcagcccagctatgcctttgaactgcaagacctatggctgcgccccgaccagcaaggccagtacctgctcaagcacaagcgcccggccgaagccgccgaacgcttccaggacccgcaatggcaaggcgtggcgctgtacgaggcgggcaactacgccgaggccattaaacgttttgcccagggcagcgacgcctattcccactacaatcggggcaatgccctggccaaggccggtgaactggaggccgctattgacgcttatgaacaggccctggaagcccagcccgacctgcaaccagcactgaaaaacaaagccctggttgaaacgctgatgcaggcgcaagcgcagcccgaaccggaccagccaacaaaaaacgcagatgacgaaaccgcccaacccggccaaactgcgcaaccgggcgccggcgggcaaacggcccagggtggcgagcagtcgtctcaaggccagggcgaagccggcactgacaaagcccagaccggcgccacgccacagccgagcggtaatgaagtgccgggcagcgaactgggcgacgagcgcaccaccacgccgcccctgcgcccagccgatacccgccttgaaggcgagcgccgccaggccctggagcaatggctgcaggagatcccggacaaccccggcgagctgctgcggcgcaaattctggtacgaacagcaacaacatcaggacacgactcgatgagccgccgcaccacccttctgctcctgcttgcgatgtcggcaggccacgcccaggcggctaacctggtcgccagcgttgaccgcagccgcctcaactccggggaaacggtggagctgacggtggaatccagtgacgtgacccagttcggcaagccggacctgtcgcccctggatgcgcagttcgaagtcagcggcacccgccagatcaaccaactcaccacactgggcggcgataaccacgccaccacacgctggatcatcaccctgctgcccaaggaaaacggcacggtgatcattccgccgctgcaagtcggcgcactcaagacccagccgatcaccctgcaagtggtggaaaccgccagccagaacaccagcgccgaactggccccggtgtttatcgaagccaacctcgaccagaccagcgtgtacgtccaggcccaggcgctattgaccgtgcgcgtataccactcggtatcgctgtatgacgacagcagcctgacgccgttgcagattcccgatgcccgagtcgagcaactgggcgagtcgcgcacctatgaaaaggtcatcaacagcatccgccatggcgtgatcgagacccgctacgccctctacccgcaacacagcggcaccgtgatgattccggcgcagaccttcagcgccacgctggtggagtcgcgcccggcccaggaaaacacgctgcagggcaccaagccgggcaagatgattcacgtcagctccacggccctgcccttgacgatcaagcccaagccggacctctaccccgccgacgcgccttggctgccggcacgcaatctgaccctgagcgaaggctggaaccccacgccggaccatgtacaagtcggcgattcactgacacgcagcctcaccgtcgaggccgaaggcctgtccagcgcgcagttgccagcaatgcccagcactgaagtcaatggcctgcgccgttaccccgatcaaccggtactcggtaaccagaccagcgaccgcggcctgaccggcagccgtgaagaccgcgaagccctggtcccaacccgcgccggcgccctggaactgccgccggttgaagtggtgtggtggaacacccacgaagaccacctggaacgcaccagcctgccggcgcgcaccgtgcaagtggcggttaacccaagcctgatggtggatacacctgccacaccgaccatcatcaccgcacctgacgatgagcgcctatggcagtggcaactgagcacgctgctcctggcctgcaccactctgctgggcttcggtctctggtggcgtgcccgccgacaaccggccgtgcaacgcgccgcgcaaaccggcccaagcccacgcactttgctcgacgacctcaagcgcgccacccaggccaacgacccccatgccacccgccaggctctagacgcctgggcccggcaacagccagagaccctggccgacatggcggcgcggtttgtaccactgtcagatgctctggatggtttgaatggtgcgctgtacagcgaaagcggccagtactggatgggtgacgacctgtggcgtgcaatcaaggccatccccgtggccgagcgcgaccaagacccggctaccgacaccaccagcttgccgccgctttatcctaaataatccaaggcccctgacactactcaaatcaactgtgggagggagcttgcccccgatggcggtgtcagcgaccgctaagctgactgacctctcacatcagatctgggtcacccgcaggcaccccgtgtgcttttacaggtaaactcccctccttttcaccttctccacggagttcgccttgcgtctgttccacacctccgactggcacctgggccaaaacctccacggccaggaacgcgacttcgaacatgcctgcttccttgagtggctgctgggccaactgaacgcccagcgcccggatgtgctgttgatcgccggcgatatcttcgacacggtcaacccgccgctcaaggcccaggagcgtctgtatgacttcatcatcagcgcccacgaacaaaacccgaaactgaccatcgtgatgatcgccggtaaccacgactccggttcgcgtatcgaattgcccgcaccactgatgcgccgcctgcgcacccatgccctgggccgggtgttgtggctggacgacggccaactggatgccgaacgcctgctgatccccttgccggatgccaaaggcaagatcgccgcgtggtgcctggcattgcccttcctgcgcccggcggaagtcaccggtgcacagctgggtgatgactacctgcgcggtatcggccaggtgcatgaatggctgatcgccgccgccaacgccaaacgcaagaaaggccaggcgctgatagccatcagccatgcacatatggctggcggttcggtgtcggaagactccgagcgcagcctgatcatcggtaatgccgaggcgctgccggccagcctgttcgatagaactgttggctatgttgcccttggccatttgcacaagccgcaaaaggtcaatggtgaagagcgtattcgctatagcggttcgccgattccgctgtcgttttccgagatcggctacaagcaccaggtactcgacgtgatgttccagggcgaacggctggtcagcgtcgaaccgctgctgattccacgctcggtcaacctgcaacgcttggaagccgcgcctctggccgagatcctcacgcaactggccgcgctgccggacatcgacctgctggccgaaacccagcgccacccgtggctggaagtgcgcgtgcgccttgacgagccgcaacccgacctgcgccagcaaatcgaaaccgccctgcaaggcaaggccgtgcgcctggtgcgcatcgccgccgaatacgccggccagcgcggcagcaccgaaaccgacgacgagcgcttgatcgaactcgaccagctcacgccccaggaactgttcagccgcgcctggcaggacagctatggcagcgaagtggatgaacagaccttgaaagacttcgccgtgctgctccaggaagtacaacaagcgggtgaacaaccatgaagatccttgccatccgcctgaaaaaccttgcctccctggccggcccgttcgaaatcgactttaccgccgagcccctggccagtgcgggcctgttcgccatcaccgggccgaccggtgccggtaaaagtaccctgctcgatgcattgtgcctggcgctgtttggcgcggtgccgcgcctgggcgataccggccaggcgaagatgccggatgccgacaccgatatctccatcggtgacccgcgcaccctgattcgccgcggtaccggtggtggctacgccgaggtggatttcgtcggcgtcagcggccgtcgctatcgcgcgcgctgggaagccaaccgtgcccgcgacaaggccagcggcaaattgcagaacagccgccaaagcctgatcgacctggacagcgagcaactgctggccagtcagaaaaccgaatacaagacccagctggaactggccctggggctgaacttcgagcagttcacccgtgcggtgttgctggcgcaaagcgagttcagcgcctttctcaaggccaatgacaatgagcgcagcgaactgctggaaaagctcaccgacaccgcgctgtacacccaacttggccgccgtgccttcgacaaggccaaggacgccaaggacgcccacaaacaactgcaagaccaagcaacaggcgtagtgcccctggccgccgaagcccgcgccgagctggatcaacagctggccgacgcccagcaacagctcaagacccggcaagcccagctcaagcaactggagttgcagcacacctggctcaaggagctgcgtgaatggcaggagcgccagctcagcgccgcccaacagctgcagcaagcccagcaacactgggacagccaaggccggcaacgccaggacctgggtcgcctcgaccagctggcgccgcaacgccatcacttcttgcgccaggcagaactagacaccttgctgacgccactggccgcgcagattcagcaacacatcgatcagcaagccgcactgcacgtccgccaggaacagtcccaacaacagcaagtagccgcccacgcggcattggccgacgcgctgaaaaaccaggccgacgccgcgcccttgctgcgccaggccgtggaagaacaaaacaccctcgcccacttgaccagggaactggccaagcgcaccgaggaaaaacagcagctcgcaaacgcctgcactgaaggccaggccctgctcgatggtttgcaagacaagcaggcccaagtcgccgagcgcctgcagcgcctggccaccgagcttgagcacagcgccgccctcgcccccttgagcgaggcctggaacgcctaccgcgaccgcctgcaacagctgatgttggtcggcaatcgcctcaacaaagggcagacagaactgccgcagctagaacagcgtgccaacgccgccgccgtgcagttcacccaacagcgtgaagccctggagctgctctaccaggaagccggtgccgaaccccacgccgtagccgaacagatccagctgctggccggcctgctgcaagacaatcgcaagcaacagcgcgccttcgaagacctggcacgcttgtgggacagccagcaacagctggatcaacaggctgccacgctgacgcagaaactgaccgacgctgcgcaaagacgtgagcagctgaaccaggctggcctgcaaaccaaggccgaactcagtgttgccgagcaagccttgtcggtgaccaaacaactgttggagcgccaacgcctggcccgcagtgccagcgtcgaggaactacgcgggcagttgcaggatgaccaaccctgcccggtatgcggcagtcacgagcatccgtttcaccaacccgaagccctgctgcaaagcctcggtcgccacgatgaaaacgaagaagccacggcacagaaagccgtcgacagcctcaaggaaaaactcaccgagttgcgcggtgaggtcggcggcctgatcgccgaacaaaaggaattcctgcgccaacaggaacagctggctacacagcaacagggcctggcactaagtctgcaagcccattcgctgtccgcttcgctgttcaatcaggacgtcgcccaacgcagcacctggctggtccaacaattggcacagctgacccaaagcatcagccaggacgaacagcgccaaagcgccctgctcaacctgcaacaaaatgccggtcgcttgcagcaacaactgcaagcggcccaggacgccagccagcaagcccggcaattgctgctggaccagcagcgcgaactggccaacgaccgcgaacgcctcgacgcagaactcaacgccttcgccggcctgttgcccgccgacaccctggaaggcttgcgcaacgaccccgcgacgaccttcatgcgcctcgaccaacaggtcagccaacgcctggaacagttgggccatcaacgtgatgaactgaccgagcagcaagagcgccaacaagccatcgagaaacaacagacccaccagcaacaccgtcaacagcaactcgacgccctgaatctgcaggtcaacgagttggcggcgcagcaacaggtgatccaggaaaaactcagcgcgttgttgggtgagcatcccagcgccgaacactggcagcaacagctggagcaaagcgtcgagcagtcacgccaggccgagaacgacgccaaccagcaactgcatagcgtgcacacggccctggtgcaggtggcggcggacctcaaggccctgcaggaacgccagcaagcactgcaagctgagcaacacaacctggccacacgcgtctccgagtggcgcgccctgcaccctgaactggatgacgacggcctgacacgcttgctggccttcgatgaagcacaggtcgcgcaactgcgccagcagttgcacaacagcgaaaaagccgtcgagcaggccaaggtattgctgcaagagcgtgaacagcgcctggccgaacaccaggcattgcacaacggcaacctggactccgcgcaattggacagcaacctggcgatgctgaatcagcaactggccgacggcgagaaacactgcgcggaactgcgcgcacgtcaatctgaagaccagcgccgccaggacgccaaccaggccctcaccgaacagatcaccaaggcttacgaagagtggcaacgctgggcgcgcctgaatgcgctgatcggctcggccaccggcgacaccttccgcaagatcgcccaggcctataacctcgatttgctggtgcaccacgccaacgtacaactgcgtcaactggtgcgccgctaccggcttaaacgcggtggcagcatgctcggcctactggtgatggacaccgagatgggcgacgaactgcgctcggtgcactcgctgtcgggtggcgaaaccttcctggtgtcgttggcgctggccctgggcctggcgtccatggcgtcgagtaccttgaagatcgaatcgctgtttattgacgaaggtttcggcagcctcgaccccgagtcgctgcaattggccatggacgccttggacggcctgcaggcccagggacgcaaggtggcggtgatctcccacgtgcaggaaatgcacgaacgcatcccggtgcagatccaggtcaagcgccagggtaatggcttgagtactttggaggtcaagtgaacgaggcgctgctgtattcgttccggcgctgcccctatgcgatgcgggcgcggttggcgttgcgttattcaggcgtggcggtgcgcattgtcgaagtcagcctgaaagccaagccggccgagatgctgacgctgtcgcccaagggtacggtgccggtgttgagcgtggagggtcgagtgctcgaagaaagcctggacatcatgcaatgggccctggcacagcacgatcctgatgattggctgctcgagggcaaacctgaggtattggcgctgatagccgagaatgatcaggtgttcaaacatcacttgaatcgatacaagtatgccgagcgctacccggagcagccgatggagcattatcgcgccgagggtgaagtgttcttgcagaagctggaggatttgctgacgaaccgggagtacttgctcgccgagcacatgagtctggcggacgcggccgtagtgccgttcgtgcggcagttcgctcatgtggaccgggcatggtttgcgggggcgccgtatcgacggcttcaggcgtggctgcagcggatcctggagtcaccactgtttatcgcagtaatggcaaaatcttgaaaccaacacaatcaaactgtgggagggggcttgccccctcccacagtttgatcttcattaagcctgggtcttatgatccagcgccgcgtagaagttggcgctctgttgcaggtatttctgggtataggcggtaacgctggattttttgccggtgacttccacgctggcagcggctggcaatgctacggtggcggagacagcggaagcggcgatgatggagaagagattcaagttcatggcggtaacccttgtgttcgtttggttgagtggccggtggaggccttggaactcaacttacgcccgagggttggaccttagaaatgctttgaaacagtagctgctatcaatgcaattaatacaaaggctcaggccccgcaatgcggggcctgtggcttattgacgcaccaggaacttgaggtcgctgggcgcatcgatcggcaacttctgcacggttttacccagcaggccggtcttggggtcgcgttctatcaccacgatttcattgcttttctggttagcggtcagcaggaacttgccgctggggtccaggctgaactcgcgtgggtgatcaccttcgacggagcggcgctggacttccttgaggtgcgcggtggccggatcgatgctgaacaccagcaactgattggccgtgccacggttgcttacatagaggaacttgccatcgcttgaagcatgcaacgcagcaccggccttgtcggataccggttggccggcggcatagtccagcaactgggtttgcgtgagcttgccgtcgttgtagtcgaacacggcgacctgggcgctcatttcggtggtcagccaggcgtgcttgccgtcagcgctgaacagcaagtggcgcgggccgctgcccggcggcaactgtaccgaaggcgggttggccggggtcagcggcagctcgtggttggccttggggtcgtattggtagacaaacaccttgtccgcccccaggtcctgcacgaatacatacttgccatccggcgacgacaccaccgaatgcacatggttggaggcctggcgctcagggttcacccggctggccgggtgcccgctcaactgcaccggggccgacagcttgccctcgccgtctaccggcaggatcgccaggctgccgcccgggtcttccagcaccgaataattggcgacgaacaggtggcggccatcggcggcgacgctggaatgggtcggctcattgcccaggctctgaacctggttgatcagggtgagctgatagttctttgggtcgatgcggtagctgctgacacggccgaccgggtctttctggcccgggccgttctcgttgaccacaaacaggtacttctggtcctgggaaaccgtcagccacgaggggttggccgtcttggccgccagtacgggctggccgctgaactggccggtgcggctgtcaaactgcaggcggtagatcccttcgctggtaccggcggtgtagctgcccaccagcagttcataggtgtcagccggcgcagcctgcaccgacatggctccgacgctgcccgccatcaacaggggccagaatttacgcatcaacatcagcttcatcctcatcgttattgttgccggtgaaggcgctcatgcagatcaggcggtgctcgcccgaatcaccggtcagggtccagctttgcagggtgtcgtcaaacgtggccgcctgcacctgggccgagctgaatgcccagcgcttttctgcacggccgtccatggcggtgatcagcagcttttcgtctttgagttcgaagtcaaaggcatgcaggccatcgatttcaagcatgtcgctggtggcaaggacggtggtcagggtgtcggcagtcatggtagtcaatcatctacgggaaagccccgatgatagcgcagggcagcgcgtgcggtcctgctttgccgcgcacgccggttacaaatacgaggaaatacaccgggcggctccagggaacacggggcttgggcacgctccggcaatagctcctaacgcaatgccgatttcgcccgtctgccaacgcgatatttttcttgctcgatttccatcccagcaaaggaattgcgccatgcaatcgatcagaaacaaccctcgcgtatttactgccacactacccgccgaacctgcgccgccaccgcttgagccaaaggtcgaccagccatcactcagcgatgcgcagccccgacgctcgaacttgccgacacccgtacgcatgccctctaccctccagagcaggctcagtgaaatgccagcgccagcggccaactcacccgccgaggtgatcgccaaccagttcgccagccggccaacggtgcgttcagtggtcgcgggcatgctggacgaggccctcaagcgccattacccgacgctgcacttcgacagcgccaatacttccctggcgacccgcctgccgaccgattcggtacagtacaaactgacgccactgctggacctggccctcgaacacctggcaaccggcagcgacctgggcttcacagcgcagagtcaatgggtcgaatcccactccgccaatcccctgagcgtcgtcgatgccagcaaccgtagcgagcccctggatacgcgcattgtcgaactggccatccgtagcctgcgacccaatcttgtggacgcctacgcgcaggccctgacccggttctggggccaggacacccccagcgccaccagccactggctctggctcagcgacagtctcaatgacaccgtacgcgtggcaggcttgcagcaaccgggcctgagcgcagtgcagcgcgagaccctcgatcaggtcgtacgttatcccgatatcacgcagcgccgtcgggtgatcggcgccgatgcggcgcaagtcttcatggtgcagaccaccttgaaacaggcagccaccaccgccacccttctgagccccgaccttctgatcacgcgccaggttggcgaccagaagctgatactgcaggtgacgcccgcgggggtggtgacgccccatgcctcaatggaggatttcgccgcatccctgtcaaaacggctcgaagggcaacgcagtttcgatcatctgtcctggaagcgcatggagccagacggcaatattttcgacacccaggccgctatgatcctcaaccgccaattgaacaacctgcaggccataaacctaccggcgagtatgcaggtgggcgaccttgagcagctgttttcccaggccaccgacacggctgagctgttcaatagccagccgagcacaacgccaggacggctggcgcagatgaagcgcaacctgcccgcatggctcaacaacgccagcgccgccgagcagcttgctttccagcgcaacaccctcgccctggccagcagcgtagcgcgtcaccaggggcgcacctttctcagcgatattcccgatatccgcacctataccgaacaacagctcaacgcccaactggcgtccatgggctatagcgcaggcgacctggaggtcaccttcaaggtggccgtgggcaccctggccggcggctacatcgagccgatcaagatgagcctggtggacatggccctggctaacctcgccggcctgccaaaaggcagcatggatatccgcctgcgcgggcagccggtgaccgacccccagatgccgcagaggctcaaggacctgatcagcacggtcaatatcggcgagcactaccccgccctgctgaaccagcgcctgctcagcgacacagccgacgcccgggaacgcaccgcattatttgtcgagcaggtaccgctgcaactgaacatgcaggcccaggaactcaagctcaaaggcctggccggcatcaccgcgcaaggctgccgctttgtcgaggccgtgactcggcctggcaccggcgcgcgcagggtcgacgaccaggagataactgtgcgccccctggcgttcctgcgcaaacctggcgcgacaccggatgaggtggccaatatgttcctgatcgagccgctggactccgcacgcggcccgcatctgctctatcgcccgatgctttcgccggcgctactcgagttcgccagccgtgacgcgctgttggccgccatccaggcaccgggtgagttgcaacagagtgtcctggcctggctgcccgatgacaaagcccgtgcggtgtacggcaatggcggcttcaagacgccccatgtcgcccactacagcgtgttcaacgagttcgacgccccagcaacgcctgcgccgaccgcattggccctcgacgactttgctgcagcccgcacgctcagaagcgacctgctcgacggcgacctgatgcaacacctgtacaacagcaatgcccgaagcctggtgacccttgcccaaggccagtccacctcggatgcccaaagccgctgggcgctgcacaaggaactcggctggctgctgttcaataccttgcttccagtactgcgcggcccaggagccatggccggctggctgctgcaactggccagtgtcgaaaacgacatcaagcacgccactgagtcgacgcatgcagacaccacgcaagcgatggtggacctgctggtgaatgtcgccaccttgttgagtcacgctacgccgagcgaggccaccgcacggcccttgggcaaggtgccctttatggagcgtgcgcaagtgtcgatcccgctgcggcgcactgccgagacggcgccgcccacccaggtgctgatcgaagaagacgcgcctgcgcccagcgggctgctcgacagccaccagccgttcgactttgccttctccaacctacggggcctgagccctgcccagcgcgcctatatcaacaccttcagcgttccggcaccggccggcgaggtcacaccgattcaaaccgggagaaccgaaggtctctaccttatcgacgacaaactgcatgcccatatcgataaccactggttccgggtggcccgggatctcgacggcgtttttgtgatagacgagcacgacaagacgcgtaccggcccgcctttgaggcgcgatgcccaggcccattggcaattggatatagctccccggctcaagggcggaatgcccatcagtgaacgggtgcaagccgccctcgaagagaacttcaaccagagtgaagtcatgctcaacaacttcgcggcccatcgccagcgtgtgctgccgatggaagtgctcatgatgggtgcccgggagcgcctccagcaaaccgaggagagcctgaaaaagtcggacaagaccctcaagacgctctggggcctggtcaacagcggagagcgcggcgctgatttcgccgagcgctaccagcaggagctgagcaataaccataacctgacagcattactgcgcaagcgcctggatgactatcaacgttacgccagcttcgccattaagggtcgcaaagacgcgatccaggcggtaagcagcgataacccggccatggacctggaggtgttcaaggatgtacggggtggcgagtaccgggcaatcgccgaaaccctgcgctcgatctacgtcgaccacttgtacgacgccaatgagtttacccatgccccctcgggggagccgatgtccagcctggctgaaaaggtccgcgccaatcagcccgaggcctatgcccaaatggtcgaagccatgagcctgcgcgagatgcgcctgacccgcctgataagggccggggacgcctatgaggcactgctcgatgaatggaaaagcgactcgcccgccaacaagaaacaggccgaaatctttatcaggagcacccaccaaccaccagccaacttggtactgacaagtcggctggagcaactgagcacactgcgtgagttgagcatcgaccgtatggtccctactaacgcccccgagaaaaggttcttccttgatcgcttcaaccgtgccgagctcaacgcggtgtccatgtcccatatcgagttgcagcagcacgagggctataccgccgacgaacgtatcgcggtactcagtgaactgatcgataaatacaaggccgagctgagcaacactcaagccctccaggacatcagccccgaaagcgtccgtccggtttatggcgcgtactttattgaatccctgcaaaaagtcatcacccaggcccaggccgaactggccgacctgatccgtgaagaacaacacctgccacctttgatgcttcgtcgggaggagcgggcgcgcaagtcggcaaacaaacgggtgttcaagacccgagacaagcaaaccctggtcggcacactacgcaccaggcaacccggggaaacggttccgatcattgatgtcctcgatccccagagcggccaggcactgaaaacctacagctggcatcaggccgacggcgaatgggtgacggtggacaagccaaaagcagtcaaacccaaaccggtgcccgcgacaaaacccttatcggcctatgtcgattcggcccgccaattaatgagcgaacagctgagtatcgaacgctcgattcaattccagaaaaggaagcttgatgacccgactcaacgggaatccgtcaacccccaggactggagcgacatgctcgaagcccaggcggatagccttgagcaagtggcacgggaagcgcaggccaaccacaaggccgataggcgaaccgcaaccctggtggagcaatggcagaatgcagtggcacacatgcgcgagcaggccattgcccacaggtgcgatggctacctgcgccaggcgccacggccggaaaatatcgattacctgtggacccatggccgcgttgatatcggtgtagtcaagcgctataaacccctcaagggcggcgattttctcaccgagtacgcgatacgcgacaaaaacggactcaaggacttgtggtatgcgcactttcactacaccaaggccaactcacccgttgccgaccacagcgctgcgcatttgaagattccggagcagcgctacctgacgcaaaaggacctggtgcgccaggccggccaggataactcttcaatcgaagaaatcgtgcatacccggatcaacccacccctggatcagaaactgttcttgaagctataaccctggcgctgcaggagcgagcttgctcgctcctgcaggacgccccttgaaggggctcagtgagcaaacaacgaattgcccttctgccccgccagcttctcgggcttgatcaggaaccgcgccagggccggcaacagccacagcgcgccgaacatgttccacagcaacatgaaggtcagcatcaggcccatgtcggcctggaacttgatagccgagaagatccaggtgcacacgccaatggccaggcacaggccggtgaacagcacggccttgccggtggatttcagcgtctggtagtacgcctcttgcagcggcaggccggcacgcaggaagctttccaggcggctgtagatgtagatgccgtagtccacgccaatccccacgcccagggccactaccggcaaggtcgcaaccttgacgccgatacccatgaacgccatcagcgcgttacccagtaccgaggtcaataccagcggcagcacgatgcacagggtcgccgcccaggagcggaaggtgatcatgcacatggtcgccacgcacaggtacaccaggatcaggatgatcaactccgattccttgatcacctcgttggtagccgcttcaatcccggcattgccggcggcgagaatgaattccaggccgtccttgttgttctccttggcgaagtcctgcacggcatgcacggcgcggtcaagggtctcggccttgtggtcgttgaggaacaccagcaccggcgccagggagcaattgttgttgtacaggccatcggcacgggcgatggagttattgagcacgtccgggttacgcgacagggtttcccatttcaggttgccttcgttcatgcccttgatcatctgcttggatacggtcaccagcgaaatcgccgactgcacgccctcggtgttctgcatcttccacatcaactggtcgataggcgccatggcttcgtagcgcgagcagccttcggctcgggtcttgaccatcaccaccagcacatcggaactggtggaataattgctgatgatgaagttgttgtctttgttgtagcgcgagtccgggcgcagttccggggcgccttggtcaaggtcgccgatcttcaggttctggctgtaccagaggccgccgccaaaggcgatcagcgccaggaaaatcgagaccggcgcgactttcgggctggcgaatttggacagcaaccgccagaaacggtgttcgcggtgcgcatcctttttactgcgctcaatcgcgcgcttgctgatacccacataggagatcgccaccggcagcaggatcaggttggtaaacacgatcactgccacaccgatggaagcaccgatggccagttcgcggatcacgccgatatcgatgatcagcagcgtgataaaacccaccgcgtcggcgaggatcgcgatcatccccggcaagaacaactggcggaaggtacgtcgtgcggcggtcagggcgttatcggcatcactcgattgcagggcgataccgttgatcttctgcacgccgtgggaaataccaatggcgaatatcaggaacggcaccagcatcgagtacgggtccaggccgaagccgaccgcgtgcatcaagcccaactgccacaccaccgccaccagggtggtaatcaacacggcgatggtgctgcggatgcaccaagtgaaccagtagagcaacaccagggtgatcatgaaggcaatgccgaagaacagcaccaccatgatcaggccatcgatcaggtcgccgactttcttggcgaaaccgacgatgtggattttcacattagggttttgcgcctcgaacttgttgcggatcttgtcctcaagttcatgggaaaacttctggtagtccagggccagcaacttgccctggtcctgcgggtccgggtaggactccagcagcgggatatcgacgatactcgacttgaaatcgttggccaccagacgcccgacctggccggacttgagcacgttgttacgcagctggtcgaggctttgcggcgagccgttgtagctctgcgggatgacttcgccaccggcaaagccttcttcggttacttcggtccagcgtacgctggggctccacaatgatttgaggcccgagcgatcgacgccggagatgtagaacacctcgtcgttgatctgccgcagggtctccatgtactccttcgtgaagatgtcgccgtccttggcctccaccgagatacgcacggtattgcccaggttggccaggtcgttgcggtgctccatcatcttttcgatgaagggatgcttgagggggatcatcttttcaaagctggtggacgggcgaatcaaggtcgcctgccagaacaggaacacgctcaccagcaggcagatgacgatcaccgccgggcgattgttgaagatcaggcgctcaagaaaggtcgctttatcgttgtgatgactgctcatgctttccccgcccttattattgttttacgagttcggcgccagcgggcgtggcgacacgaacgccgccctgcccgaccagaatcaggttgccattgcctgcggccgtgaccgccgagagtgaaatccggtccggacgattgaatacgctgaacgtctggccgtcgtcatgactgaccaccacgctgccaccgttgccgacgacgacaatggagccatcatcgagcaacgtcgccccagacaagccgaactccaacgcaccgcgtgtggcattgagttcgacctgatcccagttgctgccaaaatcggtggagcgatacaggttgccgcgcaaaccataggccagcagggtttgcggttgcgccgtgctgatcacgccaaacagcgagccttcataggggccttcgagtttttcccaggtctggccgtcgtcgctggagcggaacatgctgccttgctcgccgacgataaacaggccggcgtccttgaccgaggcgatggcgttgaggtggaactggtcttcgttatcgagacggtcgctcacgtcgttccaggacgtgccgccgtcggtggtttcgatcagcgcaccataggcacccacggcgaggccatggttggcatcgttgaaccacacatcgagcaacggggcttcgcgcttgaggtcttgatattgctgggtccaggtagcaccgccatcggcactggcaaagatttgcgcgtcatggccgacagcccaaccgtgcttgtcatcgacgaaaaacaccgccgtgagcagttgccgggtaggtaccttggcttgggtccaggtgttgccctggtcatcggaatagaggatatgcccgcgatcaccgaccgccaccaagcgcttgcctgcgtggactacatcaatcatcaggcctttggcagccttgggcgattcaatcgcaaacaccgcggcggcggtggaatcgctggcagccagtaccggcgtcgacaacacggcaccggcaaacagcgagagcgctgtggccagcaacgcaaccctgcgtgcggcgcgtgggcggcaaacaacccaacccatgacaggctcactcatagacctttctcccatttattattgttaggtcgtctcatcttccagggccgtgaaacctgcaatctagagcgcctggagtaagcaggggccatcctatcgggctttggaatcgtctgacaatcggtgctgcgttatcttttgttaactggcggcatttggccaggggtgaatatggctttatcagcagaaatgatgagcccaaggcgcgtggccctcttgctgacgagcaatgaatttttattccacctattgaattaaacgaatatttattccattaatagccttcctgaaaacaataatccaaaggaccacggctatgcgtgaactcggaatcggcttgatcggcacaggcttcatgggccgcgcccacgcgctggcgttcaataacgcgcgggcggtgtttgaactaccggtacagctcaagctggcggctctggccgatgccgacaccgaacgcgcccagcgttgcgctgacgcctggggctttggccaggcccacggcgactggcaagcactgatcgacgaccccaaggtcgacgtcgtggccatcaccactcccaaccatttgcactatcccatggcgatggcggccatcgcgtcgggcaaggcggtgtattgcgagaaacccctggccgtcagccttgagcaagccgacgccatgcgccgcgccgccagtgccgccggggtagtgacacgggtgggctacaactaccagcacaacccgatgatcgtgctggcaaagcaaatgattgccaacggcgacctcggcgaaatcatcagcttccagggtgaattcagcgaagacttcatggccgacccggtttcaccctggtcatggcgctgtgaggtcgaacacgccggtggcgcgctggccgatctgggcagccatctgctgtcgatggcgcgctatctggtcggcgatgtggtcagtgtgtgcgccgatacccagaccgtgcatgcccagcgccccgccacggccggcagccaaacgtcaaaaaccattgccgtggatgaccaggtgcacgccctgctgcgctttgccaacggtgcccgcggcacggtaagtagcagctggctcaagcacggctacaagaatcacctgagttttgagatcagcgggacccagggcaccttggcgttcgaccaggaacgcttgaatgaactgcgcctgtaccgtatcggccaggacggtttccagcgcgtactggcaggcccggccctgcccggttatgcggcgttcagccccgccgcggggcatcaactgggctacaacgaattgaagaccctggaggtgcacgagttgatcatgaccatggccggccagggtgcggatggaacagacttcgaagcggcgtgggcagtcgagcggctggcgacggcgattcgtacggcggctcgtgaagaacgctgggtcaaggtcagcgagctgtagagcacgctgatctgccggttaaacgccgcccttgcctacagggtcggcgtgcactgtcctgcctatccatcagtgcgttcacgcggatggagcgctgaccatcattcaactcaagtaaaaacctgtttgatcgcacttacatccgtaacttttcccaacttcaaatagctgtatcccccctcaaaaaaacacacttcatacgctgccagcgcacacacacccgccttgaaaaaactccccatatttaatcaaacatcgacataaataccccctagccttctttaaagaaacacgccaccttaaaccgcgttcgacactcaaacacctcttgcgtactcatacaaacccaaacacctgcgagacataaacatgcttagtaccggaactcacatgccgatgcacctgcaccgacaaatccaacctcctactggcgacacttcactgcaagcctcgtcctctttatcagacaaagtcgcccagcaactgacccgcgacaacttcaaattaaaggacagggatggcgatggccaactatccgtttcttacaagttcttcgacgccgcagatccgcaaacagcctggctcaagggcggtggtgcgcttgagttcagccaggccagaaagaaagcgttcaggagcgcaatcaaggcttgggaagacgtggtcaaggtcaagttcaccgaaaacgccaggcatgcagatgcattttttgtacttcatgccaacaatggggtcggtgggtatgcagtcatgccaaatgaccaaggaacagcaaatataggcatcggcgttggcaacaagaactctccccctcattcgtcgatgattcatgaacttggtcatagcctggggttacaacatccaaaccagaactatcccgaaaacagccacacgcatacggccatgagttacaacaataaatggtggcgcccggccgacgagcgcggcgtaagtgtttcggatagcaacttgacaccggccatgcacgatatcgcagccattcatcgcttatacgaacccaattacgaaactcgaaaaggagatacaacttatggtttcaactccaacactgagcgtgaccactattcgttgacttccgccgacgagttgaccaacttttgtgtctgggacggcggcggcgaagacacattggatttttccggcttcaggcagaatcaaaagatcaacctgggcgccgagacactctcggatgtgggtggccgcgtgggcaacgtatccatcgccaagggcgttgtcatggaaaatgccatcggtggatccgggcacgatgtgttgattggcaaccagatcaacaaccgcatgacgggaggggcaggcggcgacacgctgaccggcggcggaggcgcagatacccttgtctataaccgggccagcgactcaccggctaaaaacccggatacgctcacggacttcacaagcggtatcgacaagatcgatctatctgggctattgaaagaggcgggcctccagtctctccaactcgttgaacaacacatggggcgcaaaggtgaactgaccctggactacgatgcaaacatcaagctgtacaggctgattctgaatgtgaatggcgaccctgcatccgcgctggtgatcctgagcaaaggccccataaaacttgaagatatccttactggagccacacctgacacgcccgttacgccagatgtgccggttacaccagtcgtgccacctcagccagagccagaacctacgcccactccggtccccaagccaacccctgctccgcggccccctgtcacacctccactttcagactgcgaaacggctgacaccgtctacggcttcaacgccaataccggccagcgtggaacgagcctctcgtcggtcacagacaaaccgtctttcagcgtgcatgaccaaaagggcaatgacaccctggacttttccggtttcacgcaagcccagcgaatcaacctggcgccgaattcgcgctccagcgtcggtggcttgactgacaatgtgtacatcacacccgacaccctcatcgaaaatgccgtcggcggccagggcaacgaccgtattgccggcaacagcggcgataacgtgttgaccggcgggggcggagccgaccacctgactggtaatggtggcttcaacacgttcacctaccatgccgccagcgactccacgcgcaacaacccggacttgctcatggacttcaccacaggccaagacaagatcgacttgagtagcctgagtaaaaacacacaggtcacgctcaaccacgtcagtcaatacagcgggcgaccgggcgataccctcctgaccttcaacccgaacacccaacggtacttcctcgccattgatctgacgggtgatcgcaagactgactttctgatcaaaagcactcggccgatctacagcgaggacgtcattggtctgaacattcaggatgatggttatctctgaccgttgctgacaaggtccacggtgtcagcgcaatgcccgtcgcagtaccttgccgacggtagtcttgggcaactcggtactgcgaaactccacataccgcggcatcttgtagcccgtcaggtactcccgacagtgcgcaaggatctgctcctgggtcaggttcgggtccttgcgcaccacgatgatcttgaccttttccccgctcaccgcatcttccacgccaatggccgccacctcactcacgcccgggtgcatcgccaccacgtcttcgatttcattggggtacacgttgaaacccgagaccaggatcatgtccttcttacggtccaccaggcggatatagccgcgggcgtccatcaccccgatatcaccggtggacagccagccctcggcgtccagcacctcggcggtttccttcgggcgctgccagtagccctgcatcacttgcgggccgcgtacttgcagttcgccttgctcgccgatatccgccagctcgccatcttcgcgaacaaagcgcacccaggtcgatggcagcggcacaccaatgctgccggtgaattccatctcgcgcatgcgtgaaatatcgatggggctgatgctcaccaccggcgaacattcggtcagcccgtaaccttcgacaatcggtagcccggtgacttctttccagcgcttggccacggcggtgtgggtggccatgccaccggcgatcaccaggcgcaggtcagaaaagtccctagcgcagaagtccttgttctccagcaagccgttgaacaacgtgttgaccccggcaatcccgttgaagcgctctttgcgcaggatcatctgcacgcgcttcacgtcccgcgggttggcgatcaggatattgcgcccgcccaggcacatgaacatcaggcagttcaccgtcagggaaaagatgtgatacagcggcagcagggtcacgttggtttcctgcttgtgctggtccagttggtcgccgacccaggccttggcttgcaatagattggcgatgatattgcgatggctgagcatcacccccttggcatcgccggtggtgccgccggtgtactgcaggaaggccagttcgtcgcggtccaggctgaccggtagatgggtctgcgccctgccctgtttcatcacttgattgaaacgcagcgcaccgggcaacttgaaggctggcacctgtttctgtacacggcgcaggatgaagttcatcgccgcacccttaaaggcgcccagcaagtcgccaatagccgcgaccaccacacgcttgacgctgctgcctgccatggctttttccagggtatgggcgaaattctcgaagatcaccacggtctcggcgccgctgtccttgagcagatgcttgagttcatgggcggtgtacaacgggttgacgttgaccaccactgccccggccaggatcgtacccaacaggcagatcgggtactgcaagcagttgggcatcatcagcgccacgcggtcgcccttcttcacaccctggccctgcagccaggccgcaaacgcaatgccctggacctgccagtcggcgtaagtcatttcggtgccgatgctgacgtaggccacccgctcgcggaatttttccaggtgttccaggaacacttcgcgcaatgacgggtaatcttcgatcccggcatcgatgtcggccggaacgccgggcaggtaagcgttcaaccagatgcgttcgctgtgttccaggctgatagcgttcatgacagtgtccttattgttgtttttgacagcgttacttttcgacgatggcggtgatgcccaacccgcccgctgcacagatcgagatcaggccgcgacccccaccgcgttcatggatcgccttggccagcgccgccagttgtcggccgccggtggccgcgaagggatggccgcaacccagggagccgccgttgacgttcatcttgctgcggtcgatggcgcccaggggcgcgtccaagcccaggcgctcgcggcaatattgggggtcttcccaggccttgagcgtacacagcacctgggcggcaaaggcttcgtggatctcgaacaaatcaaagtcggcaaaactcaagccctcgcgctggagcatgcgtggtacggcgtaagcgggcgccatcagcaggccctcggtgccgtcgacaaaattcaccgccgccgtctcacccgtgcgcaaataagccagcaccggccagccgttggcgttcgcccattcttcactggcgagcagcaccaccgaggcgccgtcggtcagcggcgtggagttgccggcggtgagcgtgccgttgtgccggtcgaatgcgggcgacaggcccgcgagtttttccaggctgatatcggcacgcaggttgttgtcccgggccaggccgcgatgggggctgatcaggtcgtcgaaaaaaccgcgcttatacgccgcatccaggcgctggtggctggtgagggtcagctcgtcctgggccaggcgtttgatttgccagcgcttggccatttcctcgcagtgctcgcccatagacagcccggtgcgcggctcgccattgcgcggcaataatggtttgaagaacatcgatggacgcactttcagcaaggtcttgagcttgtcgcccatgcccttggcccgattggcggcgagcaaggtgtggcgcaaggcttcgttgataccgatgggcgcatcggaggtggtgtcggccccaccggcaatcccgacttcgatctggccgagggcgattttattcgccaccaacagcgcggcttcaagcccggtgccacaggcttgttgcacatcataggccggggtctgcggcgacagcgtggtggacaacaacgactcacgggccaggttgaaatcccgcgaatgcttgaccaccgccccggcggcaaactcgcccaggcgctggccgtgcaggttgtagcggtctaccaggccttgcagggcagcgaccaacagatcctggttgctgtcgtgggcgtacaccgtgttggagcgggcaaacgggatgcggttgccgccgatgatcgccacgcggcgggtcggggccggattgaagctgtagtcactcatgcctggctctctttccaaatgaatagcccaagcatatggggcttgtccccagcaaaattgcgcacttcgaactcacgccgcgggccggtcaccgggtggttccacagggcgacctggccgggcaggaagatcggcaacttgaagtcgcaatgggcctgggcctggtccaggccaccgggtggttgttgcgccgccaatgcccgccccagggtccacatgccatgggcgatggcacgccggaaaccgaagagcctggcgccgatgaccgaggtgtgaatcgggttgaaatcccccgagaccttggcaaagcgtcgccccaggtcagccggcaacacccagcgttgggtacgcaacaaaccctcttcctgcagcggcaaagggtcactccaggggtcgcccacggggtcgtcgacgtcacgacgcaggtacaggctgtcgctttcccacaccagggcgtcagcaccgtaggcgcgggtggcgatactcagcgcctgcccctttggatgggcgacccaacgctcgcaatacacttccaggcgcagcgcctggccctcgtgcaggcgttggtgctggcgaatgcgattggccaggtgcaccatgccgctggccgggtacgggaagcttggctgggtcagcagcatcaaatgcagtgggaatgccaacacatgggggtaggacagtggcacgccctgttcacgccgaaagccacaggctcgggcgtaagcggcgatgcctgtgggcgacagctccaccgccgagcgcacaagtcgcgccgtaggcaacggcggcgcgccgtcgagcttgggcttgcgcaaggcgcgcatgccatcgagcaacaactgggtgcgcgagggcgctgggtcgataatctgcgtgacgtaatccatcgactcaggctcccaacaggctttggccacacacccgcaccacctggccattgaccccgcccgacgcgggatgggccagccaggcgatagtctcggccacgtcaataggctgcccgccctgggacaacgagttcatgcgtcgccccgcttcgcggatcatcagcgggatttttgcggtcatctgggtttcgataaagccgggggctaccgcattcactgtgacctggcgagccgccgcacgcggcgccagcccctgcaccaggccgatcaccccggccttggaggtggcatagttgctttgcccgaggttgccggcgataccggaaatcgacgacacgcacacgatgcgcccacccgggttcaaaccctggctgtccagcaaggcctcactgagctgcaacggcgcctcaagattgactgccaagacactgcgccaagcggcttcggtcatcttggcgatggtcttgtcgcgggtgattccggcgttgtgaaccaccacatcgaaggcgccgtattggctgacgtgggcttgcaacagcgcggcggtgtcagtggcggtaatgtccaggggcaaggccgagccactgacactggcggcggcctgctgcaacgcatcctgggcctggggcacatccacgcacaccacatgggcgccgtcccgcgccagcacctgggcgatggccaggccgatgccccgggaggcgccggtgaccaaggcacgtcgaccggcgaagggcttgtcccaattgacggcagtgttgccatcgaccggtgtttgcaggcgcaccacctgccccgatacataggccgaacggcgcgacaggaagaagcgcaggctgctgtccaaagcctcttctgcatccggcgcaacatagagcaactgcacggtgatcgcccgacgcagttccttggccagcgagcgcaccaaaccttcgagggcgcgctgggcgatggcctggggcaaatcctggcagtgttccggtgcagtgccgagcaccactacccggccatgttggccgaggcgcttggcgttggcatggaagaacaggtagagctcgtccagctgctgcagatcggcaatgtcactggcatcgaacaccgcgccttgcaccttgacggtggacggcgccgtgagggtcgccggggtggcggcaacagtgtcggtggcgctgaagatgcgctgcaccgatgccaccagacgccctgccccggcgatgatcaccgggttggccaggccggcctggccactgcgatggcgttgcagcggcaaaggctgcggcaggccgacagcctgggccaggcgacggccccagggggaattgacgaatgaaaggtagttgtcactcatagagggttccactcacaacacaaatcctgccttgtaaacccggtcaaacatgtgggagggggcttgcccccgatggcggtctatcaggtaaatctgcttgggctgacacaccgctatcgggggcaagccccctcccacatttgcaccgcgtttttcttagttgaccggggcgttttcgctttgattgctgcgacgcttggcggtcggctccaacgcctgcttacgctgctgcaaggcctccaacaaaccaaaatcctgggggaagtcatcgacctgaatgccgtggtcggcgtactccacatagcgcgccagcaaggtgtcttcgtcatcgctgatcaagtccagtgcccgcgccttgacgcgccagacggtgaaagccatggccgatatcggcagcggctcgagcaggccttgcttgatggcgggcttgagccgagcctcgatcaactccacttggggcaacagacggaaacccagttcgccataggccagcttgtcgatttccgggcgcgggatgtaggaattggccagcaaacgatcgcgggtttcccctggggtctgcaccacatccgccacctgggccaacagccgatccgagggtttgcgcagtggaatgcccagcggaaagctcaagccccgcatcaccgccgcagcgggttttgaagggtagttatcgagcacttcggccaaggcttcatgggcacgcagcaatgcgtcctgggccgcccaatgcaccagcggcaagtcggcctggggctggccatcgtcctcgaaacgtttgagcacgcaggacaggatgtacagctgcgagaggatatctcccaggcgcccggtgatactttccttacgcttgagggcaccgcccaacacgcccatggaaatgtccgagatcaacgccagcaccaccgacagccgattggcctgacggtagtaggacgccagcgccgggtcggtcttggccggtgccgaaatcagccgcccgccggtcagggcatgcaccgctgcgcgcacggtgttggccagtacaaaactcacatggccgaacatcgcgctgtcgaaatcttcaagcgccttgcgccgatccgggttgcgcgccgcttccatctcgcgaaacacgtagggatggcaacgaatcaggccctggccaaagatgatcaggcagcgggtcatgatgttggcgccttccaccgtgatggcgatggggctttgctggtaggcacgggcaaggaagttattgggccccatgcagatgcctttgccggcgacgatatccataccgtcgttgacgatgatccgcgcacgctcagtgacgtggtacttggcgatggccgagatcaccgacggtttctcgccggcgtccagggacgccaccgacaccttgcgcaccgcatcgcaggcatacaaatgcccggccatgcgcgccaagggtgcctgcaccccttcgaacttgccgatgggcaagccgaactgcttgcgcatcgccgcataggctgtggtaccacgcaccgcgactttacccaggccgacgttggccgatggcagggaaatcgcccgtcccgccgccaggcattccatcaacatgcgccagccgttgccaatttgctcgcggccgccgatcacccattccaacggaatgaaaacatccttgccggtggtaggaccgttctggaacaccgcgttcaacggccagtggcggcgaccgctgttcacacctgggtgggacgtggggatcagcgcgcaggtaatgcccagtgaaccgggcgcgccgagcaaaccgtccgggtcttcggcgcggaacgccaggcccagcaccgtggcaatcgggccaagggtgatgtagcgcttgtcccaggtcactttgaaccccagcacttgctcgccttcgtgcaagcctttgcagacgatgcccaggtctgggatcgcgcccgcatcggagccggcatacgggctggtcagggcaaaacaaggaatgtcttcgccccgggccaggcgcggcaggtagtaattgcgctgggcgtcggtgccgtaatgcagcaacagctccgccgggcccagggagttgggcaccatcaccgaaatcgccgccgccgagcagcgggtcgacagcttcatcaccacctgggagtgggcgtagtgggagaaacctttaccgccgtactgcttggggatgatcatgccaaggaacccggcatccttagtgtactgccagcattcgggggacatatcttgccagacctgggtggtttcccagtcattggcgatgtcgcacaggttttccacctcgttgtcgaggaaggcttgctcctcggcactcaggctggccggcgcggcttgcagcaggcgctgccagttaggcttgccgctgaacagctcggcatcccaccacacggtgccggactcgatggccgcacgctcggtatcagacatcgccggcatgatcgtacgaaacaggcccagggccttgctggtcagcagggcgcggcgcaggggcttgatcgccagcaccaaggccggcagcaccaccagcacggcggcgacggcaaggcccaggtcgcccaccgcgttgaacagataaccaaacgccagccagatgatgccggtgcccaaccacagcgcagctgcggcttgtcgatacgccagggcaatcgctgctgcgagacccaccgataaccagataagcatggggatacctctacttgattcagggcgtaaagccacactacaaacttcaaatcacaaattcaaattttgttttgaaatttttatttaacgctttgccgaaaaaattcaggctgaccgtgtcagcctgataaagagcaaacaacgcaggtcgcgaacgaccgtctcggcaaggcgttcagtagcgctgaaggccttagaacttataagtcgccgacaggctgaccacgtcacctgaagattcagccttgccgtccagttgagccgcaccgagacgatcgacgttcttggttttcaggttgaccttctggacgaattggtgcgaatacgcggcatccactgacaaaccaggcacagccttgatgtcataaccggcaccaaacgccaggaagtagcggtcaccgtcggggatccgagggtcacgggtggagttacgcgtaggggtctggtcatacgctacacccgcgcgtagggttagctcgtcggtggctttatagtcgccaccgattgaggtcatccaggcattcttgtagttgtagggaatggcaacaatagttgaaccttgggacttgagcgtcagatctttgaacgaagaccattcagtccattgagcgcttacacccaatgtccagcgatcattgaattggtggacccagtcaatcgccgcagtagccggaatatccaattgcgtactggcatgcgcgccgtccgggaaaagcttaagacctggataagccatttcaaccagcgtttcgccgttcggaccgataggattagtcattgcgttacggccgatagcatccgtgtagacgttgtacttaccggtcatcttgtttttgattttggcgtgatagttcaagcccaacgtgtcttgcgccgtcggcttccataccacaccgccaaaccagccgaccgagatgttgtcgacttttacgcgcatcaaagaatgacctacacctgtaggaaaaccggtgcctcccaaacctggagagacatccgctgcagccaacaagtcaatgttctggctgacgaagccctggctgcgctggacgatggcaccgccaccgaccgaaaactcatcattgaccttgaacgacagcgaacctgtcaggccgacggtctcgatcttggtgtcgaccgcaaaatcgcgcagcttggaatcttcgttccaagtcgttttcatgccttggggcacgacctggctcaagccaaaagcaaaacggtcgccgattggaatcaccaggaaaccggttggcagccatgcggtgaaaccgccttgcccgccattattggtgttaagggctggatcgcccatggtgccctggtcatccaataccggcgtattggtcactggattaccattgtggtcatacgcctgacccgagtatttgatcttgacccgggcataatcgacagtctgttgcgcgatggtcgagtcaataaatgccatggctgccgggttgttgtacgcagcactggggtcgttcttaaacagtgagccgccaccaaacgcacgaccccaaccgggcgcgccgtaggtcggcgtggagaagccacccgcctgtaccgggccagtgctcatcagtccgcctaccaatgccaacccgagtaaagttcgggtgtgttgttttttattattcatgtattacccctattattatcgcagcggcttatcccagcgagccctgtcatttcaattcgctatcgagagcgtcggaaaagtgagctccattcgttccagcgtgcaattccctgacaaggcttgattaaacacagttaattgatggctcgcgtaattccaacttgcgtaaatctgatttgggccgcaatgggttgcaggcagacttgttatcgaaaaaccaacgtcatcgataagggcagaagtcgaagagaaggcattcatccgccaccccaaaatcttaggtttcagcaagctacaaaaccccggacccgtaatggaaaatgtattgatatgaaccccggtaaaagcgctcacattccccgccacggtaagtccgcatgtaagtggtgagccaaacgtagaaggcgttcttatcgttagtgtcccagcagcactggtgaatggacccgcaggagaaaaatccgcggcgagtgccacacttgcaaaccctacgccactggtcagcaacaaggtacttgccgcccgtcgcaacaaactacccatagtcagttccctcgaccttgcgctccgtcagcaggagcctccttagagacccctgccttcacgggtgatcaacccttacgaagtgatgcgacttattggacagtcaacgttggcgcggttacgtccagggaaacaacggtgcagttgccactcagagactgattggcagcggtcaacttcttggaccccgcattccaagccacggcaatagtggtagggccgcagttggtagccggaatcgaagagatcttgtaaccgacattggtcacggtaccgacagttggcgaggttgcagtcagcacccacggaatattagtcagcgtcggcagcccgcacaggccgccacctgtcagcgtcgcgccattgatcgacgctacgccgccactgacattaccggtgaaggtaatgccgcaggtcacagcggccccgaaggacgacggcgacttcaccacgatcgtgccagcactggtagagaatggaccatcaggagtgatggtggccgcactggccatcgaagcggcacccatgcaaacagccagagcagtcaacgacacgagagttttcaagcttttcattgtttttcctcacatgttatggcgattcatttcgccaggggtaatggccatgatcgagaggtcacggtgaaactgcagaacttccctttccagccaaatttcaatgcatctaccgctgcaacagtcgaaacgctttattcgacaactttgaagttgggcggcatcttgatcgacaccgtcttgatcttgcagtcttcgccaatggggacattggcggcttccaacttgccagtggcgttatcccaagtaccgtcggccgtcgaaggcccacacttgccgcccaggccaaaggcgtgcacatccacactgatcttcgacatcgagccactttttttatccttggcaaccagcacccagggcaggttgattgcttcaacgcggctgcacttgaggccaccgtcgaattcaactttgtcgacatttaccgatgaaccatcggctgccaccttgccggccaccttgatggtgcaatcggcactgatcagcttgcccttggagaaactgatgggcccctgggcagtgaaggcactgccggcaggttcgatacgggcagcctgggcctggtgatagacaatcaggcccatcgcagccagcacgatgtgggcggtgaacttggcagaactttgcatggtggacgtccttcccttaaattatttttgtagggtcaaaccacgttcttgcaactgaaactggggtcgataaggacctgcgcgatacacagatcccgagtaagccctgactgcttacttcatctcaaaacggcttcgcgctgttgctgtatttctccagatacttcaagcgttgtgacggttgaagattggtcaggctgatatccccggcatagtgattgagtacgcgatgatccatgcgccgccgccacaagtaaggcacataggcccagacaatcatgctcgcgtagccataaggcagttgcggtgattcatcgaagtgacgcagcgactgatagctgcgcgtcgggttggcatggtgatcggagtgccgttgaagttgaaacagaaagatattggtgacaatccgattactgttccacgagtggcgcggcgagcagcgctcataacgaccgttgggcaacttctggcgcttgaggccgtagtgctcgacgtagttcaccacttccagcaacgagaacccgtagatgccctggatgatcaggaacggaatcaccgccgcgcccagccaggcaatcatcgcgccccacaacaccacgctgtacatccaggcgctgagtacggcgtttttccagtgcagggccggcaggccgagtttacgcaggcgttcgcgctccaggttccaggccgatacggcgctgaaccacaccgagcgcggcaggaacgcccagaaactctcgcccagccgcgaactggccggatcttccggggtggctacacggacgtgatggccgcggttgtgttcggtgtagaagtgcccgtagaacgtcggcgccagggtaaccttggccaggaacacttccaggggcttaggcttgtgccccagttcatgagcagtgttgattgcgatgccggtggcggcgccggtggacatcgccatacccaggtaggtgaacacactgatttcgccgtgcaactcggtgcgtgcggtgataaatgcagcggtccttgccagccagcttgacggttccagcgcagcagtggcgtgcagcaggccgccgttgatgatccagtcgatgccgccagcggccagccagccggtgatgaccactgaggcgatcacaaacagcacgccggtgtagacgatccagcggtagtaactttgggactcgaggttgctgacggccgattcaggcgggttgctgacgtcttcgccgagcaggccatcgatcaacgggatcaagccgaagatcaccagcacgcctacccaccagagttgctgcacgccggtgccgatcgccagggcgccggaaagtagcggagttgcgaggggcatgatgcccagccaccacaggtggcgcttgccgtcggtccagacttgcgaggttgccagggtctgattcatggcaacctccacacgcattcactgaacacttgggctgctgagaggttcacggagcgctgacagctccgagacattgaccatgcgataaaaggcgtttttttcattattttattcgctcttaggcatttcaaaaataatttcaaattacacattgaaataatttttttaaataaatagcgcggaatcgttaggtcgtcaactagtttctccagcccttttttccgtgaccgtacagtctctttttcagccgcgtagtcaggtgtctagggcaggcattaacgccgttgaaccgcgagtcgggtggcacatttatttgctcgccagggccacaggtggatgtaactgcgtgacgctttcgccgggtcgaacgcgcttggcaatctgctccaccagcgccgccactcgctgcgtcgcggtgatcggcaacatgtgtccacggccttccacgacctgcattttcaaccctggcaccttgctcgccagggcctggccgtgtttctggaagtcgagcaccttgtcttgggcgccatagatcagcccgatgggcagggtcagttgcgggtagcgcttgaccatgtccggcaggtgatcgttgacgcggttgatctcggtagaggccgcgtagaaattgtcggggcgcatgcctagcaacccgccgccacgggtggcgaagtccgaaggcgcagcatcgggggcgaacacacccttgaccaccgcgtccttggtcagcaggccaacgggcatggtcagggtgtgggccatccagcggcgcaaccaggccggacggatcgccagagacagaaataccaacggcagcatgcgttggggatgggtcaagggcgccaccagcaccagtccggacactgcatggggatggtccagggccagcgctaaggcaatcgcgccgcccaacgagtgccccaggaccagcggcttacccaggtcgagtgtgttgataaaggcggcgatttgtcgggcctgggctggcaggtctgccgccgtgccacggtggcgggtggaatagcccgaacccgggcggtcgagggtgatcacgcgaaaatgttcacgcagttgcccagacaaggcataggtcaggttgcgactgctgcccatcagcccgtggatcatcaccagcggcgggcctttgccctcttcgacataatgaaagcgctcgccctgtacctcgacgaagcgcccgttgatcggaacaaccgcttcaatgcgccgcgtcatccaggcactcaagccccataacgccgcgctggcgcccaccaacacccccgcagccactacccattcgacagccatagctcggtcctctgcttccctgcggctggcgacccgaccggaattgatcagggcctcagccatcgtccacgccctggacctagacttgatgcatggcgtgttcgcccgtcggacaaatggcacatgcggaacctagcgtaggcgattttttcaggtagattatttaaaatcttttttaaaataaataattcaattttcctttgcaatggtgttctatctaaaagacaaaacaaaaacaggagcagattcgatgcccaagcgcgttctacggatgaggcagcctttatgaatgcctacagtgattcaatcgacatcgccattatcggctcgggtttcgcgggcctgtgcatggcgatcaaactcaaggaagccgggctcaccgacttctttatcgctgagcaggccgagaccctcggcggtacgtggcgcgataaccattacccagggtgcgcctgtgacgtgcagtcccatgtgtattcgttttcctttgcgcccaacccggattggacgcggcagttcgcggcgcaacctgagatccgcgcttacctggaacaatgcgccacgcgtttcgagctggcgccctacctgcgtttcggcatgggcctgcaacgcgcggtgttcgatgagcagcagcaacgctggcatctgacgttcagcaatggccgccaggtaagtgcacgggtgttggtatcgggcatgggcggcttgtcgcgcccggcgatgccggacatcccggggctggacagcttcaagggcaaacgcttccactcccagcactgggaccacgactacgccttgaaaggcaagcgcgtggcggtgatcggcaccggcgccagcgccattcagttcgtgccgcagatcgcgccgcaggtggcgcacctggacctgttccagcgcacaccgccgtggatcatgcccaagcccgaccggccgatttcaaccttcgagggctggctgttcaagcacctgccgttcacccaaaagctggtgcgcggcgccctctactgggcgctggaagggcgggtggtgggttttgccttgcacccacggctgatgaagatggtgcagaaaatcgccctgcgtcacctgcgcagacaagtggcacgcccttccctgcgtaagaagctgacgccggactacaccatcggctgcaagcgcgtgctgatctccaacgactactacccggccctctcgcgcagcaatgtcgaggtggtcaccgatcgtgtgctgcgcatcgaagccgacggtgtgatcaccgccgacggcatcaagcatcccgctgactgcctgatcttcggcacgggtttccaggccagcgaccccttgccccgcggttgcatcatcggccgcgacggcatcgacctgatggacgcctggggcgatggcgcccatgcctacaaaggcaccaccgtgccgggctatcccaacctgttcctgatcgtggggcccaacaccggcctggggcataactcgatgatcctgatgatcgaagcccaggtcagctacatcctcgacgcactgcgccaaatgcagcgccagcgcatcgccacgctagaggtcaagcccgccgtggagcaggcctacaaccgccagttgcaggacaagctcaagcgcaccatctggaacaccggcggctgccagagctggtacctggacccacgcaccggcaagaacaccacgctgtggcccggctcgacctggcgcttcaagcagatcacccggcattttgcgctcaaggactaccttgccggcccgctgccgacgcccgccacaccgcgccctgcacccgcgccccactccgccacagaaggcagcctgtcatgaagtcatttaacggccgcgtcgcggcgatcaccggtgcggcctccggcatgggacgcgcactggccttggccctggctcgggagggttgccacctggccttggcggacaagaacagccagggactggagcagaccctgacattgatccgcacctcgaacttatcgcccgtgaccgtcaccacccaggtgctggacgtctccgaccgccaagccatgcaagattgggcggcccgttgtgccgccgagcacggccaggtcaacctggtcttcaataacgccggggtggcgttgtctagcaccgtggaaggcgtggattacgccgacctggaatggatcgtcggcatcaacttctggggcgtggtgcatggcaccaaggcgttcctgccctacctcaaggccagcggcgacgggcatgtgatcaacacctccagcgtgttcggcctgtttgcccagcccggcatgagcggctacaacgccaccaagtttgcagtgcgcggctttaccgaagccctgcgccaggaactcgacctgcaacgctgcggcgtctcggccacctgtgtgcaccccggcggtattcgcaccgatatctgccgcagcagccgcatcgacgcgaatatgactgggttcctcatccacagcgagcaacaagcccgcgccgattttgaaaagctgttcatcaccgatgccgatcaggccgccaaggtgatcctgcaaggtgtgcgcaaaaacaagcgccgcgtgctgatcggccgcgacgcctattttctcgacctgctcgcccgttgcctgccatcggcctatcaagcgctggtggtgctggccagcaagcgcatggcgcccaagccacgcaggccggtatttgaaaccaacgacgagtcccatctctgaacaggaggacgcaccatgttgccgatccgtcgcgatatccgttttgccttgcctgccgagcgcatcaagaactggcatgaacaaggtccagtcatcagccatttcttcaatgccctgtcgctgttgtttccccagggcgagctgtttttcatggacagcgtgcgccactaccgtgggcagatcgacgatccagaactgaaaagggaaatccaggggtttatcggccaagaggccatgcacagccgcgaacatgtggcctacaacgacctgctgcaagcggccgggctaccggcgcacaccctcgaccggcgcctgaaattcttcctcgacctgcagaaaaaacacctgccaccagcgttcaacctggcagtaaccattgcccttgaacattacaccgcgatgctcgcggaaatccttctgagcgacccgtcgcgctttggcgactcgctcaagggttaccagcagatgtggtactggcatgccctggaagaaaccgaacataaagccgtggcgttcgatgtctggaaccgcgtcatcacgcccggacctgcacgctatctgctgcgcaccgggaccatgctgaccaccaccctgatgttctggttggtggtgctggatttccacgtacgcctgctgattgccgaccgcacttcgggtggcaagctcaaggggttgtggcgcatggtcaagtatttgtatggccccaagggggtgttcccgcgcatgctgcggccgtggctgcattatttcaaaccggggtttcatccttgggatcatgacaaccgggcacgcctggcggggatagacgggctggtagaagagatcgagcggacgcggcacgggtatgagtcggcgtaagagccgaacgtaaccacgatgcgcagcgagccgctcttgatcttgatctgcttttgatctcaggcgccccgtc

SEQ ID NO: 10 - DNA, 19916 bp, Pseudomonas fluorescens KENGFT3
ggggggtaaaccggcagggatgccggtttagccgccccgcgccatggatggcgcgtggcggcggccccccaaatccctgtcggattacgggcacaccgagcctgggcgaggtgccgagtggtggggcaaagcgtttttggttacttttggcgctcttccaaaagtgacccgctgtaagagcggaaccaatattggccgttacctaaacaatggatatgtactcggtctgatccaacatcctggtcaactgtcaggccgccatcgggggcaagccccctcccacacttgtaccatgcggcatcagttatatagcggtcagctgtcagggcccagaggaggcaggcccctgccacatatggatcaagccaacgccgcccgctcacgcacaaaccccggcaactgatcccccggcaatgccttactgaaataccacccctgaataaacacctcgggccccgtactcagaaagcccaactgctcggcagtttccaccccctccaccaccacccccagcttcaaggcctcgcaaaaacgcaacatgccggtcagcacctgggcgcccttgggctcacgctgggcaaccacaaaactgcggtcaatcttgatgaagtccacgggaaactggtgcaggtaactcaaggcggaaaatccagtgccaaaatcatcgaggtacaccttggcacccatggcttgcagtttttcgatggtctggcgcgtagccgggatatcactgaccagcgcgtcctcagtgatctccacagagacccagccatgggcctgggcaagaatgtccaccagacgatcaccataggcagcgtccttcaaggtggcactggaaatattaatggtcatcggcaattgaaaaccgcccttcttccacttctgatactggcgcacggcctgggacgccacccacacgtccacatccggcatcagcctggcctgcgccagccattgcaggaactcccagggcgaatgcaccgtaccttggctgtcccgggcacgcatcaacgcctcacacccggtgcacaggccggtgcgggtggacacctggggttggaattcaaggtagaactcgtaatcgctgatctgctggatgcggctcaactcaacggcctgtcgtgccgaagtcctgtgggaggccagcaccgggtcgaactccagcaggcggcctttttcttcgaggccgcgaaaggtcatgtccagtgatttcaagtacaccgtgccaccttcggcggcttggcgatgcattgcccgcacgtagggcgcatacaccagcgtgcccacgcctagcagcaccagctgcagcagcaccgccgccagatcaccatgggtgctgaggtaggcattgagcagtaccggcgcggtaaatggcacgctggccacggccggtgagacccagcccagctgcactgccgccagcgccaccaccgtgttgaatgccggcaccagcgaaaaggggatgaacaaacgcgggttgagaatgatcggcaacccgaacaacagcacctcgctgacgttgaataacgacagcggcaaactagcaatagccagcaaccgcatggactggctcctggaaaacagcaggatcgccagcagcagacacaatgtggcaccggaaccaccgataaacgcaaaactacccagcagaccgctgttgagcaggtacaggactggctcccccgccgcctgcgccgcgccattgagcaccacggccttgtccagcacgtcgaacagcggctgcatggcatacacgccgtgaatgccgaagaaccacagcagcgaattcatcagcgttacaaagagtccgctgccgtagggcgcttgcaatgcatcgagtacttgaggcccctgccattgcgccacataagggatcagcagcagcaacgacagcagcagcaccaacgacaccgcagtgatcgcaccggggagcaccatattgatggtgcctttgaggttatgcccaaccaggtcttcgttgaccagccgcgtccagcgaaagcggtgcagccaggcgatggcgggcacattgatcaagggtgaggcgatagctataaacagtaggaaagtggccgaagccctgggggattcgcgcaggacaaaggtggcgaccaccacatggacgaggcacaggaacgccaccggcaactgtggcaggcggtgccggatcgccaacatgtaaccgatggaggccgcgaccagcagggggatcaccgaactgatctggttatgcagccctgccaggaaccccaccacctgctggttgaaccccagcacccgggcgcattcggacaggatcaggaaaccggccgataccagcaggcaaggcaggatccatagcagcccttcacgaatcgcacgcaacgattcggtgctggccaagactgccaggcgctgggtaaggaaaagtctgaacagcgtttgtgccatgagccgccctctgcccgtcaccttactgccgctgaaaaccagggccggaaaccctcgctaacgctacacgtcctgatggtgggagtgaaagccttttgcccacgactctcaggctttttcggaactatctgcggggttgctacacgaattctctactgaattatcgaactttctgacttgagtcatcccctaagcctatctgagtcggtatcatccgcgcctttctgcgtgtcaaaggatgttacaacctgcgtagcaacgggtgcgctcagggaatctagcctggaacgacaacaggcataaaggagagagccttactatgcaagacaagcgtccaagcaacatgcgtcccctatttgtgaccatcctgctctggttatgcagcgtggtgctgctgttcgtgatcaagaacgtcattgaactgtttaccgggcccgttgccgagacctgggtagacttggcattggtgctggtcgcctacctgacgttctttttgctcgcaccgttgcagaactggatgcggcgcaggtcgcgcaaacgcgctcgacgtcacatcagcaaccctacgcccgatgccgggtcccggccttcccattaaggtgtacgccgttgtcagcacccagtgatacttaccagcttgcactggacagattcctgcgcgaacacccgcacatcgccagtgagctggacaacctcaatccgctggcggcccaggccaggggcgaaaccctggcgcagtatcgcgccgaacgcctgcacgaagcgttcgaagcacacgctgaacagcagcatctgttcgcctgggaactgacgctcaagctgacggccgagtccatcgaggccttcgaggcgcaacgccgcgaggtgcataaggaagtcgcacagatggccggcctggactgggtcgaatactgtcagttacatgacttgatggtttgaccctcgccctacagataccaacgcggctgtttgcaaccgatcaccttgcctaattcggcggctgtgatggttcgccgttgcgggtctgttgccagcgccaggcgcaacgccgaccagcagcgcctgggcagttgcctcgggcaggtcaatctatccatcggcgtgtgcttgccaagacgcttgccgtgagccaattcgtaaatgatgcaggccacgccatacacgtcggcggcagcgctcaatacaccgccctcgcgcagctccggcgctgcataagcgggcgtccaggcattgaaccggctgcgactcaggcacgacaggctcgccacctgcgcttgtgcgtaccccaggccaaaatcgaacaagcacaccccctcctgtcccaccatgacattggccggcttaacgtcgccgtgcagcacattctgttgatgagtgtaggccagggcgtccagcaactgcagggccatgggttgcagctcccgccagggcaagccgtcggggcactccaggagcagccggtccagggtcacgccttgcagccactccatggtgaaaaacgcgatctggctctgggtatcgacctcgaacgaaaacatccgcaccacacgcgggtgccgcaggctgcgcgccaacgcgaattcactgaacaacaacacatgtgcatccgggcactgggcaaaaggctcggccaatagcttgagtgccataggcgaacccgcctcgcctaattgttcgtgcaacaggtcacgcgcacgatacaccacacccatcccacctttgcccagtacggactcaaggtgatagcgcccgcccagcaaacgcggcggctcactcgccgggctcaaggctgcaccactacagcggtcaggtcatcccgtgccgccccacgcaacgccccggcaaacagccgctccagcgcctgctgcggcgcgcccaggcgtagcgctcggcccaggtctgcatgactgagcgcctggtagaggccgtcactgcacaacaaaaacacatcgcccggacgggtactgagttccagtacctccagatgcagtggcgaacgtgcaccaatggcccgggtcagggcccgggcgccagggtaaccccgggcttgggtcgcactgacttgcccctcgttgatgaggccttgcagcagcgaatggtccctcgacaactgataaaggcgctgcccacgccatagatagcagcgactatcccccgcccagagacaggccgcacgcccgttctcaagcaacaacgccaccaccgtactgcccatggtggcatcaacgcttgtgtcaggcccggctcggcaacttctcaagcgctggttgacgccttgcaagctcttgcggaccgcgtcgatgcgttgatcgaggttgccccgggccgacactgaagcgaggctgctgaccacccagcggctggcgacatctccatgtcgatgcccgcccatcccgtcggccactgcccagcagccatgttgtgggcagtccaggaacgcgtcttcgttgcgcaaccgcgcctgcccgcgctcggtgcgcccggcactgcgccactgacggggcccctggctcacagttgctgcgccagtcggaaggtgcgccaggtgccgatgtcaaacgggccaggtgtacgctggcctgtcagcaggtaattggcacgcaggccggcgaggtccgccttgaaaatctgtgtgtttcgcccgtttgcgggctctttgcgcagcagatccaaaaagcggaacagcgaccacgcgcctgcgttcttctcgatccccagtggccgctggttcacgcctctctccaggacaaggctgctgcgcccattgtctgcatcggttggccaatggaacgccatgggcacgatcgggccgtggcgatactccaactgctggtcgccaaaccgcaggatcgcccggctgactgactgatccaggctgtagggcgccaaggtaaaccgaaccgacagatcaccctggtccggggtgaagaagccacggcggataacctgggccttcatcagttgatccagtagcgagcgcgacaccggcaagctctgaccatccaggccacgcaaccgatagcggaccccgtcgacactgacgaacggccgcagatacccgtcgtaaaagcgtgccatgaccccattcggtttgaaaaactcatgaaagtcattaagggcaacctcgctggccgcatgggcatcgaagggatatcgctggcgaatcgccttggcgtacaggctataaacctcgctctggtaacgctggttgacatgcacataagcccgttccaacaagtgctgccaactgacatcggccaccccctcaaaccagcccgcaagcggcaacggcaagcgcgcggcagcatcacgcaggttccctatcacatcctgctgcccctccatacgccccttcaccctcaggaacgccgcctgctccggtgcgctgtcgcggttcaatgccgtcagttgcaggtgcagctcatccagcagccgcaatgcctgggacagcgccacaccggggtcctgctgctcgtccagcaactggtgcaagggttcaaaacgccgttgcaatgcccgccggccggcgtcgggaaggcccgcctgcgccagcgtcgccttggctatcccccctagttcgcccgagcgctgggccgcctggtccaacagctggtgacccggcaaaaggcgagtgttttcacgcagttgctgcaatagctggatcaagggggactgggccgacgtcagcgctgtgagttgctcggcatcttcgcgcaggttgtcggtttgccgcagccggacgcggccgagcgccccactccaggcatcggcatattcaccgaagtaacgctgctgcaattggatcatcagccggcgcaaatcctcggagcccaagtcggtggcctcccccagcacccagttgtcctgggcaatggtattcaccagcctcgggccttgagcatcaaggaactgcacatagcgcttggtatagaacccgggaatcggtgggtcgaacgcagcaaataccttaccttcggacaggcgcaagggctccaggtcgcgtgcctgctcgcgcaacacccgatacaccacatcggccaatgattcccccctcagggcttcgcgggcctgggccacaaggttgtcatcaagggaagctacgaacggtcgttcaagcaaccgtgccaagtgctggcccaggcgtttgcgggtcgacaggtctgcggcaaagcgtactgcccaatggctcgtcaggtgtcgtgccaaccaatcgttattgcgacgctcgcgcacgttgagcatcaggtatgcgcgcaggtgatccaacaactgctcgcggtctccaaggctggcacgcacctgctcttcaagctgggcctttatccacgccagcatgcgctgttgcagcgcctgatcataagcctgggcgacccatgggcggctcagttcaccttggtacaagccggcgcgttcaatcaggcgcacctctgccgacgcaggaaaaacctgggttgccgccaagcgtgcatccaacagctgcagtagcggcgacgcgtcatcatgaccctgcggaacgggtaagacggcggttgtcagcgccgccatttgcgccagtcgttgatgattgctggaataactgtgcatccacagcgctgcggcactgccgagtaccagcgccacagccattgccagcagcccctggcgtcgccggatacgctgctgctccggggcctgcaaacctgcaaggtcggcctcggcaaagatcacccggctgaacaggccttgcacaaaacgagcgtgcttgtcgccggcgcaggtcaggtagaagccgcgcaggccgttgacgcgctggtagcgatgagccgaaaaagccgactcaatgaacaggcaaatacgctcgcctatccgcgcagcctgctgcgggaattcaagcatcagaccgcggcgctcgagattgcgctcctggtgcaggcggctgatcagttcagcgttcaaacgctgcaacaactgctcgacggcttggcgaacctgcgtgacgtcagtcgcgcagctgccatcgaggggctggcccagcacatcgtcgggtgcctccctgagcggcacatcgaaaaactcggtgaagcccggcaatcgctcagcctgtgtcagcaccaggtagatcggtacgtccacatgcaatgactgctgaatgtcctgcatgcgcgactgcacatgccgcgcatgctgatccaagtcgtactcggtggtggccagcaacgcgtccaccgagagcgtcacgaccacgccactgagcgggcgtacgctgcgccgccgccggagcctgtccagcaacgtcgcccaccctgctgcatccacggcactgtcgggttggctcaggtagcgtccaggggcatcgatcagcacgccggcatcggcgaagtaccagacacagtggttgtccaatgaacgcgtgtcggcgtgatcaagcggccactgcaagccgcctgctgccagcagctgcgtcttgccactgccctggtcgccgatcatcaggtaccagggcagatcatggcgccagcgcgcgttgtgcatcccgtaacggcgagaagtcctgagcacctggagcgcttccttgaaccgactgcgcaggtgtttctgctcgtcctccacccatttcaaggcttgagggggcgccagccgttctggtcgttcgcgcccaccagcccgtcgtccaccgaccaccaccatcgccaccccccacagcaggaataacacgctgatgctggccaggcgggcagtcggaccttgccagaagcggtggtcggctaccgccagcagcggcccgaaacaccacaccaatacagcgctgcaaagcaccaacagaaggctccagacccaaacccgacacagcacggcgccaacgcccttgaaaaatgcgctcattgattgctccagcgtttacaagggcgtgcggatcaggtccgacgccaggaattgaaggggttgtaacgcatgagcacgctcctggctcagcagccaggcgaaccccgtgtacatcgcccgcagacaggccaaagtggaggccacccaccacgcggtcgggatcacacacaaccgcctgcgccgcgcctgcccaagggggggcggtaatacgggccctgtcggcgcatccccgcgcacatgcctgatctgccgatacaaggcatcgcgaacggcttcgacttgcaacacacctctctccatgacccggtatttcccttcgaaacccaaggacaggcacaggtacatcagctcgagcatggcaacgtgtttgagcggatcacgggacagtcgctccagcagttggaaaaccttctcgcccccgaaggtctcgttatggaagcggctcaacaagctcatcttcgaccagtcgctctgcgccccccaagaggtggtgacgaccgcctcatcgagaacgctgcacaacacatagcgcgcggacatgacctggttgttttcaacaccaccctgcaaggcacgggtttcgaattgagtcatcgccaatgacaaccggtcgttgagcatgcccaggtcttcgcgctcggcgctgaccttgagtcgcacaatttccgacaataactctccggctgcggcgaccatcgggttgagccccgcgttgaaactctgcgcgtcaagcaaatggcccgcgtagatcatgcggtcctcaagttgctcgtagcgcggcggcgacgggaagtccgtcagcggcccctgtacaggcccatggctctcgcggtcgagcaggacggttttttcatcttgtgagtagtcgctgtccatggcattcagttcctgatggcccaaaaatcgagttcaagcccgacgaactcacctcccacatggaaagcgaaaccaccggactgctccaactgcgcgatatcgcgggcgctcatgtcgagcatgaaataggtcttggcggcatgaaacggaatctgccgcggcgccaccggcagtggcttgaccttgatcccggcaagatgcaggttgaccaactcccgtatgcgctctaccggcccaatcttcagatgagccggcaggcgctggcgcagttcctctgcgtcacactgcgccctggcggccaggatgaatgtggccgcaccgagcaatttcaattcgctcaccggacacaccagcacgccatactggcgttgctgcagggtcaattcgatagcgtgctgttccagcaccatcgacaacaccgctcgcacgggctccatcagcccgcgaaaactcgcgccctggtcgccatgccggtaatgcacctccagttgcgcacgcttgctgtcgttggcgaaggtcgataactcgccaagcatcgacaccaacgcgcggaacaccgcttcaggacgcacctggggctggctcaggcggtgacgcagttccagctctgtgcgattgatcacttgcagcatcaacaagtcaccgatttgcgcgccagcgccgttgcctccggcacggatccgcgccgcaatggcatcgcctcggctggcaagcaggccgattacctccttcaggcacgacgccacatagccatgcgcctgcacaaaaatgaacgacgggagaaagtccgtatccaggctcaggcccccctcggcgctggagttcagcacctgcgcgatcttgagtttgacaaagcgctggtcgctctggtgctcgcccagcagcagacgcaagtcggggcgtgcgcagtgcacctggcaaagcgaatccactcccacgttgctatcccccacttccacttcacagctcaggtaacgcgccagtacatcgctatgctgcggttggcgcacttcgacctgattgccgctcgccaggggcagcgccaggtaaatcccttgctgttccgtattcggcggcacctgcaagaccaagggttccatggctgcgctcaactcaaacaggctgccgtccggcaagacgccgctggcctgattgaccaccagcttgcccaggttcaggtactgcacgttgaggtccagcgtcaggaaaccccaggcgtcactgcccagcaggcgcgtctgatcaagttgctggtggtaataacggtcgttgtgctgcaagtgctgtgggcgcaacagcatgccttcctgccagatgactttatgaatcggcatatcagcgcgcctccaggtcaggcaaatggccggcgacccgaatgccggcctcgtccagcaccagctcggcccgtgtcagttgccgggcggtgacgggaatcagcagccgccagcgtacatggggcaaatctcgatacgccgccagcacacccacgaagcgactgtcaggcccgaccctgagtttgagcgccaggccgtcaccggggcgcagttcaacttcctcactgctcacccagtccttgggcagcacctgctcagcgtggccatacaggctgaagaagtcggcattctcgaaggccacgccatggcgcagttcaatcaggtgaaccaccactggagagggtcgaccgtgcaggtctgggttgacctgttcgctggcggtcagcaccagatccaacttggtcagcgtcgaaaaaggcgaaatcgcgctgcagcctgccaacggaccgagcaggaacagcagggctgcaagggtaattcgatgcatgactctcatcctgggaaatccatatgcaaggcgccaatcaggcgaacctgctcctcgtaggccttggcaaaatcaccttccagcggacgccgattcagttgttcatccgccgccagccgctggtagtaacgctggtaagcccgccaatgccacgcatccgcaaaaaatctgggcggcctgccctgggactcaaaacaccccagcaggtagctgggctcgaaggcggtcctggcgttacgcagcgtgcttcggcatgcggccagcagggcggcttggcgcacttgcaggtcccgatgggcctggacgatcgcccgttcagcggacagctggcccaatacctgcgaacccagcattgcggctagcgcagcccccgtatcggggcacaccttcaaagggttctgggccaggtccagactggcacctggcgccgaagcaaactcgctgttcagttcgtcacaggtacgcagcgtctgttgcaggccattcacgcccaggtggaacaggcgcgccaccttgattgccagggcttcccggccggacctctcgagggtattcaggtcgatgcccaacgctgttgcaaactgcccccagaacagctcgtcggagggcgccgccaccgctatcgggtccaccgcgccaggcgccaccgcgggatcgaccgggcaaggcactaccaggtgttcccgctcggcgccctggctgtcaacccacgtgcagggctcatcgactatctcgctcaatgcctccaggtcctccgagcgggttcgacgcgggtgatcatggtcgagcgcatgcagaggatccaaagacaggaacgcatcatctggaatcggcccccctgtgatgacccgctgctcgctgccgtggcggggcgctttcagcaattgcgcgcgtatcgtcactggcccaaggtcaaaaacatcgccatcactgatcaagcgcgcctgccctttgcgcaggcgttctgcgctgcccgccatcccggtcccattgcggctgatatccgtcaggaaatagcggcctccacgatagccgaccaagccgtgatgactggagagcacgcggctcggatcgggtattacccagtcacacccggagccgcggccgatcacaccgcctgtgccgtcaaatactttgcgggccaggggtatgttttttgcacgttcgacttcacagacctcaaacaccagttgcatcctctggccccctccattcatcggccacgggtgaccgcctgggggtcgcccaaaggacgatactcggcatcgtcaaagacggtgttggcgttacagccgcccaacaaacacagcaccagcaaaacggcttgcaacggacgatcaggcatccggtttctccctcagtcaaaatcatgtgtgccattcagcgctcttccctggcaccgccaacaggtatgttcaagcgtgcaagccggtagagcagtgtgcgccgtgccacccccagctcccgcgcggtacgggtacggttgccatggtttttgtgcaggcaatcgagcaggaacacgcgctcgacccgctccatacgcttgcgtagcgtcgcgtcgtcagccgccgtcggcgtcagtggcatcgacaggtgcagcggtagaaccagattgtcgtcacacatcaggacggcgcgttcgaccaggcatttgagctcgcgcacattgccggggaaaccatggctcgacagctggtcaagcgcagcgttcgaccactcgaccggcgccctgcccaactgtgcacaggcctgatcggtgaaatgccgggccagttgcagcacatcgccgtcacgctcacgcagtgcgggcaattggagggggaactgcgcaagccggtaatacaggtcttcgcgaaagcgcccctcggcgaccatggccgccaggtcgcgatgagttgcggcgatgatgcgcacatcgaccttgtgcgccgcactggcgcccagcggacgaatctcgccttcctgcagaacccgcaacaacttggcttgcaatagcagcggcatgtcaccgatttcatcgagcaacaacgtaccgccgtcggcagcgtcaaacagccccgcatgattgcggtctgcaccggtaaatgcgcctttgcgatagccgaacagctcactctccagcaacccttcggcaaatgctgcacagttctgcacgacaaaggccctggcactgcgtgggcccgccgcgtgaatggcccgggccaccacctccttgccagtgccggtctcgccgaacagcaggacggtgtaaggggtatgcaggactttgctgatcaactggcgcgtctgtgccatggctgcactgttgccgatcaaaccgtatgccccgtccaacggcacagcctgccttggcggcgcgccaaccctggtgcgcatgccgcgcagcacatgcaaccgctccacggcaaaactgcccagttggcccagggatattgcgtagccgtgcaactggaccgggcgttggctggcgcacaacaacactccggtaagccggccagatccgctgaacagcggcatgctcagcagtgcacgccacggtgccggcgacacaggcaggaagcgggtgtcatagcaactgccttgtacctcatcgaggctgaaggcggcgcgctggttcaaggtgtagtgcagcagttgttgattgcgcgggtctgcgcgtgtgcatgccgagtccagcgaaggcccgtcgggataatgttgggcgaccagctccaatcggtcgctcgcttcatcgaacagatacagctggctgagctcgcactgggccagttgcgcgacgtccgccacgcatttcccgggcagcacgtgttcatcatgttcaaatcccaggcgggtgaagcagacggacagcgcatcgacagtgaatgcacacgtgccggtcagcgcttgcatgtcctcattaagcatggtcatcagtccctaaaaaatggccggcaagcgtcaccgcgccatcggctcgctcatggttcagccaactggtccaacccaggcggcaaacgttgtcctggccaatgtgcagcgccttgatttcgctgcgcgccagcaccaggcgcaggtcatagtccaaagggctgccagtagccaagcgcaccagtgcacacagcggctgatgggcctttccggtcggcaggaagtcgtgaaaccgttgccagcccagcgcctgcaactgcaccctgaacttgccgcagcggtccgcaacctgctgccccaggaccaggtcctcaccgagtgcacagttggcgcgccccaggccgttgcgctgcacagggttgatatcaacccggcgctcgacccattgctcgatgaacaacgcgtcgtgcttgaagtagtgacgcagcacggactcgatcacggcagccgagcgcgcccgcaggctcaacagccccaggtaaggcagaaggtgtttgcagtccagttgcgatgcccgccgtatcgcgtcgccgcccaggccgatcagcgcaaacatctgcgcggagaacgcatcgttggcacccgtctggaaacacgcccgatagcgatatttacgccagatcggcagcatcagacggtgcagacggtgatgaaacatatccagaaagtcacgggtaggattgccccctggttgctcagctagcgcctgttcagcataaaacgccggcagtggtgaccctgcgccgaataaccccagcacgttgaggcgcaggcgggcacgcaaacgcccgtggtccatgaagaactgcacccggtcaatatcgtgtgccgcaaaccccaggctcgggttggcctggaattccagttggtcgtacaacgcatcttcgtccagcagcggatgcgcctcgcgcaaccgttcggtcacctgcaagaccgcctggaacagcgtgtactcgcggataacacggcaaagccgggtcagagcaggggttgctggcccgtccgggatggccatagatacacgtctccttgtgtgctgaggacccgcaactcgtgatacgaattgaggttggcatagagtgcaaagaactgattgatgacagaggcaaacagaaacaggtcgccgtggccgacgaagccttggggatcgacggtcaggtcgatgcgcagcccccggatgggcagcccgcggtgcagccggtccaccgcctcgtggcgaatggaacgcaacgcacccaaccttttctggctgaccttgagtgcctgtcgatcgtgatagcgcggcaggtcgtaggtttcgaggaccactttcaaggcgttgatatcggtcaacgacagatagttgagcgacatgttgctgatcagccgccacaggaagtcctgttccaagggcggcgtgaagctcgcggtaggcgtcgtgatgttgtgaaacgtcaacgactccggtgcctgctcgccgggctggttgatttcgcctagacggatctgctgcgctaggttgctattggtacaggtcagttctatcgacaacgtttcctggccctgcgcgcgccgcgtgccaaagcccatccaggtctccagcccgccatgctgcaccgaggagcattggcgaatgctgtagctgggaggtgcagccagcgattcatggcttgcatcatgttcaaaggactcgaaaggcacataggcttggtgacccaacccaccagggcgccacccagtgacccgatccacggagaacacactggcgtgccccggcgcatatccaccgggcatcaggaggtactcgtcctgcttgccgtccaggcgaatgggaatcgcgtcttgattgaacaggttggcgataggcgtgcaatacagcttcacgttatccaggctcgggcgcaggccatcgcgcccctgcgtgtgcaattggaaacgcacgaccattccgtgcgcctgcttgagcagctcgcggggcagtgtgtgcaatacattcagtccttcaacgtcgacaaacaggtacttctcgggaaaggcaaagtactcctgcaggtggcgataaccaccgaacgtgttttgcgggtaaggcatcagcgcctgttccggggcaaaacccactggctgaacctggccggcactgagatgcagcgtcacgggatgtccatcggcggtgttgagcggcaagccgtcgtggcccgacagcaacacctggataccgtcaagatggcgcagcaggccaaggtacaagccctggctgacgtagtggtcgccggccaggtgcaaccgcaacgaatcaaacgccaggtcattgaagctgccttctgcgctcatggtcaggcgcaggtccagccacgcgccttcggcttggcaccggtactccaggccgctgagttgcagggccatgacgtcggtggcataacaggtacgaaaacggcaacgttcaccttgtatcggcgtgctttccaccgcagtgtcccgcgccactcggacgctgggtcctgcacgcttcaacgggtcaaactgcaggatgctgaaggccggaatgggtcgcatataattgggccacagcaaatgcatcaacgaatgcgtcaactccggcagttcatcatcgagcttctggcgcaggcgtccggtcagaaacgcaaaaccttccagcaagcgctcgacgtccgggtcctggccggcctctgcgagaaacggcgccagggcaggattgcgctcggcaaagcgccgcccaagttggcgcagggcactgagctcgtgttgaaaataacggttaatggtcatcgacacagaccttgatttgtccggcatccgtcaggcgcgcctggaacacgacgggctgggtagtaccgtcgatgaccaacccggcatcaatggcaaatgccaaggccaaaggctcgctcgcagcgggtaacagcctcacacgtacgttcgccagccgcggttcatagacctggatgaaccgctcgatcagcagccgtgactgggtcagggactcatgcaggctcagttgcatatcattgaagtcgggcaaaccataatcaggcagcgcctggacgctgcctgcgcgggtgctgagcatcctgcccaaatgtgcggcgacggacgcaacggggcacgcgcgggtcgacgcatcgcgttcaagccgttcgaacaggctgttgtggggggacatcccctggcctctgctcatgctttatcgagcttaccgaccagggacaaggtgaagtcggcccccatgtatttgaaatgcgggcgcacgctcaggttgacccgataccagccaggctcgccctcgacatcgctgacgacgatgcgcgcagcacgcaatgggcgccgcccgcgcacttcggcactggggttttcctggtccgccacgtactggcgaatccatttattgagttccagctccaggtccgtgcgctccttccacgcccccaattgctcgcgttgcagcaccttgaggtaatgggccaggcgattgaccaccatcatgtagggcaactgggtacccagccgataattcaactctgcagccctgccctcttcactggtaccaaaggacttgggtttctgcaccgagctggcggagaagaacgcggcgttatcgctacccttgcgcatggtcagggcgatgaaaccttcttgtgccagctcatactcgcgccggtccgatatcagtacctcggtaggaatcttggtttctatctctcccatgctctggaagtggtgcagcggaagatcctcgacggcccctccactttgcgggccgatgacattcgggcaccagcgaaaatgcgcgaaactgtcggtcaggcgcgtagcaaaggcataggcggtgttgccccacaggtagtgctcgtggctgttgaccacgttctcctgataggtaaaggtcttgaccgggcactcaagggggtcgtacggggtgcgtagcagaaagcgcggtgcggtgaggcccatgtagcgggcgtcttcgctctggcgaaaactttgccacttggcaaactgcggtccttcgaaatgatcccgcaggtctttcaggtccggcagcccggtgaagctttcgaggccaaagaaactcggccccgcggcagcgataaagggcgcgtgggccatgctggcgacactggatgcgtatcgcatcagcttcacatcaggggcactgggagaaagaaagtagtcggcaatgatcgcgcccaccggctggccgccgaactggccgtattcggcactgtacacatgcttgtagagcccggactgagtgacttccgaggagtcctcgaaatcgtccagcaggtcctggcgcgagacattcagcagctcgatcttgatgttttcgcgaaagttcgtgcgctcgaccagcaactgcagccctcgccaggaagcctccagcgcctggaaatcggggtggtgcaggatctcgtccatttgctggctgagcttggtatcgatctcggcaatcatccggtcaaccaggcgtttcttcaccggttcttcgcggttatgcggcttgagcagctctgcgataaacgccgacacaccgcgcttggcaatgccataggcctcgtcgtcagcgctcagcaatgtctgggcaatgatgttatcgaggatgctgccggcacctggggtgtgtacgatttgcagttcgtgttcgatcgtggtcatgctctcagtgtccttttactgaataggttcggcgtggggtccgggcaaccccagctcggccaggacctgggcgcggcaatcgccattggccaaggcctgttcaatggctttgcgaaagttcggcgtattgcccagcgggcccttgagcgccaccagtgcttcacgcaatgccatcagtttttgcaactcggggatctgctcgaccaggttcgcgggattgaagtccttcatcgcgttgatccgaacctggatcgccaactcctccacgcaggcttgctcctggaggcgattgggcacgctcagcgtcaagttcagcgcttgtttggccagcacgtcgtcgaaggtgtgcttgtcgatgccaatgggcttgcgatcctcgagcttgcgcaggtcctcgcgctgggtgaaatcacccagcaccagcaacttcaacggcagttcaacgtcctcttgtgcgccgccgatggccggtttgaaggtgatgttgatacgttccttgggggctaccgaacttcctttagccatggtgctattcctttttgacagggctttattcaagtactgcttcgagatcgagttggcataaccgtctatggagagactccttgcactcgcgtatgccgtggccttgtggcaacaggtcataacatcggtacaggcactggcccacttgcagggccagttgcggctcccagcgttccaggccgttacgctgcaattcatcttgcagctgctccagttggcccctggccaggtcgtgcttgcccgctttcacacacaacctggccagtgccaggcgccagtgaaaacgcgcgcgctcgccgggcgcggcgtgcaagccctgcttgagcaccacgaccgctgccttgagcccctttgtgcgcaagcaaggcagcaccgcctccaaggccgcctcccagggctcgcgggaagtgtctgtaacgacggttgaaggctcgctgcggtgcagatgaggcctgacatggagcgcaatccacccacaggtggcagggtcggcaaagggtgtgccatcgtcgaaccggtactcgggcaggttcggcaggcgttgcaacagcagcgcgaaatgcatttccagctcggtcatggccaggtctgcgtgcagggcctcaaggcactcccaggccatgcgtaaaccatcgaaccagaacattgcgcccgtcaggctgacttctagctcaagcaacagctcggcatattggccttgggccagacgctcctcgtagcgtttgagcttgtcggcggccagtgggcgcagcgccgtaacccgctcactgtcggcatcggggtagttgatgagcgtcatccacgccaaggtccggcccaggcgcaaggcacacagggggata

SEQ ID NO: 11 - DNA, 812278 bp, Pseudomonas fluorescens KENGFT3
ccccccacgactggcacacaaagggcgggcctgctcttgcaatgaacgcagcagcctgtgcgcgtccttttcgttgtcaatgggttgcccgggttggggcaactgggtggttaccggcttgacgggagcgatggcacccacgacgacctcaggtttggcaccgtcttgttcggtgcgggccaggcgttccgacagttgcctgcggaccggcaacagctggggcgcctcattgccaagcttttgaccccacagctgatcaagccgcacgaggtgctcaagcagggcctgcaacacaggcacctgcccggcaacacagaggttctgcgcaaacaacggctcaaggcgcaacaccagccagcccaatgcggccacgcgtgtacgcaacttgctggggtgaacctgcgcccaatggtgctcacaaagattgcgcagcaaaccgagaccggccagcaacccagtgaatgaatgacattgatacagagcccaggtcaaccagacggccactcgcaggtccttggaatgctcgcgcaataaagactcgctgagccggcagaccttcggccagtcaggtagcccttgcgcatgaatcgatcgggtcttgcccagttcgtcctcgagggtttcaaactccccggagaaacgcatgtcgtcaccggtaaaactgtcagctcgacaaggtactttcgcaacttcctgataataatcgaacagcttttcggaatattccatttcgtcgaacacatcaccttccaaggcaagacaagaaacttttaatattattaaaaaacgtatcagagcaaactttaacttccgttaaagtgcttactggaggctgtgaaccttagccattaaaaaagcgatcagcaagcgactgatcgtgacttaagcattgtcctacgcccgttatatgaaggggaccgcgcagttatttgcgcagtgcaatcggagaaaaaaccgcgagcaccctgcactaactgatccatgggcgcgagcagacaattgcgcacacctgcgcaacaacaacctctaaaaaccaattatttcccgacaacttcctgctcattctttttatcagccttgccgactgcagttttattgagccccacactttcaggcacgtttcttgtaataggcagctgccggtccggcaacttagccgttcggcatacctactcaaccaggcaaggaaaaccatcatgccaacacccgcgtacctctctatcaccggcgtcaaacaaggtttgatcacggcaggtacattcacccaggactcggtaggcaacatttatcaggaaggtcacgaggaccagatactggtgcaggcgttcgctcatcaggtaatcattccacgcgacccgcaatcagggcagccaaccggccaacgcgtgcataaaccgatgatgatcagcaaggtcttcgacaaatcatcaccgttgctgttcagcgcgctgactaccggtgaagaagtgtcatgccgcctggaatggctgcgcacctcttcggccggcacccaggagcactacttcaccattgaactggaaggcgcaaccatcgtggacatccagtcgcgcatgcccagttgccaggaccctgacaacgcccatttcacccatctggaggaggtgtatttcacctatcgcaagatcacctggacccacgaagtggcgggtacgtcgggttcggacgactggcgtagcccagtagccggctagcagcgcttgaagcaggaacggctgtcggggaaggcgccgttcctgctcacgaactaaaccatcgccagcgggtgcttacgcttgggcgcgccaaacacacgatcaatcgcttcaaggtcgtgctcatccagcgccagggcggccgccctggcattgagtcgtatgtgttcggggttgaccgccttagggatagcgatcacgccatcctggcgcaggacccaggccaggcacacctgggccggtgtcacctcatggcgatgggcgatctgcttgagggttgggctggacagcagctcaccgccctgggcgatcggacagtaagccatcagcggcaaatgatgctgttgccaccatggcagcaggtcgaattcgatcccgcgttcttcgatgttatagagcacttggttggttgcgcacgctggggatgcaagctcctgcaggtccgccacatcgaagttggaaacgccccaccggccgatcttgcccgcctcgcgcaaacgttcgaaggcttcaacggtttcttccagtgggtactggccgcgccagtgcagcaggtacaggtcaatgtaatcagtgcccaggcgctgaaggctggcttcacaggcacggggcacgccgttgcggctggcgttatgggggtagaccttgctcaccaggaacacctggtcgcgcttgccgcgaatggcctcgccgaccacctcttcggcgccgccttcgccatacatctcggcggtatcgatgagggtcaggccctcgtccatacccagttgcagcgcggcgacttcggcgcggcgccgactcgggtcttcgcccatgcgccaggtcccctggccgatgacagggacgggaacgccggccagatcaatggtacgcatgacaacctcctggtgaattcgcggattaacactgtggcactgagcggacaaaagggttcaatcccagtatggttgccctctcgccagtcgccaggaatcacccgcaatgctgtttgtcgtcatgctcgggggcaagcacccacgggccaaaatcgaggtgcacgatgtggtgttcgcagtggcagacaccttgcaggccacctacccacaactgtgcgatgcctggttcggcagctccaagggcgtgcacatcgattcgtggatggcggtggatggcgtcgacggctggaaggtcgaactcagcccactggcgccccacggcgatgcccatcacctgtacttcatcaacctcggcggctacgaggccaagcgcttcggagaagatcatcactacctgctggtggtcgcccgcaacaaacgcgaagcgatgagcatgggcaaacggcagatgttgcgccaatggtcccaggcccacaccgacgcggtcatggatatcgacgattgcctgccgatcgacctggtggacgggcgttatgtccatctcgtacaaggcccgcacgccgctatcgtccagcacaacgactacatcgtgttgccctgagccctggaacgcgttcggagcgactcaaacaagtgacgggaactttgccaggaaataaccgactgaatccggtaggctcaccgttttttactctaggagttattccccatggccaaagccaccgcccgtcacatcctcgttgccaccgaagacaagtgcaacgaactcaaagcccagatcgaaggcggcgctgatttcgcagaaatcgccaaagccaattccagctgcccatccagccgtcaaggcggtgacctgggttccttcggcccaggccaaatggtcaaggaattcgacaccgtagtcttcagcgcaccggtcaataccgtgcaaggcccggtgaaaacccagttcggttatcacctgctggaagtcaccagccgccaggattgattcaatccgcgctgatgctataaacaacggcccaccccttggtgggccgttgtgcatctgatgactggcgatgccccggccgttagcgtacaaatccttattcttcttcacccggcgctcaaggctgataatgcgattggctttttcatctctgctctcttccaccctggccctgttgttggccagcaccgcggtgatcgcggccccgcaaacctacctgacggtctacggcgagccggccaaatactctgccggtttcagccatttcgactatgccaaccccgatgcgcccaagggcggcagcctgcggcgttcggcgctggaggtcgggcggttcgaccatgtgctgccgtatatcgacaaaggcatcggcgtttcccagatcgacggctgggtgtatgcgcccctggccctgcgctcgctggatgagccctacaccgtctacggcctggtagcagaaaagatggagcgcgccgacgacggcctgtcgctgcgcttttacctgaaccccaaggcgcgttttgccgatggcacgccgattaccgccgaagacgtgcgctacagcttcgacttgctgatgacccagggcagcctgcgctttcgcacgttgttcgccgacgtcaagcaggtcgaagtcgaaggcgagcaccaggtgcgctttgatttttccagcaacgagaaccgcaccctgcccctggatatcgccaccttgccggtgttccccgagcactggtggaagacccgtgactttgccaatggtggcggctacgaagccccactgggcagcggcccgtacaaggtcagcaagatcgactccggcagcaccatcacctttactcgtgatcccgactggtggggcaaggacttgccggtcagccgtggcctgtacaacttcgatcacctgagcctggaatacttcggcgacaccgaggtggcgcgccaggtgctgcgcggcggcgcctacgatttcaaccgtgagttttccgccaccggttactctatcggctacaacggcccggccctggacgatggccgcctgcaacgtgcgcacctggccaaggaaatgccgcaacctgcccagggctatgtgttcaacgtgcaaaaaccgatattcaaggatcgccgtgtgcgccaggccctggcgatgctgtgggatttcgaatgggccaatcggcagatgatgcgcaacctgtacatccgccagcagagctacttctccaacagcccgttggcggccactcagttgccgacccaggaagaactggcgatcctcgagccattgcgcgggcagatccccgacgaagtgtttacccaggtgttcaaggccccggtcaccgacggcagcggtatgatccgcgataaacaactgcaagccctggccctgctggaacaggccggctggaaaccgcttggcgacaagctcgtcaatgccgagggcgaaccgctggagttcaccttcctcaatgtccagaacggccttgagcgcctgttgctgccttacaaacgcaacctggcgcagatcggcatcaccctcaacatccgccgcatcgactcctcgcaatacgtcaaccgcctgatggcccgggactacgacatgatcgtcaccggttttccggtcaccacctcgccgggcatggagctgtacaactacttcggttccgccgccgcgttcgattcgggcgccaataactacatcgtgctcaaggatccggccgtcgatacgctgatcaatggtctggtcaaggccaatacccaggcgcagatgctcacctacgcccatgccctggaccgcgtgctgcaatggaattacctatggatccccaactactacccgcctggcacctccgccgcgtggtggaaccgtttcggccgcccggccatcgaggccaggaacgacgaagccctggaaacctggtgggaggtcagccccacgccgctgaccaatgagcaaatgcaagccgagctgaaaaaacgcggaggggcccgctgatgcttgcctatatcctaaggcgcctgctgctgatcattccgacgctggtaatcatcctgctggtgaacttcgtgatcgtgcaggccgcccctggcgggccggtagaacaggccatcgcccatctgcaaggcattggcggcggtggtgtcgccggcgcatccggcgaaggcatcagcggctcgcgggccagccgcggcctggacccgaagctgatcaaggacatcgaaaaacaatacggcttcgacaagtccgcgccggaacgcctgtggctgatgctcaagaactacgcccagctggatttcggcaacagcttctttcgcggcgcgacggtgaccgacctgatcctggaaaagatgccggtcacgatttcccttggcctgtgggcgacgctgatcacttacctggtgtcgatccccctgggcatacgcaaggccgtgcgccatggcagcagctttgatatgtggagcagcaccgccatcgtgatcggttatgcgatgccggcgttcctgtttgcgatgttcctgatcgtggtgttcgccggcggcacctcgctgaactggttcccggtgcgcgggctggtctcggaaaactttgccgagctgagtacgatgggcaagattgccgactatttctggcacctggtgctgccggtgacggcgctggtgatcggtgggttcgccaccttgaccatcctcaccaagaactctttcctcaatgaaatcacgcgccagtacgtggtcaccgcccgcgctaagggcttgagcgaacgccgggtgttgtacgggcacgtgttccgcaacgccatgttgctggtgatctcgggcatcccccaggcgttcatcagtgtgttcttcgccggctcgctgctgatcgaggtgatcttctccctcgatggcctgggtcgcatgagctacgaagccgccgtatcgcgggactacccggtggtgttcggttcgctgttcatcttcacgctgttcgggctcttgataaagctcatcggtgatctctgctacaccctggtggacccgcgtatcgactttgccgcgaggaacgcctgatgcctaacctgtctcccgtagctcgtcggcgtttcgagcggttcaagaaaaaccgtcgcggctggtggtcactgtggttgtttatcggtctgtttatcctgaccctgggcggcgagttgatcgccaacgacaaaccgctggtgctgagcttcaagaacgagctgtatttcccggtgttcaagcgctacaccgagcaacagttcggcgggcaactgcccttccaggccgactaccgcagtgactacgtgcaaaagctgatcaagcaggacggcggctggatgctgttcccgccgattccattcagcgacgacacgcccaactacgaattgacccgccctgccccgagcccaccgtcggcggtgaactggctgggcaccgatgaccaatcccgcgatgtgttggcgcgggtgatctttggcgcgcgagtgtcgatcctgtttgccctggccttgaccgccatcagtgccgccatcggcatcgccgccggagccttgcagggttactacggcggctgggtggacttgctcggacagcgcattctcgaggtgtggtccggtctgccagtgctgtacctgctgattatcctgtccggatttgtggagccgaatttctggtggctgctggggatcatggcgctgttttcctggctggccctggtggacgtggtgcgtgccgagttcctgcgcgggcgcaacctggaatacgtcaaggccgcccgcgctcttggcctgggcgacggcaagatcattcgccggcatatcctgcccaatgccatgaccgccaccttgagctatttgccgttcatcctcaccggggcgatttcgaccttgagcgccctggactttctcggcttcggcatgcctgccggcagtgcttcgctgggtgagctgatcgcccagggcaagcagaacctgcaagcgccgtggctgggcctcacggcgttttttaccctggcgctgattctgtcgctgctggtgtttatcggcgaggcgttgcgtgacgccttcgaccctcgctcatgagtaattgcctatgaacctgatcgaaatccgcgacctgtgcgtcgcgttcagcggccagaccgtggtgcgcaacctgagcctggacgtgcgccccggcgagtgcctggcgctggtgggtgagtcgggctcgggcaagtcggtgacggcccattcgatcctgcaactgctgcccgaagccggcacattgagcaccggctcggtgaagtaccgtggccaggagctgatgggcgcgtcgccggccaccctgcaaaagctgcgcggcaaccgcattgcgatgatcttccaggagccgatgacctccttgaacccgctgcacagcatcgaaaagcagatcggagaaaccctgctgctgcacaagggcctgggcggcaaggcggcgcaggcgcgcatcctcgaactgctggaactggtgggcatccagaagccccaggaacgactcaaggcctacccgcaccaactgtccggtggccagcgccagcgggtgatgatcgccatggccctggcttgcgagccggagctgctgattgccgatgaacccaccacagcgctggatgtgaccgtgcagcgcaagatcctgctgctgctcaagtccttacagcaacgcctgggcatgtcactgctgctgatcagccatgacctcaacctggtacgcagcattgcgcagcgtgtctgcgtgatgcgtgccggcgaaatcgttgagcaggccgactgccagacactgtttacggccccgcagcacccctacagccgcctgttgctggacgccgagccgacgggcgatacgctgtgcggtgatgagcgcgagacggtgttgcaggtggatgacctaagcgtgaaattccccctcagcggcggattgtttcggcgcaagacctacctgcatgcagtggacggcatcagcctcagcgtgcaacgcggcaagaccctggggattgtcggtgagtcaggctcgggcaaatccaccctgggccaggcgatcctgcgcttgctcgactccagcggcagcatccgcttccagggcgaggccctcgacccacttaaccatcagcagatgcgcccatggcgcaagcagatgcaggtggtgttccaggacccctatggcagcctcagtccacgcatgtcggtgcagcagatcatcagcgaaggcctggaagtgcatgcaccctgcagcctggccgagcgcgatgtgcaggtgatccaggtgctcaaggatgtgggcctcgaccccgccagccgacatcgctacccccatgaattctccggcggccagcgccagcgtatcgccatcgcccgcgccctggtgctcaagccggcgttgatgctgctcgacgagcccacatcggccctggaccgtacggtgcagaaacaagtggtggcgctgctgcgtgaactacaggacaaatacggcctgacctacctgtttatcagccatgacctggccgtggtccgcgccatggcccatgacctgatcgtggtcaaggatggcaaggtggtggagcgcggtgccagtcatgctgtgtttgaatcaccccagcatccctataccaaagaactgctggctgcagcgcacatccctttgtgatgattaacaggattctgcctccatgagcactagcctcaaggactaccagcaagtccgcggcctggccatccagtcgctgttcgagatcatcgagcagtccagcgaaggcacggtcatcgtcgaccgcgatgcgaatatcgtctggatgaacgagcgctatgccaagcgtttcggcctcaagagggccgatgaagccatcggccagccctgcgaacaggtgatttccaacagcctgttgcgccaggtggtgcgcaacgaccagccgatcctgctggatatccaggacacacccaaagggccgctggtggtgatgcgcctgccgatccacgacgatgccggcgcggtcatcggcgcgattggctttgcgctgttcgatgagctgcgcaacctgtcgccgctgatcgagcgctacctgagcatgcagcaggagctggcttcgacgcgctcgctgctgcgttcgcggcaaagcaaatacaacttcgcgcactttatcggcaccagcgccgccagcctcgaggtcaagcgccgggcgcggcgcagtgcgagcgccgagtcaccggtgttgctgctgggggagaccggcaccggcaaggaactgctcgcccaggccatccacggcgcgtcaccgcgggcgcacaaagcctttgtgagtatcaacagcgcggcgattccccatgacctgctcgaggccgagttcttcggcaccgcccccggcgcgtttaccggcgccgaccgcaagggccgccccggcaagttccaaatcgcccagggcggcacactgttcctcgacgaaatcggcgacatgccgctgccgctgcaaagcaaactgctgcgggtattgcaggaaaaggaattcgaaccggtgggttccaacgagatgctgcacagcgatgtgcgggtgattgctgccacgtccatggacctggaagccgcgatcaagcgcggcgagttccgtgcggatttgtactaccgcctcaatgtactgcccattcaagtgccgccgttgcgcgagcgcctggaagatataccggcgctgagcgaggcgattctcgaagagctgcgcagccagcatgagcttgatcgtgatgccttggcgttgttggcccagcatgcgtggccggggaatatccgcgaactgcgcaatgtgttggagcgggcggcgttgttgagtgatgacctggtattgaacgccagtgagattcgcgcagcgattggcacgttcagcccggtggcccgtggcacggtggcggcggtcgaggatgaaacgttcgcggcggcgcgggagcggtttgatcggcaggtgattggtgcggcgttgaggatgtgcgaaggcaatgtggtggaggccgccaagcggttggggctggggcggtcgaccctgtacaagaaaatggtagcgctgggcctcacccattctccaaattgagacagcaatctcaatacaaagacaatccaatgtgggagggggcttgctcccgatagcagtgtgtcaggctgagcatctgtacctgacccactgctatcgggagcaagccccctcccacattaggtaattgtttgtctccaaatagagataaaatttcaaagtgctgttaaagatcctgaaaatattgttgtttttcaattagttaaaaatatggcacacatctagctatagcctctctcaccgtttcacccacaacaataacaatccgatggagacacaccatgagtgtgatcattgccctggctgcgctcgcgctgctgatgctggcggcctaccgtggctatagcgttatcctgtttgcccccattgccgcccttggtgcggtgctgctcaccgacccgtccgccgtggcccctgcctttaccggggtgttcatggaaaagatggtgggctttatcaagctgtatttcccggtgttcctgcttggcgcggtgttcggcaagctgatcgagttgtcaggtttctcacgttccatcgtcgccgctgcgatccgcttgctgggcacgcgccaggcgatgctggtcatcgtgctggtctgcgccctgctcacctacggcggcgtgtcgctgttcgtggtggtgtttgcggtgtacccgttcgcggcggagatgttccgccaaagcaatattcccaagcgcctgatcccggcgaccatcgcccttggcgcgttctcgttcaccatggacgccctgcccggcacgccgcagatccagaacatcatccccagcaccttcttcaacaccactgcctgggccgcaccgtggctggggttgatcggcacgatctttgtgttctgtgccggcatgctctacctggcgcgccagcgcaacaaggcccagcgagccggcgaaggttatggcaccgagctgcgtaacgagccggagacggctgaaaacctcaccctccccaacccctggatcgcgctgtcgccgctgatcctggtgggggtgatgaacctgctgtttacccactggatcccgcagtggtacggcaagacccacagcctcagcctgccgggcatgagcgcgccggtgaccaccgaaatcgccaagctcaccgccatctgggcggtgcaggcggcgttgctggtggggattatcgtggtgttggtgttcggcttttccgcaatcaaaagcaagctggccgaaggcagcaagagcgcggtaagcggtgcgttgctcgccgccatgaacaccgcttcggaatacggctttggcgcggtgatcgcctcattgccaggctttctggtactggcggactggctcaagggcatccccaacccgttggtcaacgaagcgattaccgtgaccttgctggccggtattaccggttcggcttccggcggcatgagcatcgccctggcggcgatgtccgagagctttatttcggcggcccacgcggccaatatcccccttgaagtgctgcaccgggtcgcggccatggccagcggcggcatggacaccctgccccacaacggcgcggtgatcaccctgctggcggtcaccgggctgacccaccgcgaggcctacaaggacattttcggcatcaccatcatcaagaccctcgcggtgttcgtggtgatcggtactttctacgccactggcattgtgtgaggttttcatgacgactttgaatggcaagaccgccctggtcaccggctccaccagcggcatcggcttaggcatagccttgagcctggccaaggccggtgccagcctgatcctcaatggcttcggcgacgccagcgcggtgatcgcccaggtgcaggcgtttggcggcaaggtcgggcaccacccggcagacgtcagcgacccggcgcagattgccgacatgttcgcctacgccgagcgcgagttcggcggcgtcgacatcctggtcaacaacgccggcatccagcatgtggcggcggtggaagactttccagtggaacgctgggactcgatcattgccatcaacctgtcctcggtgttccacagcacacgcctgggcttgccgggcatgaaggccaagggctgggggcgcatcgtcaacatcgcctcggtgcacggccaggtcggctcagtgggcaaggccgcgtatgtggcggccaagcatggggtgattggcctgaccaaggtggtgggtttggagactgccaccagcaacgtgacctgcaacgccatctgcccgggctgggtgctgacgccgttggtgcagaagcagattgacgaccgggtggccacgggggtcgacccgcagcaggcgcagcaggatttgctcgcggagaaacagccgtctctggagttcgtcacgccttcgcaactgggcgagctggtgttattcctgtgcagcgaggccggcagccaggtacgtggcgccgcgtggaatatcgacggcggctggctggcccaataaccctcccagacaccggagatcaaaatgtgggagggggcttgctcccgatagcggtggttcagttacagacgtttgcctgacacactgctatcgggagcaagccccctcccacattggaactctattgtttggaagacctgtacaagaacaagagatttcgctatgtccgacatcctctggcaaccctcccccgaacgcatcgccaacacgcggatggaccagttccggcgctttatcaatgatcgccacggcctgcagctccacgactaccctgccctgcaccaatggagcatcgaccagcgcccggacttctggcaggcgattgtcgcgttcttcgacgtgcaatttcgcagcccacccaccacgaccctggtcgagggcgctgaaatgcccagcgcccagtggttccccggcgcgaccctgaactttgccgaacacttgttgcgccgccgcgacgatcaccccgccgtggtggccatcagcgaggacggccagcgcgaacaactgagctatgccgaactggccgcccacgtcgccggcctgcaacgcagcctgcgggcggcaggtgtgggcatcggcgaccgggtggcggcgtgcatgcccaacacctggcaaaccctggtgggcatgctggctaccaccagccttggtgcaatctggtcatgctcctcgccggacttcggcacccagggcgtgatcgaccgcttcggccagatcgaacccaaggtgctgatcacctgcgccggctaccgctatgccggcaaggccatcgaccagagcgccaagctcaatgaaatcctcgaacgcctgccgtccctgcaacagttgatcatcgtgccctacacccagcctcaggcgcgggtcggggactaccgcacccaagcccgggtcgcgctgtggaacgacttttaccaagccggtggcgagcccgaatttgtcgcggtgcccttcgatcacccgctttatatcctctattccagcggcaccactggcgtacccaagtgcatcatccatggtaccggcggcgtgctgctcacccacctcaaggagcacggcctgcatgccgacctcggccgcgaggactgcctgttctactacaccacctgcggctggatgatgtggaactggctggtgtcggtgctggcgctcggggccaccgcggtgctgtacgacggctcaccgtttcatcccggccctgagcgcttgatcgacctgatcgatgcggaaaaaatcagtgtgttcggcaccagccccaagttccttgcgaccctggagaaagccgggttgcaaccgcgcctgagccacgacctgagcagcctcaagggcctgatttccaccggctcgccgctgtcgccccagagttatgactatgtgtaccgcgagatcaaggccgagctgtgcctgtcgtcgatgtccggcggtaccgatatcgtctcctgctttgtgattggcaatccggtactgccggtgcggcgcggtgagatgcagtgcaagagcctggccatggccattgaagtatgggacgaccagggccgaccactgcttcgggagaaaggcgaactagtatgcacccggcactttcccgccatgcccatcggcttgtggaacgacccgcaccagcaaaaactacgcgcctcttatttcagccagtttcccggtgtgtgggcccagggtgactacgccgagcaacgcgccaatggcagcctcttgatccacgggcgttcggacgcggtgctcaaccccggcggcgtacgcatcggcaccgccgagatttatcgccaggtggaaaaactcccccaggtgctggaaagcctcgccatcggccagcgctggcaggacgatgtgcgcgtggtgctgtttgtgcgtctcgatgatggagtcgagctggctgaggcgctgcaacagcagatccgccaggtgatccgcgccaataccacaccgcgccacgtaccggccaagatcctcgctgtcacggatatcccccgcaccatcagcggcaagatcgttgaattggccgtgcgcaacgtggtgcacggggagccggtgaagaacaccgatgccctggccaacccccaggcgctggaccagtttcgcaatcgggctgaactggattattagatgaaaggtttcagcgctgacgcagcgttttgaagaaaaaccctcaagacatgttatttttcgggggtagtcacccgttgttatcccttgggacaatgggtgttgtcatatttcaaagcgtcatgctcagggctttttcatgaatggaacatccaccggtagcgaagccgctgcattgatcaagcggctggactgggcgcaaagccccctcggtgaggccactgattggccgcagagcctgcgcaccgccgtcgatatcgtcgtgcattccccgatgccgatggtgctgctgtggggcccgcaactcactcaactctacaacgacgcctttgccctgctggtgggcaacaagcaccccggcgcccttggccagccggcgcaccatacttggcctgagctggaaagcttcgccgggccggtctacgacgcggtcctcagcggccaggtgcgcaccttcagcgagcagcgcttcgtggtgcaacgccagggccgcgacaccgacatctggctcgacttgacctacagcccggtgcgcgatgaaagcggcctggtggccggtatcctggtcaccgccatcgaaaccaacgagcggcgcagcaaagccctcgaactgcagcagcgctccgaagagagcctcaaggcccagcacagcaccgagcagcgcctgcaactggccctggcggcgaccgatgcggtaggcacctgggattgggatatcggcgaagaccgctttatcgccgacgcccatttcgcccacctgcatggcgtcgaccccaatgacgccggcctgttgcccatcagtgcctacctgcaaggcgtgcaccccgaagaccgtggcatggtggcgcgcagcatcaagcattgcatcacctttggcaccgaatacgccgaggaataccgcctgctgcaagccgacggccaagtgcgctgggtgttcgctcgtggccgctgctacaaggatcagcagggccgccctgcgcggttcctcggcgccgcgctggacctcaccgagcgcaagcacaccgaacaggccctgcgccaaagccagaccgagctgcaattgatcatcaacgccatgccggtgctgatcggttatgtcgaccatgagcagcgctttcgcctcaataacagcgcctacctcgactggtacggcatgaccccccaggagctgtacggtaagaccatccgcgaagtgctcggcgacgaggtgtatgccgggcgcgcagacaagatcgaagccgccctcaacggcaaggcgtgcagtttcatgaccatcacgccccatcgcgacggtcgcccgcgccacgcgctgatgaagtacctgccgcgcttcagcaacgacggctcggtcaatggtttctacatctttgtgattgatgagaccgaacgcaagctcaccgaagaagcgctgcgccatctcaacgaaaaccttgaagaacgcgtggcccagcgcacccaggccctggccgaagccaaccagcgcctgcaaaacgagatgttcgagcgcgagcgcgccgaagatgccttgcgtcacgcgcaaaagatggaagcggtgggccagctcactggcggtatcgcccatgacttcaacaatatgctcaccggcatcatcggcagcctcgacctgatgcaacgctacatcgccgccggacgcagcgacgatatcggccgctttgccgacgccgccgtcgcctccgcccaccgtgccgcggccctcacccatcgcctgttggcgttctcgcggcgccagtcgctggaccggcgccccaccgatcccaaccagctggtggcgtccctggaagacctgttccagcgcaccaagggcgcgcatatcacactcaatgtgcgattgggcaaggacatctggccggtgaacaccgacgccagccaactggaaaacgccctgctcaacctggtgatcaacgcccgcgatgccatgcccgatggcggcgagttgctgatcgaaaccgccaacagctatttggacggcaccgacatcaccaccctggagccggtcaaggccggcgactatgtgatgctcggcgtgagcgacaatggcagcggcatggcgccgaaaatcctcgccaaggccttcgatccattcttcaccaccaagcccatcggccaaggcaccggcctgggattgtcgatgatctatggatttgcccagcagtctggaggccatgtaaccatccagagcgaaccgggccagggcacctgtgtgcgcctgtacctgccacgcctgtatggcaccgcgctggaaagcaacctgcccgccagcctggccgaagcccccgtggcccaggccggtgaagccgtggtggtggtcgaggacgacccggcggtgcgcatgctggtggtcaacgtgctcaatgagctgggctataccgcccaccaggcggcggatgcccgcgcggcgctgccgctgctggagtcggacctgcgcgtcgacctgctggtgaccgacgtcggcctgccgggcatgaacggtcggcaactggcagaaatcgcccgccagcatcgcccgggcctgcgggtgttgttcatgaccggttatgccgagaaagccgctgagcgccaaggcttcttggaagacggcatggacatggtggccaagccgttttccatcgacctgctggccactaaaatccgcagcatgctcggcgtcgagacatgagttcaggcataatcgcgcgccgtcgcacagctggtagagaccaatgaaagcccaagcccgtcatattctggtgaaaaccagcgaagaagccgaacagctcaaacagcgcattgccaagggcgaagcctttgatgtgctggccaagaagtactccacctgcccgtcgggcaagcgcggcggcgacctgggtgaagtgcggccagggcagatggtgggggcaattgatgcggtgatcttcaagaagccggtgaaggtggtgcatggaccgatcaagagcaagttcgggtatcacctggtgcaggtgttttaccgggactgatgggcttggctttcagccctcatcggggcaagccccctcccacacttgaccctgttccaactgaaggaatgcagtttaatatgggagggggcttgctcccgatccgccccaggcggccattcacctcggtatcaaagcccccgacacctgaatcacccgactcgccaaccgatgccccgccaaggcagcctcttgcggcgactcacctttaagccgcccagccaaataccccgcactgaacgaatcccccgccgccgtggtgtccaccaccttctccaccttcaacgccggcaccacgaaacgctcccccgcacaacgaatcagacaggcatccgccccacgcttgagcaccacctctgcaatcgatggatacgccgaaaacacctgctcgctgtcctgatagccaaacaacgcaaactcgtcatcctcggtcaacaaggcgatatccacttcggccagcaccttgctataagcctcacgggccgctgcgacatcagcccacagccgtggccggtaattgttgtcgaacaccaccctgccaccccgacggcgggtttgcaccagggtttgcagcaggcgcccgcgccccaccgctcccagcaccgccagggtaatgccgctgaaatacaccacgtcataatccggcagcgccgccagtatcggctcggccgccggcgtggtgaagcagtcgcgcaccgccgcttcgttgcgccaatacagaaatttgcgctcgccattggcatcggtctggatgcaatacaagcccggcaggcgtccgggcaggcgctggaccatgcccaggccaacgccctcttcgagccattgctggcacatggcatcgctgaaactgtcatcgcccaaggcggtgacatagtcgacgctgccgacctcgcccagttcgcggcgcaggtacaccgccgtgttcagggtgtcgccaccgaagctctgatgcaggctaccgtcggcgcggtgttgcagttcgatcatgcattcgccgataagggcgatacgcggttggttggtcatggctgcggtctcggtggggctgatggtctcatcgggggcaagccccctcccacaggggaacgcattccaaatatgggaagggcttgcccccgataggagcgactcggtctagaaacaggtacgcagggactcgaccacctgcaactgctcatccaccaggcagcccagctgccatttgtcgaaggtcaggcaagggtgggaagtaccaaacgaaatgatgtcgccaatgcgcaactcaacccccggtgccacggtcatgaacgcatgctggtccatcaccgccgtgaccttgcaggcactcacatcatcgccttgggccggcacaatcccggccttgtagcgcttgagcggcaccggcaaaccggcgtcataagccacatcgcgcttgcccagggcaaccaccgcaaagcccggctccggcagcgactgcacatgggcccagacttccagcgccgggcgcaggccttcgttgaggtcgctgcggcgctcgagcacacagcattgggcttctttgtagataccatggtcgtgggccacatagctgccggggcgcaatacactgaggaaacgcccggcggcattctgcgcttcgaacgactcggcgatcaggtcgtaccaggccgagcccgaggccgtgacgatcggcttgggcaggtcgaacaggccgttgtcttgcaagtccaccgccaggcgcaccaggctggcggcgaagtcacgaatgccgctgatggcgtgctcaccgtggatcaccccttcgtagccttcgataccggtcagggccagcgcgggctgggccttgattgccttggccagctcgcgcacctcctgctcgctacggcaaccgcaacggccgccgaccacgccgtactcgatcatcacgttcaggcgcaggccacgggcggcgaagaacagtcccaggtcggcgacgttatccgggtgatcgaccatgcaatggaagtcgaaatccttgtcggccagtagctcggcgatcaacgccatgttcggcgcgcccaccagttggttggccatcagcacgcgacgcacgccaccggcgtaggcggcacgggtctgcacggcgctggccagggtgatgccccaggcgccggcgctgagctggcgctggaacagcgcgggcatcatgctggtcttgccgtggggcgccagctcagcgccgctgcggctgacaaagtcctgcatccagcgaatgttgtgttccagggcgtcgcggtgcagcaccagggccggcaggctgacgtcgcggaccaagtgggcaccgatagcggcggcgcctttttcaacggcattgagggcagacatggaaaactcctattcgttgatacgccgggccaggctgttggcgctgtcgatcagcacccggcgatagtcgtggtagtttttgctggcatcggcccggggggcgacgatgcacagggtcgcaatgctgacgccctgggcgtcccgcaccggggcggcaaagcaatgggtaaaggtgtcggccacactgtcgaaggaaaaaaagccatcgagggtggcctggcggatctgtgccaggaagatgtgcaacggcaggcgctggccgtccggcaggatgaaatcgtcggggtcgatcaggtcgatgatctgctggtcgctcaaatgcccgagcagcaggcgcccggaagcggtccacgggatcggcgcgttttcaccgatatccgaagaaatcctgaaatgccgctggccctcgcgcatcagcgccaccgtgtatttgcgcccattgagcaagcacatctgcgcggtttcgtgggtctggctgacgatgtcctgcagggcatggtcggcctcgcgggtcaggtcgaagtggcgcaggtgcgcctggccgagaaaatacagctggcggcccagatacacgtgaccgtccttgcccacggtctccaaaatgcgccgttcgagcaacgaagcgaccagctcatagaccgttgattttgggctgccgatgccgctggcaatgtcattcgggcgcaggggctggccgatctccttgagaaaatcaaggatatcgaacgcacggtccaggcctttggcgcggcgcttgatgaggtcttcggtcatggcggactcggtcccgagtggtatgaagtcttctgtaggagcgagcttgctggcgaaaaacttcaggacaacgcgttcatacagaatacccgcgtcatcattgacgatcttcgcgagcaagctcgctcctacagggtttgaatattcagccctttttcttgtaggccacgcaatcgatctcgaccttgcaatcgaccatcatattggcctgcacacaggcccgcgccggggcgtgttccggggtgaagtattcgccgaagaccttgttgaaactccagaagtcccgtggatcttccagccacacgcccacgcgcacaacatccttgagctcatagccggcttcttcgaggatcgccaccacgttgcgcatggtctgccgggtttgctcgacgatgccgccactgatgatttcgccatccaccgccggcacctggcccgacacatacagccagccatcggcctccaccgcacgtgcgaacgggcgtggctggccaccacctgcggtgctgccggtaccgtaacgagtaatgctcataaaagttgctccttgttaaaaacgaatgttctttaaaaattccgccagtcgcggcgactgcggccgctcgaagatatctttggcggtaccctgctcttcaatgcggccctggttcatgaagacgacctggtccgaaacttcataggcaaagcgcatttcgtgggtcaccagcaacatggtcatgccctcttccgccagccccttgatcacgctgagcacttcgcccaccagctccgggtccagggccgaggtgacttcgtcgaacagcatcaggctggggttcatggcaatagcgcgggcaatcgccacgcgctgttgctggccaccggacaattggcccgggaagtggttgcgccgctccagcaggccgacgcggtccagccacttttcggccagggccacggcttcatccttgcccatcttcttgaccttgagcaagccaagggtgacgttctgcagcgcggtcagatgcgggaacaggttgaattgctggaacgccatgccggtcatggcgcggtgctgggcaatcacccgctccggatggcgcacgcgcttgccgccgacctcgcggtagccgatggactcgccatccagggtgatctgcccgccttggaattcttccagcaagttcacgcagcgcagcaaggtggtcttgcccgagccgctgaagccgatcaaggtcactacattgccgcgctgcatggacaggtccacgcccttgagcacttccacctcgccgtattgtttacgcaggccgcgaatagccagcagcggttggttggtttgagcttggttcatggcaaggccacccgcttttcaatgtagcgcccgaataattcaatggcgtagttgatgacaaagaacagaaacccggcgaacaggtagaactccagggtcatgaaggtgcgtgcgatcacctgctgggtactgagcagcaattcagccacgccgatcaccgacagcaaggtcgaggccttgacgatttccgtggaagaattgacccaggtcggcaggatctgccgcagcgcctggggcaacagcacgtagcccagggactggtaaaacgtcaggccaattgccttgcctgcttccagctgtccacggggaatggcttgcagcgcgccgcgcacgatttccgacacatgggagccacagaacaacgtgagcccaaccgcaccggcctggaatgcgctgatgtgccagccgagcgccggcagcatgtagaaacacgccagtaccagcacaaacaccggtgtgccccggatcaaatcgacgtacaggcgaaacggcgcgcgcatccagaacttgccgtaggtcaggatcaacccggcgacgatgccgatcagggtgccaaagataatcgccagggccgacacgtatacactggcctggaagccggcccagagcgtatcgcgggcgacccataattcatgcagccaactgggggattcgtacatggaaaccctccttaacgacggatcgccagacgctgctcaaggtaacgcagcagcatggcaatgaggtagcaggcagccacgtagagcgcagtcgtgaccagccaggtttcaatcacccggtagctttcgacgttgatcttgcgggcgtaataggtcagctccggcaccgcaatcgcagcggccagggaggtgtccttgaacagcgagataaagttgttcgacagcgccggcaacacgttgcgcaacatcaccggcacggtgatataggcgcggatccgccactcgccaagtccgatggccagcccggcttcgcgcaggcccttgggaatattcagtagcccggcgcggaacacttcggtcaggtaggcaccggcgtagagcgacagggtgatgatgaacgagggaatcttatccaggcggacccccagggacggcaaggcaaagtagatcaacaggatcagcaccaggatcggcgtattgcgcacaaccgtcacgtacaccgaagccaggatgcgcaacgcgcggtgccgggacagcatggcaaacgccatcagcaggccgatcacgcagccgatggcaatcgacagcaacgccaactgcaggcccaggccgagccccgccagcaaggtgtcgaaatcacgccagacggcggcaaaattcaactgatagttcatggttagcaatacctgagtggggcgtgttcaggcacgcccctattgttgcggatcacttgaattccacgggaaaaccaatcgccggttctggcaggtccacgccaaaccactgcttgaatgaagctttgtaggtggggaattccacaccggtcatggcttcgtgcagcgcggtgttgacgaagttcagccaatcctggtcgccgcgcttgaccgcgcacgcgtaggtttgcgggctccaggcgtatgtggggctgcggtagcggccagggttctgcaccatcaggtatttgaccgaagactggtcggtggcggcggcatcggcgcgaccggagttcacggcctggtacatcaggtcgacgctgtcgtactggtcgaccttggccttgggcagcgcctggtgcacgagctcttcggcatacacgttttgcagcacagccacagtgacgtcatcgcccgccgcctgcaggtcttcgatttccttgtacttgctgttgttcggcagcaacaggccgacaccttcgcggtagtacggcagggtgaaggccacctgctgcgcacggctggcggtgacggtgatgaactggcagctcatatcgaccttgtcggtgagcaggttgggaatgcgtgcgtcggacgactgcaccacaaactcgaccttgctcgggtcattgaacaaacccttggccaccatgcggccgatgtcgatatcgaacccctgcaacttgccgtccgctccctggaagtgccacggcgcattagtactgcctgtacccacgataaggtgcccgcgcttgagcacatcatccagcttgctgtccgccgcttgcaccatgcttgtgaaggaagccgatgcggcaacaagaaatacacacgctttgaatacggaaggtcggtgatgcatgacaagcactccagggattgtttattccgctataccggaacttggtatgtaacaacggaatagacagcagaaagtgtgccacagccacggcaggaaaaatatgctgtcaggaaactctttatggttcagtaagataggtattgaagcgcttaacggcgttgcgccgaaagcgtagggttttgctacgcaacgccccacaacggtgttactgcgcacctatctgggtgcctggatgacgctccagatgcaaggtgcgtgaagacggccctgtgaaggttgacagtagacctggacgattttccgacttagcgtgagccatggagtgacaggagatgcccgatggactacgtcaatgcagtgatcgcagataaggcgcaatttgaccgcgaactcgatacgaagcagcccgtattcgttgtattcatttcccatggttgcgcggcatgcactgatgcgatgccacgctttatgcggataagccaacggtacgagaaccaggtcaagatcatgatcctcgattgcgccgaaacaccgcgccatccaagcgtggaccggattccaatgctgctgatctaccaggaccaacagcttcaggaaaccgttcccggactcggcgagcaagcgcttgaagacgcgttcaagcggttcgctcgccttcagatcaaggggccgttagcggcgacaaacaaacctgcgtcaccctccgctcttccaccgcgaccacagtcaggcgccacccctcgtattcaagactatcgcccacaaccggcaagcgatccaacaggctcatcaccaggccggccagggtctggtaatcttccgtcgccacggccttgaagccggtgcgtcggctcacctgattaagattcaaggcaccattggcacgaaagcccgcgccctcctcgacaatgtccgggccttcgatttcactggcatcgggcaattcaccggcgatggattccagaatatcggtcatgctcaacacgcccatgaagtccccgaattcgttgatcacgaaggcgatgtgggtggactcctggcgcatctgctcaagggcattgaggatcgaaaagctctccagcaggttgattgcccggcgcgccaagtgctccaggttcggctcgttaccggccaggtattccttgagcagctctttcttgtgcacaaagcccaggggctcatccaccgcgccattgcggatcaacggcaggcgcgagtaggacgaatgcatcaacttcaggcggatagtctcgggatcgtccgccaggtcgatgcagtcaaccttggcccgaggcgtcatcaaggagcgaatcggccgctcggccagttgcagcacaccgctgatcatcacccgctcgcgtcggtcaaacagcggaccttgggctgcatccggctcgcccaacagatcagcgacatcctcacccacctcctccaccgccaggctgcgcccgcccaataagcgcattaccgcatgggcagtacgctcacgcacgggcagcacaccctgcgccgacttcttgcgccgcgaccgggcgatctggttgaacagctcgatcagaatcgagaagccaatggccgcgtacaggtagcccttcggaatatggaagcccaagccttcggcggtcagggcgaaaccaatcatcatcaagaagcccaggcacagcatgatcaccgtggggtgcgcgttaacgaagcgggtcaacggcttgctcgccacgatcatcaggccgatggagacgatcacggcgatcatcatcaccgccaattcgtccaccatgcccacggcggtaatcacagcgtcgagggagaacaccgcatccagcaccacaatctgcgcgacaatcggccagaacatggcgtaggccacactgcccttgtgctgggccacgtggccctcgaggcgctcatgcaattccatggtggccttgaacaacaggaacacaccaccaaacagcatgatcaggtcgcgaccggagaagctcttgtcgaacacctcgaacagcggctgcgtgagggtcaccaaccaggaaatactcgccaacaggcccaggcgcattaacagtgccagggacaaaccgatcaaccgcgcacggtcacgctgttccggcggcaacttgtccgccaggatcgcgataaacaccaggttgtcgatacccagcaccagttccagcacaatcaaggtcgcaaggccgagccaggccgttggatccgctaaccattccatttatagagtctctgtattcaagtgttcagaatgccggacacggcaatgcgcggtcagtggaccgggccaaggttagcagtcggaatacggggtgcttcagggggaacgacgacagtggtggtcttggggaaagacgactgggaggctccgagagggtgttcatgcaagtcctgagataacaaagggacttgaatcctacagcccaaatacacaattcccacatagcaaactattacaaaacctgtctcccagactcccacacaagcccccatcccacatttggaacggtgtggtatcaggactttcgggtggcatcatccagggccaggatggtgtgggcattggtgacggttgtcgccagcgtattgatcacccccgagcgcaacgcccccaacgtcgccgccgccttggtgttctcactggcaatcgccaccacatccgggatgcggaacagctcctgcacggtcagtcctatcacccgaccctggatggcgttgaccgcgggctggccgtgaatgtcgataaagtcatagcccatcatgtcgcccacggtgccggataaccgcgcctgggcaatctcctggggcgagaaccagcccatgcgcaccatgttgctgttctcgctcatgtcaccgatgccgatcagggcaatgtcggctcgccgtgcacggtcgagggtggagcgcaccgtgtcgttattgatcagcacgccgcgcagttccgggttggccaccagcgccggcgcgtacaggctttcgctctcgccgccaaagcgcagggccaggcgccggcagatatggtcggggttcatgtactcgccggccttgagcgaaccgccaatggcacacacaaatgtacaattgcgcgtcaccggcagaaagacgttgtcggccaccgcgccgacgttacggcccatgccgacggcgacgatcatgccgtcaccgagggtcttgttcaggtagttggccaccaggctggcgaccgccgagcgttgggtgtcagggtcgctgtggtcgaccgcgatcaaggcgcggtcaagtttgaagcgctccaccagcgccctctccagctcgttgttcatcgccgggtgctgcaacacgcgcacctcgacaataccttcatcccgcgcgcgcttgagcaggcgactgacttttgcccgcgacagatcgaagcgtttggcgatggcctcctgagtgacgttctcaaggtaatagagcatcgccacttcggtcatctgatcgatatcactggccatgcgctgggtactgtcactcatggggacgggcttccgtttcggcgtcaaaggcgcattctcccgactcttgccccgtgccgtccactactgatgcccatcgcgctcgatcgcattgatgcgttcgaccttggcccccgaacgcgccacctcgaactccgaggccagaaacgcagtgacgatgctcttggccagctctgcgccgatcacccgcgcaccgatggacaggatctgagcatcgttgctcttgcgcgcccgctccgccgaataggtgtcatgggcctgggccgcacgaatacccatcaccttattggctgagatggccatgccgatcccggtgccgcacaccagcacgcccaggcgctgctgcccggcattgatggcattggccacagccagggcgatgtccgggtaaagcactggcgcggtggagtgagtaccgaagtcggtcaccgggtaacccagcgcctcgatatggcgcctcaacagttctttaagctcaaaacccgcttcatcgcatccgatagccaccgggaaaggtgtgttcatagcgtctggctccgctgccgagatcctgattaagactgatcatatgatcactcaatgaaatttcgctcagtcatttcgcgggcattttaccttctatgtcaagcttgatttaactgacctcccagtcaatgctgctcaaaaagccgataacgtcgctaaagatgagaatcatcgcttttaagtgaaagagattgactgatcagaatttcatttgatacacatatgctcacagcgaaacatgactgtgcgacctaataagaattcacagcacgaggacacgccgatggccacgccattactgctccaggctgaacacgtcgccaaggcttacgccggggtgcccgccctgcgtgacgggcgcctttctctgcgggccggcagcgtccacgccctgtgcggcggcaatggcgccggcaagtcgaccttcctgagcatcctgatgggcatcacccagcgtgacgccggcagcatcttgctcaacggtgcgccggtacagttcaaccgcccgagcgaagccctggcggcggggatcgcgatgatcacccaggagctggaacccatcccctacatgaccgtcgccgaaaatatctggctgggccgcgaaccacgccgcgccggctgcattgtcgacagcaaaaccctcaatcggcgtacccgcgaactgctggaaagcctggagttcgaggtcgacgccaccagccccatgcaccgcttgagcgtggcgcagatccaattggtggaaatcgccaaggcgttcagccatgactgccaggtgatgatcatggatgagcccacctcggccatcggcgagcgcgaggccgaaacgttgttcaaggccattcgccgcctcaccgcccgcggcgccggcatcgtgtatgtgtcccatcgcctgagcgaactggcgcagatcgccgatgactacagcatcttccgcgatggcgcctttgtagaaagcgggcgcatggccgatatcgaccgcgaccacctggtgcgcggtatcgtcggccaggagctgacgcgcatcgaccacaaggtcggccgcgaatgcgccgccgacacctgtctgcaagtcgacagcctgagccgcaacggcgagttccacgacatcagcctgcaactgcgccagggcgaaatcctcggcatctatgggctgatgggctccgggcgcagtgagttcctcaattgcatctacggcctgaccgtggcggactccggcagcgtcaccctgcaaggcaagcccatgccgatcggcatgcccaaggccaccatcgacgctggcatgtccctggtcaccgaagaccgcaaggacagtggcctggtactgaccggcagcatcctctcgaacattgcgctgtcggcctacaagcgtttgtcgagctggtcgctgatcaacgcacgcaaagaaacccagctggccgaggacatggtcaagcgcctgcagatcaagaccagctccctggatttgccggtggcatccatgagcggcggcaaccagcagaaagtggtgctcgccaaatgcctgtccaccgagccggtgtgcctgctctgcgacgaaccgacccggggcatcgacgaaggcgccaagcaggagatctaccgcctgctcgaccagttcgtacgggctggcggcgcggccatcgtggtgtcgtcggaagccccggaactgctgcacctgagcgatcgcatcgccgtattcaagggtggccggctggtgaccatcagcaccgacaccgccctttcccaggaagccttgttgagtcttgcctcatgaatgccaaaaccatcgccgcacctattactaccgccccacgcagccgcctgcgcctgtccctcgaccgtttcggcctgccgctggtgtttattttgctgtgcgtggtgatggcgttttccagtgaatactttatgacctggcgtaactggatggacatcctgcgccagacctccatcaacggcatcctcgccgtgggcatgacctatgtgatcctgaccaagggcatcgacctctctgtgggttcgatcctggcgtttgccgggctgtgcagcgccatggtcgccacccagggttacggcctgctggcggcagtcagcgccgggatgtttgccggggcgatgctcggcgtggtcaatggatttatggtcgccaacctgtcgatcccgccgttcgtggcgaccctgggcatgctcagcatcgcccggggcatgacctttatcctcaacgacggcagccccatcaccgacctgcccgacgcctacctggccctgggtatcggcaagatcggaccgataggcgtgccgatcatcatcttcgccgtggtcgcactgatcttctggatggtgctgcgctacaccacttacgggcgctatgtgtacgcggtgggcggcaatgaaaagagcgcacgcacctccggcatcggcgtgcgcaaggtgatgttctcggtgtacgtggtctcgggcctgctcgccggattggccggcgtggtgctgtcggcacgtaccacctctgccctgccccaggccggggtttcctacgagctggacgcaattgccgcagtggtgatcggcggtaccagcctgtcgggcggcaccggcagcatcgtcggcaccttgttcggtgcgctgttgatcggcgtgatcaacaacggcctgaacctgctcggtgtgtcctcttattaccaacaggtcgccaagggcctgatcatcgtgttcgcagtactgatcgacgtgtggcgcaagaaaaaacgctgaagaacgaccgataacaataactggagttcgacttatgaaactgggtaccaccttggccgctgcggcggccctttccctgctcgccagcagcatcgccatggctgccgatggcaagacctacaagatcggcgcagccgtctacggcctcaagggccagttcatgcagaactgggtgcgtgagctcaaggaacatccggcggtcaaggatggcaccgtgcagttgaccgtgtttgacggcaactacgacgccctgacccagaacaaccagatcgaaaacatggtgacccaacgctacgacgcgatcctgttcgtgccgattgataccaaggccggtgtcggcaccgtcaaggctgccatgagcaacgacgtggtggtcatcgcctccaatacgaaagtagccgatgccaacgtgccgtatgtcggtaatgacgacgtggaaggcggccgcctgcaggctcaggccatggtcgacaagctcaacggcaagggcaacgtggtgatcatccagggcccgattggccaatcggcgcagatcgaccgggaaaaaggcgagctggaagtgctgggcaagcacccggatatcaagatcatcgagaagaaaaccgccaactgggaccgcgcccaggccctgaccctcactgaggactggctcaacgcccaccccaagggcatcaacggtgtgattgcacagaacgacgacatggccctgggcgccgtgcaggccctgaagtcccacggccttacctccaaagacgtgcccgtgacctccattgacggcatgccggatgcgatccaggcagcgaaaaaagacgaggtcaccaccttcctccaggacgcccaggcccagtcccagggcgcgctggacgtagccctgcgcgccctggccggcaaggactacaagccgcagtcggtgatctgggagcgttatgccaaggacgtgaaatggggtgaaggcacggccaagaactacatcctgccatgggtgccggtgaccaatgccaatgcggatgctctgtacaagcaagtcagcggcggcaagtaatccacgcccctgtaggagcgagcttgctcgcgaaaaacttaaggacgccgcgttcagtcaggttacccgcgtcatcgttgatgctcttcgcgagcaagctcgctcctacattaatcaatggagtcattcatgtctggattctggaaccaagccttcgacctcagcggccgttgcgcggtcatcaccgggggcgctgccggcatcggcctggcctgcgccaccttgctggtggaacgtggtgcgcgggtggcgctgctggaccgcgatcctgcagtggtcgaggtggccgcccgcctcggtaccgggcacctgggcattgccgtcgacctcgggaagatcgaccagatacaaccgactgtcgaccacgttttcgctcacttccaacgcctggattacctgatcaacagcgccggcgtggtgctgctggacaaggccatcgaggtcagtgaaagtgcctgggacaccaccctggacatcaacctcaaggccagtttcttcgtggcccaggcgtgcgccaagcacatgctcgcccagggcagcgggcgcatcgtcaacctcgcctcccaggccgccgtcattggcctggaccgtcacgtcgcctattgcgccagcaaggcggccatcgtcggcatgaccaaggtcctggccatggaatgggcgccgcagatcaacgtcaacgccatctcacccaccatcgtcgaaaccgccctgggcaaaaaagcctgggccggcgacgtgggtgagcgcgccaaattgcagatcccggcggggcgttttgcattgcctgaagaaatcgccgggctggcgctatacctgctcagcgatgccgcgcagatgatcaccggtgccaacatggtgatcgatggcggctacagcattcagtaattccatctttatgtcgtgaggtcctgtcatgtccaccgtcaccgaacgcacaccgcaacaactcgccccgagcatcccgaaaaccatgcaggccgtggtctgccatggcccggaagactatcgcctggaaaccgtcgacgtgcccacgcccggccccgacgagatcctcaccaaggtcgagctgtgcggcatctgcatgggcgatatcaaaacctatcgcggcgcgccgtcgttctggggcgatgccgagcaaccgcgctatgtgaagccgccgatgattcctgggcatgagttcgtgtgccgtgtcgtcgcccttggcccaggcgccgaaaagcgcggcgtggcggtcggcgaccgggtgatttccgaacagatcgtgccatgctggggttgccgcttctgcaaccacggccagtactggatgtgccagaagcatgacctgtatggcttccagaataatgtgcagggcgccatggcccagtacatgattttcaccaaggaaggcatcatccacaaagtgccggaatccatcgcccccgatgaagcgatcctgatcgagccattggcctgctcgctgcacgcggcggagcgcgccaacgtcgaccatgacgacatcgtagtggtcgcaggcgccggcactttgggcctgggcatcatcggcgcggtgcggttgcgcaacccgaaaaaactcatcgtgctggacatgaaacccgaacgcgccgccctcgccctgcgcatgggcgccgacgaagtctggaacccggcagaggtagatgtgctggcgaaaatccgcgagatcacggatggctacggttgcgacatctacatcgaagccaccgggcaccacaaggcggtcaaccagggcctggcgatgctgcgcaagctggggcgcttcgtcgaattcagcgtgttcaatgacgaggccacggtggactggtcgatcatcggcgaccgcaaggagctggacatcctcggctcgcacctggggccctatatgtacccgcgagccatcgactttatcggcaaccgcaagatcgacatgcgcgatgtggtgacccacaagtttgccctggcggatttcaaggaggcgtttgcggtgatggagcgcggcgataaatcgctcaaagttgtgcttgaaccttagaactacacaaccgcttttactgtaggagcgagcttgctcgcgaaaaacgtcaacgattacgcgggcggtctgatttaacgcggcgatcttgagtttttcgcgagcaagctcgctcctacagtgaacaaaaacaagaacacaggaacccgcgttatgaatcgagtcatcaacgatcccgaccaagtggtcgaagacatgctgcgcggcatcctggtcgcgcaccccgaactgcgccagtacgagaccaacccacgggtcatcgtcaaggccaggccgtccgcccagggccgtgtcggcatcgtcaccggcggcggctccgggcatgagccggcgttcctcggctatgtcggcccgggcctggtggacgccgtggccgtcggcgagattttctcctcgcccaccgccaagagctttttcgacgccttccgcgccgccgaccatggcgcgggcgtggcctgcctgtatggcaactacgccggcgacaatatgaacgtcaagctggcgatgaagatggccgccagcaaagacatgcgcatccgcaccgtagtggccaacgacgatgtggcttcggcacccaaggccgacatcgccaagcgtcgcggggtggccggggaaattttcatgtggaagatcggcggtgccgccgccgcccagcactacgacctggacggggtgattcgcgtcgcgcagaagaccgtcgaccattgccgctcgatcggtatcggcctcacgccctgcaccatcgccgccgtgggcaagccgaacttccagattcccgacggccagatggaactgggcatcggccatcatggcgagccgggcatcgaagtcatcccgatcgagccggctgcggccatggccgagcgcatgctcgcaccgatcctcgccgaccgcgatttcagccaggacgacagcgtggtggtgctggtctccggccttggcgccacgcctgtgatggagctgtacattttctacgccgaggtggaaaaacagctcaaggccaagggcttgaagatccaccgttgctacgtcggcaactacttcacctccctggaaatgatgggcgtgaccttgaccctgctcggcctcgacgccgagctgaaaaccctgatcgaccaaccctgccgttccatcggcctgacccaggcggagtaaacatgagccagcacttttccacccgtgacggcagcgctatcgttgccgacctggtcagcgtcattgtggccaatcgcgaatacctcagcgaagtcgacggcgccattggcgacggtgaccacggcatcaacatggccaagggcttcgcccactgcggtcgcactatcgaaggccgccaactgagcctggcgcaagccctggatgaactgaccctgagcctgatggaaggcatcggcggctccatgggcccgctgtatggcagcctgtttattggcatggccgacgaagtgcgcaattgtgaagacatcgacgccgcgaccttcgcccagctgttgcgcggcggcttgacctcattgcaggacatcaccgaggcgggcgtgggcgacaagtgcctgatggatacccttattcctgcagtagagtcgtttgaacaggcacatgcatccggggcgtctttcaacgatgcgctggaggcgatgaaaaccgccgcctcccaggggcgcgattctaccaaggacctggtggccaagatcggccgcgccagtcgcctgggcgagcgctctctcggggtgctggacgccggggcggtgtcgtgttgcctgattcttacgcgcctggccgactcggtgcagccgcgactgactgcttgacctgctggatataccgcgccaccgccggcgctttttcaaagcgccggtaaatcaacgacaaccacgacgacgcctcattgccctggatattgcgatacaccacgccgggcaggctcacatgcccgaccatcgatgcaggcactaccgcaaccccctgccccaacgacaccaaggccaccaccgccaccaacccgcccggctgcgcgcccagacgcggtgcgtagccgccctgggcggcgacatgcaaggtgccgctgatttgttccggcaggataaacgtctcgttttccaggtgctcgcaggtgattgccttgagtcccagcagccatgagtcatgagccagcgccagcacaaagccttcgctgtccaggcgcaccgcctcaacgccgtccggcagggtcatcggcgaacggatataaccgatatcgcagcgcccatcggccaccgcgcccgttagcgcagccatggcccattcgcgcaggttcacgttcacatcggcaaacgcctggctgaaccctcgcacctggcgctgcaacagcccgcagtacagcgccgaggccacgtaacccaactcgatatgcccgatctcgccacgcccggcgcgctgggcactgtgctgggcgaactcgaattggcgcacggcggcttcagcctcgctcagcagcgcggcacccgcttcggtgaggctgacttcgcgctgccggcggataaacaagcgcgtgcccaggctggtttccatgtcctggatttgccggctcagggtcggcggcgcaatacccaattgctcggcggcgcgggtgaaattgcgctgccgggccacggccagaaagtaacgaaaatggcggatttccatggcagcattagctcaaaggtaatgaagtacttcctggcgcctaacaaaaatttgaatagccagggataagctcgtagctcctgaacactagagagcccttgcgatgcaagtcaaccgagatttcagtattgcctaccaggtaatttgcttgtgagccgggtcagcccacgcctgacgctggtgaccgcctccgctgtctgctcgttgatcgtgctggacaccaacatcgttgccgtcacgctgccgagcatcgcccgcgacctgggcgccaactttgccgatatcgagtgggtagtcagcgcttatatgctggcattcgccgccttgttgttgccggccgggagtatcgccgaccgctttggccgcaagaaaaccctggtctggggcctgggtattttcatcctcgcctccctgggctgcggcgcagcacccaccgcgctgtggctggacatcgcccgggccgtaaagggggtgggtgcggcgctgctgctgacctcggcactggcatctatcgggcataccttccacgatgaaatagaacgcgccaaggcctgggcgttctggggcgcgtgcatgggcgtggcgatgaccgccgcgccgaccctgggcggcttgatcaccgagtacctgggctggcgctggattttctatctcaacctgccggtggggctggtactgatggccttggtgctgcgggcgattcccgagtcccgcgatacccgatcggcgcgcctggatccctggggcagcctggcgttcagtggcagcttgctgtgccttatctgggggctgatcgaggccaatcgcgtcggttgggatagcccgctgacctacgcccgcctcatcggtggcgggctgttgatgggcgtatttgtgctggccgagcacctgcagcagcgaccgatggtggacttacagctgtttcggcacccgcgctttatcggcgccttgctcggcatgtttgcctatgccgggtgcgcccaggtgatgatgacgcttctgccgttctacctgcagaacggcctgggtttttccgcgattgcctcgggcctgggcatgttgccgtttgccttgaccatgctggtctgcccacgcatcggtgcacgcctggcgggccgcttcacaccggcgaccatgatggcgagtggcttgaccctggtgggctgcggcaatctgttgagcgcgtgggccgtgcaggccggcggttatctgccctttgccctggcgatcgccgtcaccggtgcaggcgcggggttactcaatggcgacacgcagaaaaacatcatggcttgcgtgccgcgagatcgcgcaggcatggcctcgggcatgagcaccaccatgcgtttcagcgcaatcatgttggccatcggcgtgtatggcgcattgctgagcagccacagcgagcagttgctgagcgcgagtatcgacccgcagtggcaggcgcaggtgacgggtattgcttcgcgggtggtagccggtgatatgcccgcggcgctggatctggtgcccgaagcagcgcgagtaacagtgcaaccgctggcgcggcaggcgtttgtgggtgggttcagcggggtgttgtgggtggcgggtttattggggttgctgggcgcgctggtggtggggagcctgatgcgcaagcccatacccacacacagctaaatgtgggaggggcttgctcccgatgagcatcggcacctacacaacttcgtagcagctaaaggtaaccacgatgcgaagcgagccgctcttgatcttgatctgcttttgatctgaggcgccccgtcaaaccacgctggccggaattcgacagggatttgggggggtaaaccggcagggatgccggtttagccgccccgcgccatggatggcgcgtggcggcggccccccaaatgcatgtcggattacgggcacaccgagcctaggcgaggtgccgagtggtggggcaagagcgtttggttactttgcgcttttcaaagtgacccgctgtaaaagcggaaccaatagtggccgttgcccaaataacggatatgtacccggtctgatccaacatcctggtcggctgtcaggccgccatcgggggcaagccccgtcccacaggggaccgcctacaacctgaggatggttaccagaaccgctgctgggtcagccggctccaccaggtcagcaatacccggtctaccgaaccgctggccgccaggcccacgcgctcttgcaggcttttacgctcggcatagtgcaggtgaaacacttcggcagtcttggccttggtggccaggtattcatcgctggtttgcagctcgtcgaccaactgtttgtcgagggcggccacacccagccacacttcaccggtcgctacatcgtcaatcgccaattgcgggcggtaccgcgagacaaagttcttgaacaactggtgggtgatgtccaggtcttcctggaacttctcccggcccttctcggtattttcgccaaacaccgtgagggtgcgtttgtattcgccggcagtcagcacttcgaagtcgatatcgtgctttttcagcaagcgattgacgttgggcaactgcgcgaccacgccgatggagccgaggatggcgaacggtgcactgatgatcttctcgccgatgcacgccatcatgtagccgccgctggccgccaccttgtcgatgcacacggtcaatggcacgccggcctggcggatgcgcgccagttgcgacgaagccaggccatagctgtgcaccatgccgccgccgctttccaggcgcagtaccacttcatccttgggtgtggccaggctcagcagcgcggtgatttcatggcgcaggctctcggtggccgaggccttgatgtcgccgtcgaaatccagcacaaacactcgcggcttgggctcgggtttcttcttgccctttttcttttcagtcttgctctcggatttgcgcaaggccttgagctggtccttgtcgagcaggctcgactccaggcgctcgcgtaggcccttgtagaaatcattcagcttgctgacctgcaattggccggcggatttacgacgacctttgctgcgcagggctgcgaagctgatcagtaccaccagaatagcgaccaccagagtgacggtcttcgccagaaagctcgcgtattcggccaaaaaatccatatgtctccttaagaatgcactgcgccaggcgcggatggcctcagcataccgacgccatcgcgcaggggccagtgatcaaagcgccagcaggcgggctccaacgaggttttaaaacaagcgtatgttttttcattgacagcttgcaggcatcctcataacctcgccagactttcaacgtaccgggaaaacggacgtgggcagcatctatctgattcgacatggccaggcctccttcggtgcagacgactatgacgttctgtcgcccgttggcgtggagcaggcgcaagtgctcggtcgccacctggtcgaactgggcctgagcttcgaccgctgcatcgccggtgacctgcgccgccagcagcacaccgccagcgccacgttcgatcaatacagcgcccttggcctgccggttccgacgttggagaccgacagcgcgttcaacgaattcgatggcgaagcgatcatccgcggcctgttgcccgacctactcggcagcgaacccgatgccgtgcacatcctgcgtaacggcccgcagaaccgcagcgagttccagcgtatcttcgcgctgattgtcgagcgctggctggccggcacttatgacccaccggggctggaaagttggctggggtttgtcgaacgtgtccagggcggcttgcagcgtatcctcgaagccgccgacaacaccgacaaaatcgccgtattcacctccggcggcaccatcaccgccctgctccacctgattacccgaatgcccgctgcccaggcgttcgaaatgaactggcaaattgttaacacctcgctcaaccagctgaaattccgcggtcgcgaggtggtactggcttccttcaacaaccatgcccacttgcaactgttgaaggcgccgcagctcatcactttccgatgagctgcggccaaccgtgaccccaaggtcactggactcaccataaaaggatcgaaaccatgactgacgtagccaaagctgtagaagcaatgaaagccaaattcaacccaagcgctgccgaaggcttggacctggtattcggtttccgcatcgacgacaccaagaacttttcgctggtggtcaaggacaagacctgcgaactgcaggaaggcgaaaaccctgacgcccaagtgaccctggtcatggacagcgaaaccctggaaggcatcgtcgacggttccaccgacggcatgcaggcattcatgggcggcaagctgcgcaccgaaggcgacatgatgctggcgatgaagctgagcgagctgttcccttcctgatccaagagcaagcctggatccctgtgggagggggcttgctcccgatcgcggtttgtcagtcgcctctcagttgactgccccaccgctatcgggagcaagccccctcccacattgggtctgcggtggtattcagattctgggttgcagcaacaacgccaccaatgcactccaccccgtctggtgtgatgcccccaacccccgccccgtctccccatgaaaatactcatggaacaacaccaagtcacggctggccgggtccgcctccagttgcgcataccccgccattgacggtcgcaggccattttcatcgcgcagaaacaaccgcgtcagacgcgcgctgaggctgtcggccacttcttccagggacgacagataaccgctgcccgtcgggtactccacggaaaaattatctgcgtagtaccgatgaaactcccgcaacgattcaatcagcatgtagttgaccggcatccacagcggcccgcgccaattggagttgccgccgtacaagcgtgaatcggattcgccgggctggtagctggcacacagggtgtcaccattcatcttcagcgccagaggctgttctgcgaaagccttggacaaggaacgcacgccaaaggccgacaagaattcattgtcatccagcatacgccgcagcagatccttggtccgttcgccgcgcagcaacgccagcaacaggcgattgccctgccctggttcgttccagcgtgagaccagtttggccaggtccggtcggtgatgcataaaccccagcaggcgctcgcgcaaccctgccagcccctcatgctcgcgctgctccagcaccagcaccgcgaacaacggcatcaggccaacaatcgaacgcaaacgcaccggttcattctggccgtcggggtgatgcagtacgtcgtagaagaacagatcctgctcatcccataggccttcggcgctgtcgtcgacgcggttgatggcgccggcgatatacaggaaatgctcgaaaaacttaaccgcaatgtccacatacacggcattacgcttggccaactccagcccgatacgcatcaagtccagggcataggccgcgacccaggcggtgccgtcggcttgatccaactggtaacccggtggcagcgcggcggagcggtcgaacaaggcgatattgtccaggcccaggaaaccaccctggaacagattgcggccctcggcgtccttgcggttgacccaccaggaaaaattcagcagcagcttgtggaagatccgttcgaggaagtccatgtcgccgacgccggtcagcgccttgtcctgctgatacacgcgccagctggcccaggcatgcacgggtgggttggcgtcgtcgaagcgccactcataggcgggcagctggccgttggggtgcatgaagcggtccttcaccagcaacaacagctgctgcttggcgtagcccgggtcgatcagcgcgatggccaccgcctggaagccctggtcccaggaggcgtaccacgggtattcccaggtgtcgggcatggacaggatgtcgaagttggacaggtgccgccaatgggtattgcgcatatgcaaacgctcggacggcggcgcaggctgggccggatcgccgtcgagccactggttgacgtcgaaatagtacagctgcttggaccacagcaagccggccagggcctgacgctgcacattgcgcgcatcgtcatcggcgatgccttgttgcaaggctgcgtagaagtcatcggcctcctggcggcgctgttcgaacaacttgcgtgcgttgacctcgggggcggccacaggggcaaagcgcagatagaggctttggctttccaggcccgccagctccaggctgaatcgcgccgccaccttggtgcccgcgttaccgcggatggccccttgatcaccctccaccacgtaatcgttgatgccatccttgaacggcccgggcgtaggctgcccgcccagtttggcgaagttgctctcgttttcgcagaacagccattgcacgccgtcccggccccaggcgctgagatggcgatcgtccagttcatgatgacgggccagcacgcggtcgccctccagggtcaagctgggcttgggcgcatcgaaggtccagctccagtcattgcgcgcccacaactggggcagcacctgcaggcgtgttggttgggccgagcggttgtgcacggtaacgcgcatgaaaatatcgtcgggctggtgcttggcatattcgacagtgacgtcgcagtagtggttgtcttcaaacacaccggtgtcgaggatttcatactcggcatcgcccagcccgcggcgggcgttttcggcgatcaaatcggcatagggaaaagcggcatgggggtatttgtacagcatgcgcatgtaggcatggctcggtacgccatcgacgaaaaagtacagctccttgacgtcttcaccatggttgccctcggcgttgctgaggccgaacaggcgctccttgagaatcgcgtcgcgctcattccatagcgccaggcccaggcaccagcgttgcgctttatcgctgaaaccggccaatccgtcctcaccccagcgataggcgcgactgcgcgcctgttcatggggaaagtaggcccaggcgtctccatcggcgctgtagtcttcgcgcaccgtgccccattggcgttcgctcaggtacgggccccactcgcgccaacgctcggcgtcttgcggcgccaggcgctggccttcaatcgtgtccagcaggcgggttgcgggtatggccgtcattgagtcctccatcacctacacagtgaggagcagtgtaaaacccaatgacgcccggttgcacatgaagacttgagaagtgggtgtagttgaagctcgggcgggttgattttctcatgtacacctcatcattcatttgcagaatgaagtccagaggaatcttcgtttgcaagctggcctgcggctcaacaaaatcaggcaaaggccactttcatcgccatagccatcaggaatttttctatgcacgccactgcacatgtcagccccgatgagatccgcaagggcttttccaaggccatgtccgacatgtaccgcgatgaagttccgctgtacggcgcgctgctggaactggtggccgagaccaatgccagtgtgctcgaccatgaaccgcgcctggcgcaacagttgcaacgcaccggggaaatccagcgcctggacagggagcgccacggcgccatccgcctgggcaccgccgcggaactggcgaccatcagccgcttgttcgcagtgatgggcatgcaaccggtgggctattacgacctcacccccgccggggtgccggtgcattccaccgcctttcgcgccgtgcatgaacacgcactgcaaaccagcccgtttcgcgtgttcacctcattgctgcgcctggaactcatcgaaaacccaacgttgcgcacgttcgccgaaagcgccctggccaagcgctcgatcttcacccccggcgccctggcgttgatcgagcaagctgaaacgcaaggtggcctgaatgccagtgacgccgaggtttttatccgccaggccctggaaacgttccgctggcaccacgccgccacggtaacgcgcgcgcaataccagcaactcagcgaccagcatcgcctgatcgccgacgtggtggcgttcaagggcccgcatatcaaccacctcaccccgcgtactttggacatcgatcaggtgcaggccgccatgcccggcaaaggcatcacgcccaaggcggtgatcgaaggcccaccgcggcgccaatgcccgatcctgctgcgccagaccagcttcaaggccctcgacgaacccatcgccttcaccgatgcccacggcagccacagcgcacgcttcggcgaaatagaacaacgcggtgtcgcactgacgccaaagggccgtgcgctgtacgaccaactgctgaacgtcgcccgcgatgaactcggcgcgttccccactgaggccaacgccgaacgctatgtgcaattgctggaacagcacttccaggcgttccccgatgatcatgggcagatgcgggaacagggcctggcgtactatcggtacttcgtcaccgacaaaggtctggcagcccgcggccaggccgaccagccgcgtgacttgcaagcgctggtcaacgccggtcacgtggcggtggagccattggtatacgaggatttcctgccggtgagtgcggcggggatcttccagtcaaacctgggggatgcggcgcaaagtcattacgccgccaactccaaccaggcgcaattcgaacaggcactggggcgcaagacgatcgatgagttgcagctttacggccagacgcagcagcgttccattgatgaatgtttgggcacactgctggcatgaaatagggtgtcctccccggctcagcggcacaatccttgcgccacaacagtccccagagccgggtggacggggcgcatcataaagactgagtcctacaatgtcccgcaggtaaatctgaacaaatattgccgcattgctgttaacccaagcgccctacaatctcgtctttgatcagcagccgcttcttcttaaggttttccacatcctcatcgctggcactggctttttctgctttaagcacctccccgtccgcaacgtcatattgcgtgagcaacgcgtccagccgcttgtcactcgccctgcgttcgtgaacggcttccttgctcaaacccaagtcctgatacaggtcgtgtttcactggcatggcctacctccacaagttattcaatggcctacgcccatgaaactagcccattccaagcggtcttgtcatgtgccaggtcaatacgcgtccgttcgtcgtaaccctggcgatgggatcaaacctttgccgtgccctgccctccactatagatcgccacccgagggagaacggttttatgaatcacgttgccactgctgccgacacccaatgcatcaacactattcgtaccctggccatggatgccgtgcagaaggccaactcgggccacccgggcacgcccatgggcctggcgccagtaggttacacgttgtggagtcgcttcctgcgctatcaccccgagcatccggactggcctaaccgcgaccgttttgtgctgtcagtggggcatgcatcaatgttgctgtattcgctgttgcatctggccggtgtggtggaaattgacgctcacggcaagcgctccggccagccggccatcagcctcgacgatatcaagcagttccggcagatgggttccaagaccccgggccatcccgagtaccgcatgaccaccggcgtagaaaccaccaccggcccgctgggccagggctgcgccaacagcgtcggcatggccatggccgaacgctggctggccgagcgtttcaaccgcgacggccaggtgctgttcgactacgacgtgtacaccctgtgcggtgacggcgacatgatggaaggcatcagcagcgaagcggcgtcgatggccggccacttgaagctggataatctgtgctggatctacgacaacaacaccatcagcatcgagggccacactgagcttgcgttcagcgaagacgtgatcaagcgcttccaggcctacggctggcacaccgtgcacgtcaccgatgccaatgacttgcaggccttgagcgtggccctggaaaccttcaaggccaacaccggcgcaccgaccctgatcgtggtcgacagcgtgatcggctacggttcgccacataaacacaacaccgccgccgcccatggcgagccgctgggcgaggacgagattcgcttgaccaaggctgcatatggatggccgcaggattcgagtttcctggtgcccgaagaggcccgtgcggtattgcgcgatgccctctttgaacgcgccgagccgctgtatgccgagtggaaccagaccctggcgtccctcgacccgcaacgagccgatgaactgcagcgcatgcgcgccggagaaatgcccgagcagtggcaagcacacctgccgagcttcgccgccgatgccaaaggcgtcgccagtcgtgcctcgggtggcgaagtgctgaatgcctttgcccaacagatcccgtggctgctgggcggctcggcggatttgtcgccctcgaccaagaccaacctcaccttcgacggagccgggcgtttcagcgccgacgactacagtgggcgcaacctgcacttcggtatccgcgaacatgccatgggcgcgattgccaacggcatggcgctgtcctacctgcgtccgtacacctcgacctttctggtgttcagcgactacatgaaaccgccgatccgcctggcggcgatcatggaactgccggtaatcttcgtattcacccatgattccatcggcgtaggcgaggatgggccgacacaccagcctatcgagcacctgacccaactgcgcgccaccccggggctgctgactttgcgcccgggcgacgcgaatgaaaccctggaactgtggaaagtggccctggcccaaacccaccggccaagctgtgtggtgctgtcgcgtcaggcgctgcctacgctggatcgcaataagtatgcgccagcctccggggcagccaagggtgcgtatgtgctggccggtgcggatcaacctgaggttattctgatcgccacaggcagtgaggtcagtctcgcagtggctgcctatgaacagctcaagggcgaaggcgttgccgcgcaggtggtatcgatgccgagctgggaactgtttgaagatcaagaccaggcttaccgcgacagcgtcttgccgccagcagtaaaagcccgggtggtggtggaacaggcaggtcccttgggttgggaccgttatgtcgggcagaccggcgccaaggtggtgatgaacagcttcggcgcgtcggcaccgttggccaagttgcaggagaagtttgggttcaccgtggagaatgtggtgaagctggccaagcgacaaatccaactgacagaacaataatctaagtgtgggagggggcttgctcccgatgagggcgtgtcagtgatacatctgtgactgacccgccgctatcggggacaagccccctcccacatttgaacatcatcacgctttagaccagctctctggccagatagggcgccgtgcggctgttcttgcttttggcgaccttctgcggtgtgccacacgccactaccttcccgcccaggtcccctgcccccgggccgatatcgatcacccagtcactctgggccactacgcgcatttcatgctccactaccaccacggtatgcccggcgtccaccagctgattcaactggatgagcaagcggtcgacgtccttggggtgcagcccggttgtgggctcgtcgagtacatacaacgtagcgccacgggcattgcgttgcagctcggtggcgagcttgatgcgctgagcctcaccgcccgacaattcggtggccggttggccaaggcgcaggtaccccaggccgatatcgcgcagcacttgcaatgagcgcagtacaccaggctggtcggcaaatacgtccaccgcctgctctactgtcaggcccaatacctgggcaatgttcaagccctgccatttgatcgccagggtttcagggttatagcgcgcaccatggcaggtcggacatggcgcatacacgcttggcatgaacaacagttcaacgctgacaaagccttcaccctcgcagttcgggcaacggcccttggcgacgttgaaggagaattgcccggcgtcgtaatcgcgcttcttggccgctggcgtggcagcgaagagtttgcgcacgttgtcgaacagtccggtgtaggtcgccaggttggaacgcggcgtgcggccgatgggtttctggtccacctgcaccagccggcggatgtgttccaacccggcgctgatatgcccgccgctggcttgcggtgcggcgtcttccaggctcggctcgtcgtcgctttccagtacacgccccaggccctggcccaccagttccagcagcgcctggctgaccaggctggatttgcccgagccggagataccggtcaccgctgtaaagcagcccagcgggaaatccactttcagcccgttgaggttattgcgcgtcacaccttccagcttcagccaggcactgggttcgcggcgcagcggattcgaagggcgctgttcggcgaacagatattcgcgggtctgcgatgcctcgacctgtgccaaccccgcaggcgggccgctgtatagcacttgcccgccatgttcaccggcggcggggccgacgtcgatcagccagtcggcgcggcgcatggtttccaggtcatgttccaccacaaacagcgaattgcccgcggccttcaagcgctcaagcgcggtgaacagcgcttcgccatccgccgggtgcaggcctgccgagggctcgtccagcacatagatgacgccgaacaactgcgagcccaattgggtcgccaggcgcaggcgctgcaattccccggacgacaaggtcggcgtgctgcgctccagggacaggtagcccaggcccaggtcgatcaaggtgctgacccgctcgagcaggtcttgggcgatgcgctgggccgccaggcgtttttccaccgacagcttcatcttgtcctgcccggccgctaccgggcgcagcaactcggccagttgcgccagggacagttgcgacaattcaccgatgtccaccccggcaaacttcaccgacagtgctgcttgggtgaggcgtttaccgtggcacaacgggcaggcactgccttgcatgaattgcgacacgcgctttttcatcagcgcgctctgggtatgggcgaaggtgtgcaggatatagcgccgcgcgccgctgaacgtgccctggtaactgggctcgatcttgcgcttcaacgcatcgcgggtctgctctggggtgaagccggcgtacaccggcacggtaggagtttcttcggtgaacaggatccagtcgcgttgttttttcggcagctcgcgccacgggatatccacgttgtagcccagggttacaaggatgtcgcgcaggttctggccctgccacgccaacggccaggccgccactgcacgctggcggatggtcagggacgggtcgggcaccatcagcgcttcggtcacttcatacacccggcccaggccatggcattgcgggcacgcgccctggggcagattcggcgagaagtcctcggcatacagcatggcctgccccggcgggtaactgccggcgcgggagtacagcatgcggatcaagctcgacaaggtggtgacactgcccaccgaggagcgcgcactcggcgtgccacgttgctgttgcagggccacggccggcggcaaaccttcgatgctgtccacatccggcacaccgacctggtcgatcaagcgtcgtgcatagggcgccaccgattcgaaatagcggcgctgggcctcggcatacaaggtagaaaacgccagggaagacttgccggagccggacacgccggtaaataccaccagggcatcccggggaatatccacgtcgacgttacgcaaattatgttcgcgggcgccacgcacccgcacgaagcccgagggctgggcggtgaccggagggatgttgcgcggtgaagtcatgggcaaccttgtcttgcgttgagcaccgtgcgcacgcgttgcgtcagggcatcggggctatagggtttgctcagcagatggatatcggcgctgagcagatgattggacgacagaatgtcgcgggtatggccggaggtgaacagcaccgccaccggcgggttctgcgcccgggcccagtcggccaggtcggtactcttgacccggccgggcatgaccacatcggtgaagatcaggtccggcgccaagccgccgtgcaacgcttgcatggcgtgatcgccatcctcggcggtgagtacggtgtagcccgactgctccagcaactcgaccacggtcaggcgcacgccttcattgtcctcgaccaccaggatggtttcctggccgccgccctgcaggtccaactcattctgtgcgtcgaggcattcgggctccaggctgtgggggaaatacatctgcaccaccgagcccttgccctcctcgctccacatgtccacatgcccgccactctggcgcacgaagccgaacaccatgctcagccccaggccggtgccctggccttcacgcttggtggtaaagaagggttcgaatgcacgtttgagggtcgcctcggacatgcccacaccagtgtcagacaccgccaggcgcacatactcgccgggcttgatgcttttaccgatgcaatcgccagggttgaggatgatgttttcgccggtgatacgaatcacgccttcgccctgcatggcgtcgcgagcgttgatcgccaggttgagcagcgcgttttccaactggttgcggtcgacgttgatgcaccaggaatcctggggcaattgcacatcgatatgaatggtttcccccagcgcccgttgcaatagctcgcccaagccggcgtagatgcgttgcgggttgtacaccgccggcgacaagggctggcgccgggcaaacgccagcagttgcgaggacagcttggcgccacgctccaccgcggcgatggcggcgttgacgcgacgttgcacctgggggttgtccggctcatggcgggcgagcaaatgcaggttgccggcgatcacttgcagcaggttattgaagtcatgggccacgccgccggtgaggccgccaatcgcctccagcttctgcgactggcgcaactggtcttcggcagaagaacgcgcctgcacttcggcggccacccgctgttcaaggttgtgggtgagttcctggcgcacgtgctcggacttcaccagttcagtggtctcgaccacgatcgccagcaccccggccggttgctggtcatcaccggcaaccggactgtaatagaggtccagccacacggtttccggcttgccgttacgcgacagcaccaggtccttgttattgaaggacagggtgcctcccgccaggcaggtgtccaccacatggcggttgaactcggccacttccggccagcccagctccaccggcgtgccgagcaggtacgggtgccggccgccggcaaaggctgaatagctgtcgttatagatcatgtagcccgcacgtccccacagcatcaccattggcaccggcgaagccagcatcatctgtacggtacaggccaggctggtggaccagcggtcaatgggcccaaggtcagtggtcgaccagtcaaatgcgcgaatacgctgggccatttcgccggcccagccgtcacagccgtgagggttggataaaaatggcatggttcaactctgcgcaaagaggacaatcgcaacttttggagcgcaccggcgcgagatggtttcatcttgtataaattaggtggtcgtgaacgcagaaaccagcggcctcaatgaaaatcccggctgcgcacagtgatccctgccagcagcggcgtcaggtcagtcaagcgcccggcgatcaagtgccgtacctcgcctaccgcctcccagcggccgtccaccttgagcaaccgcgagcccaccagcgcctggcgttggcgctcggccaggtcacgccagaccaccacgttgaggttgccgaattcatcttccagggtgacaaaggtcacgccactggccgtaccggggcgctggcgaccggtgaccagcccggcaatgctgacgttgcgcccatgctccaccgtcagcatctcctgggaactacggcagcgtcgcttgcgcaactcgctgcgcagcagggccaagggatgcgggccaagggtggtgccgagcgtggcgtaatcggcctgcaagtcttcgcctacgctgggtgcgggtaacgccaccaccgcttcctcgggactcggcaaaccggcaaacaagccgagctgctgatgtacaccggccacgtcccaacgcgcctgatgccggttgccggccagggcgcgcaaggcaccggcatccgccagcagcgcctgggcccgggcatccaggccggcgcgtgcatccaggtcggcgatgtcgctgaagcgttgccgctggcgggccgcttcgatacgccgtgcgtcttcctcgcgaaaccccgagatcatgcgcaagcccaggcgaatcgccggctgctggccgtcgatgggttccaggctgcaatcccagtcactggcctgcacatccaccgggcggatctgcaagcggtggcgccgggcgtcctgcaggatctggtccgggctatagaagcccatgggccagctgttgatcagggcacaggcgaaggctgctggttcatgacacttgagccagcaactggcgtaggtcaacaaggcaaaactggccgcgtgggactcagggaagccatagctgccaaaacccttgatctgctcgaatatctgcgcggcgaaggcttcggtgtagccgttcctgagcatgccggcgcgcagccgttgccggtgcggctcgagcccgccatgacgtttccaggcggccatggagcggcgcaactggtcggcctcgccggggctgtagtcggcggcgaccatggcgatctgcatcacctgctcctggaacaacgggatgcccagggtccgttccagcaccgttttcaatgccggcgagggataggtcgtggcctcttccttgttccgtcggcgcaaatacggatgcaccatgccgccctggatcggcccggggcgcacaatggcgacttcgatcaccaggtcatagaacgtctgtggcttgagcctgggcaacatcgacatctgcgcccgcgattcaatctggaacacacctatggtgtcggccttgctgatcatcgcgtaggtcgccgggtcttccttgggaatgcttgccaggctcaagtcctgattgcgatgacggcgcagcaggtcgaagcagcgacggattgcgctgagcatgcccagggcgaggatatccaccttgagcaggcctaccgcgtcgaggtcgtccttgtcccactggatgatggtgcgctcggccatggcggcgttttccaccggcaccagggtatccagtgggtattcggaaatcacgaagccgccagggtgctgggacaggtgccggggaaagccgatcaattgctgggtcagcttcagcacgcggcgcaacagtgggctgtccggatcgaagccgctttcacgcaggcgctccaggggcggcgcgtcgtcactccagcgcccacagcagtcagccagggcattgatctggtctggcggcaaccccagggccttggccacatcccgcaccgcgccggccgcgtggtagctgctgaccaccgccgtcaatgccgcgcggtggcggccgtagcgctggaagacgtattgcagcacttcttcgcggcgttcgtgttcgaagtcgacgtcgatatccggcggctcgttgcgctccttggacaagaagcgctcgaacaacaggctggtcaggctcgggttgatctcggtgatgcccagggcaaagcacaccgccgaattggccgccgagcctcggccctggcacaggatcgaacggctgcgggcaaagcgcacaatgtcgtgcaccgtgaggaaatagctttcgtagcccagctcgctgatcagcttcaactctttatcgatctgttccagagtcttggcatcgacgcccttgggccagcgccgggcgatgccttcttcggtgaccgcgcgcaaccaggaggcggcgtcatggccgctgggtaccagctcccgtggatagtggtaacgcagctggctcaggtcgaacgtgcaacgccgggcgatcgccagggtttcgtccagcagtgcttgcgggtagagctcgcccagggcgtccaggctacgcaggtgtcgctcgccattggggtgcaacagcgtgccggcgtcggccaccgctaagtggtggcggatggcggtcatggtgtcttgcagggcgcgacgcccgcgagcatgcatatgtacatcgccgcaggccacggcggggatgtgcaggctggcggccaattgcaggcgctgttccaagtggcgttcgtcgtcctggccgcaatgcaactgcactgccagccacaggcgctcggcgaaggtacggcgcagccattggatcgaggcttgggtgtcctcgtcttgtgccacccacagtgccagcaagccgggcagcggttgctcgaaatcttcctgcagcaggcgataacgacctttttcgacgcgacgccgggccagggtgatcaaccggcacaggtgctggtagccgctgaggtcttccaccagcagcaccagtttcaggccgttttcgaggcgcatctcgctgccgataatcagcggcaggtctaccgccttcgccgcttgccaggctcgcacaatgcctgacagcgtgcattcgtcagtgattgccaacgcgctgtagccttgggctttggcccgttcgaacagttccagggcgctggaggcaccgcgttggaagctgaagttggacaggcagtgcagctcggcgtaactcatgcaccactttcccctgtaggaacgagcttgctcgcgaaaaacgtgaagccgccgcgttccttcaggatgccagcgttatcgttgacgaccttcgcgagcaagctcgctcctacagggttcatgcaaaccagccttgcagccacagcccatcgctgttcccgacgttgcggtaggcccagccttgctggccggcgcgggtctggatcaggtagtagtcgcggcgcacatcggcgccatcccaccagccggtttcgatgcgctccgggcccatgaggatgtgcacgccttgctcgctcagcaaggtgggttcgtgcagcaaccagccggggcgccggaccttgctcaaggttgggcaggcgcggctgtcggtcgcggcctgccaggcgcattcggggcggtggtcggcgtggaaacgcaagccctgcacggcgtcatcccccaggcgcgcacgcaggcgttcgcgcaattgttcccacggcagggtttgttgcgggcggtcgtcaaacaggtcctggcgctgcggcacgaacaccggcaagtcctcggccaccaagcgcaagccgcgcaccggcgaggtgacctggacctgctccaggcgcccccgagccagctcgaacagcatcaagggctcgcgttcggcgctgagcaggccgaccttgatcacactgtcgggtgcctgggcatgttccaggtgcaggtcgaagcgctgcacgccactgtcgcgcccgcaaaggaaggccgacaagtcgccggtcaagcggcgcaagggaaacagcagcgcctggtgggattgcacatcgaagttcaactcgatgcgcgcatcgaactggtccgggggctgatagaactccaaggccaagggccgttgcccgctcaagacgtcgaggtgcttgagcaggctggcgtcaaagcgccgcgccagggtgtgccggggcaacgcctgcacctgggccagggtgcgcaggcccatgcgcgacaaggccgtggcggcctgcggctcgaggccggcgcggtcgatgggcagcagcgccagggcgtgcatcaaggcgctgtcatcggccacggccaagccatcgtaaaggttcgccaacacccttgccgccgcaggattgggcgcagcgacgatgcggtgacgaaagccaagctcggtcaactccttgcgcaaacgcgcctcgaactgtggccagggaccgaacaggcccaggctcgactcgatctcgaacaacaaggcccgcgggtaatacaggctgacctgggagctgaaacggtaggcccaggcggcgagcaactgctgcaggcgctcgatctccaaggggtcgtattcgacgcaggcaaagcttttggccagggcatgggccgccgtcaaggattggccggggcgcaggcccaaggcccgggcggcggcattgacggtttgcagcacccgccgctgcgacgtgccggtcagcagtgccagcggctggtcgggctcgggatgcacacgctgcgccccgtccagcgccaattgcgggaagacaatacacacccaacgcatggcaacctcaatgccccgccagggcaatcggcgccggatgggccagcccgccccggcacttgagcacccgcacttgcgcgggccgggcctcgaccgccaggcgcaatgccgcgggcgatgcattgaccgcctcactcaaggagcgccaggcaaacgccagggtctggccggtttccgccgcgacttgcaaacgccgcaaggcccggtcatcggccttgcgcggccagcacagcaccgcaccacaactgcccgaacgcaggcattgttccaccgcccacaatgcgtcgcgctcctcggcctggatgatggaaagcttgcgcacatccaccccggcgttctgccaggcgtgggggtacggcgtatagggcggcgccaccagcacaatgcgctcgcccagagccgacaagcgcgccagggtcggcagtaccaactgcaactcgcccacaccgtccttggccatcaggatttcactcaaggccgcttccggccagccgccactgggcagcaccgcatccagcgccgccagccccgtagggtgcacgctggccggtggcgcggcgggccggcccttccagactcgcccgccattgaacagcgagtccagggcaaccacggcgcccatcagccttgcctcaccaggccgcagaacaccccttcgatggccaggtcctgatcgggtccgaccacgatgggttgatacgccggattacgtggcaacaggcgaacccggtcgccgctgcgttcgaaacgcttgatagtgacttcaccgtccaggcgcgccaccacaatctgcccgttcaaggcttcgacgctgcggcgcacgcccaccaggtcgccgtcgagaatgccgtcttcgatcatcgaatcgccctgcactcgcagcaggtagtcgggggttttcgcgaaggtggcagggtccagttgcaagcggctgtgcacttcggcatcggccccaatgggccggcctgcggccactcgccccagcaccggcacatccagccactcgggacgctcgggttgattaagcaggcgaataccacgggcctggttggggttgacctcgataaagccagcttcggtcagggccaccacatgcttgcgggctacgctgcgcgaggcaaagccgaacgcctcggcgatctcggcgaggctgggaggctggccttgttgcgcgatgcggtcgcggataaaggtcaggatggcggtacggcggggggtcaggttcttcatggagtacatttgtactcctctgggaaatttctgacaattaccgtcagtcggggttgaggttagcgaggtggttgcgcgactctgatctgggagcttgatttcataacggtctgattgactgcacccggtaaaaaatgtgggagggggcttgctcccgatggcggtgggtcggtcctagatgcgttgcctgatactccctcatcgggagcaagccccctcccacattggatcgcaggtgcgtcagtgggatcatcggcggctgtcgggccgctgcgcgagcaagctccctcaccagccttctttcagcatcttcagttcaaggtgctgcaacaacatgatcgtcttgccatccacaatatccccactctgcaccatctccagtgcctgctcgaagcccagttcaagcacctcgatatcctcaccctcctccgccaggccaccgcccgcccccacccgatcccctggctggtactctcccatgaagaagtgaatccgctcagtcaccgagccggggctcatgaacgccgcgtagattttctccacatgccccacgcgatacccggtctcttcctcggcttccaggcgaatgcgttcttcagggctggcgttatccagcaacccggccgccgcttcgatcaggtagccggggtagtcgttgacgaacgtgggcatgcggaactgacggatcaacagcaccgtgcgttgcccgcggttgtacagcaggatggttgcaccgttgccgcggtcatacacctcgcgggtctgggcttgccagctgccatcccggcgacgcaggtcgaagctgtattttttcaagaggtaccagctgtccgatagggtttcttcggcggtgatgcgaacggggctgttgtccatggtggggcctatgcaggtgggaacaggttcagtggcgatggctgccgttgagccgtccaccctatcaacctgcgccgggattgttcaatgctgtaacactttgctctgctacaaccgtcgcattaatgcctgcgcgctcgggccatctggtaaaacccgtgcttcgcttttgtcctggagctttcatgtcttctcgctttatcgcccgcctgggcctgcgctggctgcccctgctgtgcatggctgtgctgatcgtcggcctacccgtcggctgcgccgtgctgcagcacaaggaacgcgaactggtgtttcgcatcgagccggggaccgccggctggtacaccggcctgcccaaggccgtgcaggaattcgaactcaggcccgccagtttcaaatcggggcagaacatccatggctggtggtacccggctgcgaacaaagatgcgccggccatcctctacctgcacggggtacgctggaacctcacaggccagctgtttcgcatcgagcaattgcatgccctgggcttctcggtattggccatcgactatcgcggcttcggccaaagccacggcgacctgccttcggaaaccaccgtgtacgaggatgcacgcatcgcctgggagcgcttccagaccctgcaaccggacccgggcaagcgcctgatctacgggcattccctgggtggcgcggtggccatcgacctggccgccgaactgggcaagcaggtaccgctgccggtacgtgggctggtgatcgaatccacgttcacctccctggcggatgtggccacagccgtcagtaacacgtcgttaccggtgcgctggttgctgtcacagaagttcgattccatcgacaagattgccgacatccacatgccgttgctggtggttcatggcctcgacgaccgctacgtgccaccgcgtttcagccagcaattgtttgaagccgcccagcaaccaaagcacctgttgctggtgccgggtgccagccataacaacagcatgagcttggccgggcgtagttatggccaggcgctggacaagctgatgcacaccaagatgcccgacccggtggtgactcattccacagcgcgcgacaacgcgtcataaacaggcttttcggcactgggttcgcgcttggctgtcaagcgcaaaccctgcccatactggcccgaaacagaagttgatcaaataatgacctgcattgaaatcgccaacgctgccgggccttcgtaaagttatccacagagatacccacggttttcgtggacaactctttttatttttttacgattttttgctcaggcaacacattcaggaaagctcccgggcagcaaaatctcgcggttcacatcacgtatatcgttatagccacacagcgccatcgacacgtccaactctcgggcaatgatatccagcgccttggtcacgcccgcctcacccatcgctcccaggccatacaagtgcgggcgaccgatcatggtgcccttggcccccagggcgatggccttgagtacgtcctggccggagcgaatgcccccatcgagccacacttcaatacgcttgcccaccgcctcgacgatcgccggcagttggctgatgctcgacggcgcgccatccagctgacgaccgccgtggttgcttaccaccagcgcatcggcgccggaatcggccgccagccgcgcatcttccacatcgaggatgcccttgatgatcaacttgccgccccagcactgcttgatccattgcacatcgtcccaactcaggcgtgggtcgaattgctgggcggtccaggacgacagcgaactcatgtcggccacgcccttcacatgcccgacgatattgccgaagccacggcgctgggtgccgagcatgcccatcacccagcgtggtttggtcatcatgttgaggatattcggcagggtcagcttgggcggtgccgacaggccattgatcaagtccttgtggcgttgcccaagaatttgcaggtcaagggtcagcaccagcgcatccaccccagcggccttggcacgctcgatcaaccgctcgataaatccgcggtcgcgcattacatacagctggaaccagaacggctggccgacatgctcggcgatgtcttccagggagcagatgctcatggtcgacaaggtatagcgcagcccgaatgcggcagcggcacgggcggtgaggatctcgccatcggcatgctgcatgcccgccaggccggtgggcgccagggccacgggcatggccatgtcctggccgatcatcgtagcgcggatcgaacgctcatcgatattgcgcgccacccgttggcggaactggatgcgcgcaaaatcacgctcattggcgcgataggtgctctcagtccaggagcctgaatcggcgtagtcgtagaacatccgtggcacgcgtttttgcgccagcttgcgtaagtcttcgatggttgtgatcaacgacatcgggtcacctctccctgaactgaggcaagagattaaccggcgatcggctgcgcagccaaccaccggctcgcaaccaacgttttattggctaagaggtgcagcgtgcggcataaccagatgttcgctgttcaccatcaaaagagcgtccatcaccgcatggccgctggccgtattatcgaagatgcaccaagtgggaacacccgccgcagccgacgcctccaacagccgcgcataggcctgcacacgctgcgggccgtaggcgctgtgataaatgcgcggcgagccgtgcaggcgccaatattgcacgccttgccagccggcgcccgggtcgatgacggccgggtcggcgtttacccggcctatctgcatgtccagcaacatggcctcggcgtcaagccaactggggtgacgtggctccagcaccacggcgccggcaaaacgctggcgcagtgcagtgaaaaaacctgtggccaacgctggttcatagcgcaacgaaggcggcagttgtaccagcaggcagcccagcttctgctccagatgcaggcactgttcaagaaactcatccagcgcggtagcgcacccttgcaagcgcagttcatgggtaatgcgcttgggcaccttgaccgagaaacgaaataccgacggcaccgactgcgcccagcgtgcataggtcttgggcaggtgcggacggtaaaacgaactgttgatttccaccgcgttgaagcgcgaggcatagcgctgcaagtgagtgccctcttcggcaaacgccgcccagtgttcgcgcggcaggctccaccccgcacatcccacatacacaggtgccgtcaaaacagcaccttggctgcatcgcgcatgaaaatctcgatggtcttgggcccgaccccgtcaaactcgccgaggcgctgttcgaaagcgtgacggtcctcgctggcgtgtttgatctgggtgatcttgcccgcgtactcggcattcaatttggcactcaggtccagcaggcgctgggcggtggtttcgtcgtagcgtacgtagtgggcacgccccaacatcgaaaccagctcacgggaggtgcaatgctgcagcttgcgcgcagtatcgcggccctcctcttcgataatcacccgatacgcctgggccgcaatcggcgcctggatacgcttgcccatcaggaagctggcgataaaccatttaaacaggctggggtcatcgtcaggcgtgagttcgatgcccagttcagacgccgtgatcgacttggccatgctcagtggcccagcttgcgctcagccttgtcggcctgctcattgatagcgtcagtctggcgctcggtttccttgatcgacgtcggggtcaggaccttgtcgacggtttctgtctttgggtccggatgctcaagggtctgccccttggcgggttttgcggctcctttctgggcgtcttcggagctgatggggttgggggttttgtcggcagtcttggggtcagtcacggtgtatctcctggcagatgcgagcctgcgaaaattggcaggcacttatgcagaagagcccgacgaaattcgatagttcaaggaaattgccctcgtcaccgctggcgaaaaaaacgcaaaaaaaatttaaaccttttgcgcggccgccggctcaacactcaggtaacgacatcacgtcatccataaggagatgcaccatgactagcaagctgatgaaacagatgggcctgaccttcgcactggctgcgggttcgatttccgttgccatggcggcgacctccaatgacttcgtcgacaaggccgcccagagtggtatcaccgaagtcgaggccggcaagctcgccctgcaaaaaagcagttcggctgacgtgaagaccttcgctcagcacatggtcgacgaccacaccaaggccaaccaggaactgatggcactggccaagaaacatgatcttgaagtgccggatgatgccgcgctcatggacaaggccaagaaagccattctcgagatgcgcgacgaatccttcgacaaggcctatgccaacaaccaggtcaatgcccatgaagaagccgtcgaactgttcaagaaagaatcgacttcctcggacaacgccgagctgaaggcttttgccagcgagaaactgccgaccctggaaaaacacctgaaaatggccaaggagctgcaaagcaaatacgccaagtaatccactcacccacacaggagatatccgctcatgagtgcgcaactcaacggtaagaaaatcctgatcatcacctccaataccggcatcgagcgcgacgagctgctcaaacccttggaagccctgcggggctacggcgccaccgtgacccacgcttccagcaaaggcggcaccacccagacctttgtcggcgataccgaaaaggacggcaccgtggagtccgacgtgcaattgtcggatgtggtcagcggcaacttcgatgcgctggtcattccgggcggcacggtgaatgcagataccttgcgccaggacgcagcagcgctgcgcttgatcaaggactttgccgacgccggtaaaaccatcgcggccatctgtcacgggccatgggcgctgatcgatgctggcgtagtcaagggcaagaccctgacttcctataaaagcgtgcgcatcgaccttgaaaacgcaggtgctgcgggtgtggtcgatgccgaggtcaaggagtgcaaggccaacggctggaccttgatcacctcacgtacgccggacgacttgccggcgttcaacgaggcgattgccaaggctgtcgccggctgatcacgagataaaaatctccaggacgctggagatccaaatgtgggagggggcttgctcccgatagcggtgtttcagtcaacttatgtgtagctgactcaccgccatcgggagcaagccccctctcacatttggccctgggcagcattgtgcaatcctgcgcgagcccgaccatgcaagctgcacgaaagccaatcattgcttaacttataactaattgattttaaacataaatattcagaataaaaagttggtacgcctgatgcaatagccttaatacgaggcgtgcatttcgacacgcccgtccactaccgtgaggttctacatgaatgccatcgaccttctcaaagccgaccacgagcgcgtgaagaccctgctgacccaactgagtgaatccaccgagcgcggggttaaaaagcgtaccgagttgctggccaagctcgagatggaaatcaccctgcacacccagctcgaagaggaaatcctctaccccgctttccgcaaagccggcggcaaggagcaggacatcatgtaccacgaagccaaggaagagcaccgcaccgtcgacgcactggtgctgcccgacctgaagcagaccgacccatcatccaccgagttttccgggcgggtcaaagtggtcaaggagttgcttgagcaccacatcgaagaggaagaaaccgaaatgttcccccaggccaagaaactgctgggcaaggcggtgctagacgaactgggcgccgaaatggaagcgatgaaagcggcctataaaaaggcgcacgccagtaaaccgttggctgcctgagggcctggcccaagtgctcagccatggcggcagaagcaatcacaggcgcccgatccgatagcgtctgcgtgctgtggcttttctaccgctatcacaacaatgccccgtatcttgcgctacggggcattgttaaacacactacctgttggcatgcagccaaccctgcacctcagtctttacgcgctgaggccatctcgcgcttgggcccgaacagcgcccacacaatcaagcccagcaacggcacgaagatcaggatcaccagccacagccccttggtctcccagccaccagtgctgcgtaatacgacgttgattgcccacaactccgccagcagcagaaccaccgccaatacgatccagatatagtctacttgcatgaatcacctcctgaggtctatgcattaggtcaagtatctggcctgagggttccatccaatttaaacctgagtgccccagcgcctgacggattacaccttgatatcgatttgcaagtcgcccgccgtgtcatccgccacggacaggctggccaaaggatcgggatgcccttcggctttacgacctacacttttttcgatacccggcttttgataaaccccgatgccaatgccaccggtcaactcggcaataccgggcacgccttcggaagtgttcatgtgtgagcggccgacccagacgaccgacttgccccccagttcatttttcagcacttgcttggcaccgtaatagttcacatcgtcaagacgttgcctggacaatgccatacgctcgggggaagctctggggagtgttgacaggccgtcgaaataacctggggcgtctgcgtgccgggtcaaatagcgatgttcaaggggcatgacctcgatgccatatttctcagcggccgccagtacctcttcgtaaagcctgaccctttctggattgccgtgcctgagcgctctgtcatagttaagcccatactcatccagtgagataccttccatgaagatagcttcgacttgcccttccttgagcgtcggcatggcgtcacgtatcactatcagggaggcgatttcatcgtgattatcgccaaagaccaatacgtcggtttgctctaaggccttggcgaccaattcattaggtgtctcaccggcgatctcgggaattgtgggccgttgtataccaccaccttggacgaaatcttgaaggtgaccgtttttttcgagtgtgaatttctgccgggtgaacttgatcctatccggtgtgaaatggtcgggaatcagtgctccattggtttgcttgctcgttacgtattcatccataggcaaagggaccctggcggcgggtttcgccgggcgggcgcttctgctcagtgggttgtgccgcacgccctccgtcctgctggcaacacgcaggatgggcgactgcggaatcaatgtattgcttgaggaaaacgtcatgggcgggccataaggtttttgcgtcagcgcatcgtaggcataccattgcccattgtgttgcacagcagagccctgcaccgcttgctcgtcgatcttgaaggtgccgagtgccgcagcgtcgtagcggttgctcgccgcgcgcagtgcgtcgcgccccgccgtgcccttgagggttcgcaggccgttgctggcggtagtgccggcctcgtaaagcacctttcccgcacccatcaccacgtcacccacgccttcgagtgggttgagctccttgagcaacggcggcaccatgatcttggtcaccttgagcgccttgcccagcgccgacccagtactgctcaaggctcttccagccttggccgcggcgccgaatcctgcggtgataaaaccgaagatatcaaaggccacatcgttgatcccttcgctgtagttaccgtccctgaaattgacaatggccgagcgaaacggaatcaggtcaaggaaggcatccctcaaagtgtgggtctgttcggcgcgctgctcggaggacgtggtacctgccgcggctttgcggatggcggggttgtcgagatccagcgccttgacgatcgagtcagcgatatggtgggcacgcgggttgacgaacatgtatggcgcagacgctgtagacggttgttcttcatcgaggcggtcgcgtttgtagctgtcggtattcacccaagtcagcgccggattgaacggcaggtagctggcgaacgtacgcagcccttccacggttttacttttatctatgtcggggaagaactcctcgaccttgctgacttcgtccgccacgtattccgggtcgcgtggcacaggcctgttgccgatattcctgataacgcctttttccgtatcaaattcatacttggaaagcgtgctgccgttttgcgccgtgaccagtatttttgggctggtgtggaataacgtcggtccgacaaaagggagcgtactgatcctgtagcttttctcctggtaatacttgagttgcccggtactgaggttcttcttgtcttcaggcgacaggttggtcaatgcattgatgaccgacagcttcttgatttgtttatgattgtccgtagccactgagaaggctttatcgaaggtttcctgaatattgaacgccgggcttttggtaaaggcgacaaacgccttgaggtcaactccctcagtgcctttcttgatactccagcggctgtccatctgcacctgttccatgacgatatccagcatggaataaggcttgccgggcttgggaggaaaggtgtcggatagcctagaaaacaccttgtcctcgaaagatacggtgtcgccaaaggtctgcttgagcaagtccatggccatctgccgacgatcgggcatcaccgtgtcctgcaaggccgagccctcttggagggtcgcttgctgatgcataaacgccgcatgaaccttatcgatatcggcctgggtataaagcgcgtcgtccttggcatcgagcaggttattggccactccccagtccaccagcgctgccctttgtgccgcctcgggggcggcgcccaagccagccgcgttgaccatcacttcggcaaagttgttccccttacctccggcggccaccgcgatgcacagattcgcccaggcctggctgccgtaaagcaccgtgtcgggaatatccttgaccaggaactgcggcgctgcccgcatcaacagcgcatgcgccgccgtctgggccagtgccggtgaaacccgttcggtatcgatcaaatgctggcgcaggccttcgacaaccaccgagggcggctggaacgcatattgaggcgccgccaggtcgaaaccggccacccgattgcgcccaggcgtggtgatcgactccggatccagcgccagctggatcgcagccagggtgtagtcattgacgctggtgtccgtggcgatgccattcaacttggcttgtgcggcccggcccagcgcctgcccctcgctggaagtgaccaaggtttcgagcaccttgaccgggtcttccagtgccgcgcccgacagttgcacatcccggttcaaatagtccagcaaaccctgtgccgcgggctcttgagctgaatccgaagcttggcttgcctgttcaatcgcggttgcccgaagcacctgctgctcgctggcactcaagggtatcggccaggacaaggcgccgccgacgttgccgaacgggtgctgccgggcacgccccgccacggtgcgtgccagcgccagcaactcgctttgggtcgtgggcaaaggcagcccgttttcaaccatgaaggcttccagggtcaccgcctttccaggctccaggatgtagggcacatgctgggccgagcccggggccacattcatcggcgcgcttttcaacaccgccgccacctcccgcggtgtagccgtttccggcaggcgctgggcagccagggcaagttgttgtgccaggtattgccagtttttctggttctccacgtgttggcccagcgcctggcgcgcatccaggctatccaggcgctccagcaggcgttcattgcgagcccacagcgcatcgctgccgtcgaaatggggcgccaggtcagctccttgctccagcccctccagcagttgctgtacacctgcggcaatcacgtcgttgtgcagtggcgccagggcctggctcagttggttttcccagcccggcttgaggctgtgctgagtcgccaggggcaggctgtgcttgaactgctgcgcggcgtctgggtcgtcggcgatacgccggcgaaccctctgcaaggcctgcgccggggtattgaatacctcgaagccatcacgcggggtatacaacaccgtaaggccttgttgatccccaggctgcaaggtccggtcggcgtcggggctgtcataccgacgcgtcggtgacgacccatcggcgcgagtgatcaggaagctgcccgccatcagcgtgccgtcaggcatgggcgtatcgagcttgagcgggtagactccaggccgttcgccatccggtatggcgcgttcacgctcggccagggtgggatgttcgaacgcggtatcgatcagcgccttggcggccaatgacaacgtgccgtcctctacaagcagcgcggccagggtcgaaagcatttgccgatgaatggccaacagctggttttgcgcgggctcagggttgacctcccccgggcgcgcttcagtccagaaccgcgaagggctcaacggcgacggttcttcagaggcttggcctggttgctccgccggcgagtcggtgcgggttggctgcctgtccatcaggccctggatttgctggttgagggcctggtactcgttgagcagcaggcgttggttggtgatctgcagcccgcttagcaggcctgaacgattggcgcgtacgggcgcaatcccctccacctccgcaagggtcgatgcgtgcaacgacagagggctgagggggggtgaaataaactccaggcgcggacgatggctggcgatagcagtggacattcgagtgttctcagatgagtgaggccattcgtccctgatgacaatcggtgtagtgatcttccttaacgtgcttcgcctgggtgagatctttgcactgccaggttccggtaaatcctgtgagcaaagatgaacagatcgatacccgtcgctggaaacgcgacttcggatccgcctgaacagccgtgggtcccattaccgctgcaagaagccccgggggtcgaacacctggaggtgacgaacgcctggggcggcggctcggctatatggtggtggtaagtcacgttgcgtacggtcaagccacgagggtcgatgaccgtcagcgacagggtgttgtgatgcaaggaagtcatgcactcagacccggcgaaccttgcccagcatacgccgcaacacccgggtatcgcctcgcagcgcgtggaggatcaccgcaccgatgtgaccgacaatcaacaccagcatcgcccaccccagttcgctatggaaatcccggcccaggtcgatcatccactgcactttctcaccctcgaacccctgcatgatggtcaggccaaatgccgagaattcccgcccggaaccgtactggcgcagcagcccgatagtcgggatcaggaacatcaacgcatacagtgcgccatgcccgaatgacgccaggcggttgacgctcggcggacggttgtggcgctgcagcaggttccagccggcccgtagtatcagcagcaccagcaatagcaggcccgcgggcttgtggtagggccatagcagtttgtccagcgcagaatcggacgccaggtaatgggccgctgccgtgcaatagctccaggtgaacaccagagccatcagccaatgcagtgttcggctgacagcatcgtagtgatcatcaggggaacggggtgtctcgaaagtatccttcatcgcggcctcttttttttgatatcgaaggtgaacatcgcactcctgccggtaaaaaaacaccattcccataggcagtaggaaaaatcaggtaattcctacaagctcattaaataccaccaggacgacgccgttagccgcgtcgcacagcgcctcaaggcaccggtaaccacgcgctgaaacccgcctggcgggtcaatgggcaccaggcaacgtccccagtcggagcgggcaacagctggcgctcgacaccaggtaacggcacgcccttccaatcgaaaacccttgtaccttgccaggccagcactatgcccagggcctggctttgatcggtattgacccaacacgccgccgaggctgccataaaggcttcgataggctcgtcgtcgatctgcgcccggtaagtcgagcccagcagccagcggcacacgctcaggtggtaggtccaatccagcgccggctgattgcggtaggcccaggtcatgaaactgcggaacaggttcagcccctccggcgggtcgagcttgagcagtgccgggcagatatcaaacaacgtgtgccaatggggcagcaagcgtgcatccaggtgcacgaaacagcgggaattactcgggtaatcgggcagcgtcggctccgcgcgcaggcggcgagatgccttgctgaccaggcggctggcgcctgcaggcaattgatgattcatgggtcgcactcacagtcgtgacgatagaacgccccctggtcacagggggcccaaggcacacgtcagaagtctggggaagcgcgggggttggccgagggccaggagtaacgcggtggcgccttattgcgccgctcatgggcaggacgcggggtttgcgcctggcccaacagccaggccaggccaatcaggaagacgatggcgacggtaacggcgctgcacaccgggcaggcaaagtagttcgagatgttgctggaattcgggttagccaaccctttatcggaaaccggcgactggccgccgtcggctgaacagaacaggccaccgatgccattgagttgctggcccatcatctgaccatgccctaaaccgcaggcgaacaggttcatcagcacgcaaaagtacagggcccaggcgatcagcgaacggtcacaatggcgcaatttcatggcggcgactctaccaccgaagccgcaaaaggatgaagtgcggcgcgcccctgtggcagaacgtcgcagattacgtgggccagccagggttgctagactgtgggccctcctcgtttctacgtttcaaagcctggctttcaaagcctgatgtgtagatccagagcaatgcaggcgtttcacaggatgcacagttaatgagtacgttattcacccgccgcaaagtgctgaccggcatgggcctgttgggcctgggcagcctgctgggcggctgtgactacagccccaagctgaatttcaaatacggcaaggacctcagtgacaagatcatgggccgcaccttcaagctcaagaacaccgacggcgaaaccgtcaccctgagttcgtaccgtgggctgatgccggtggtgttcttcggcttcacccagtgcccggcggtctgcccgacgaccctggcccgcgccgcccaggccaagaagctgatgggccgcgacggtgagatcatgcaggtggtgttcatcaccctggaccccgagcgcgacactcccgaaatcctcgacaaatacgtcaaggccttcgaccccagcttcgaagcgctctacggcaccccggaagaaatcgccgtggccgccaaggaattcgggatcttttatgaaaagatccctgccggcgacacctacaccctgtcccacaccgccaccagtttcgtgttcgacacccgtggcaacctgcgccttggcttgcaggcatcccttaccgctcaagagtgtgcagaagacctgctcaccgtcatggaggtctgctaatgactgccgttcaacacctcaaacgctcgaccctgggcctcaccctgctgggcatcgccgcccacgccagcgcccaggtactggtcaccgacgcctgggtgcgcgcctcagtagcaggccagccgtccagcggcgcgttcatgaccgtcaccgccgacagcgacagccggctgctcagcgtggcctcgccggtggccaaggacgtgcagatccatgaaatgagcatgaaggacgacgtgatgcgcatgggcccggtggaatcggtggccctgcctgctggcaaagccgtcaagctcgacccgaacggttaccacgtgatgctgatgggcctgaccggccagatcaaggaaggcgaccaggtgccgctgacccttacggtgcaggatgccaagggtgaaaagcagacggttgaagtaaaggctgccgcccgtggcctggatggcatggaccacagcaagatggaccatagcaagatgcattgattgggctgtggcagagggccctttgtaggagcgagcttgctcgcgaaaaacgtcaacgataacgcgtgcttcctgaatgagcgcggcgcctgtgagtttttcgcgagcaagctcgctcctacaaaagccttaactgactggcattaggacaagccccacattttgaccgaatacaaccaatccaaagatacttgttatcctgccgctccaacccacattgacgcgagcctatgcagatcgtccccgccttcatcctgcaccagaccgagcactggctgctcaatcaccaccaggcgtcaaagctgccgggctacctgatgctgggcgcccaggcacagatcgattcgctcgccgatatgcctgacgccgcgctggccgaactgggcggcttgctcgccaacatccagcgcgtgatgcaagcccaactccagccaaaatggttgtacatcagccgttacggtcatatgccaggcttgccgctgcactttcacttcatccccgtctatgactgggtagagcaagccttctggcaggatgaacgctatcgcacactgcagcgttttggcgcccaggaactccaggaaacactgaccgatggggccgaactgaccctgtttgtatggcgcgagtttggcgaaagcactacacccccacagattcaagggccgggggttgagcaggtgattgagcaactgcgtgcggcattcaagcctcaggcatgacacgcagcagcttcaccatcggaatacacgccagcgccagccccgacggcgagtgatacaccgcctgctcatcgcccacataaccacacgcccgatagaaactcaccgcattcaaggtggaatcgagcatcacctcttcaatggccctcagtcgcgcaacgtcctccaaatggtcaagcatcgccttgccatatccacgtccggtgaacccaggccgcacgaataacgcccccacttcattgttatcaagatcgagcatgccggtggcgacggccgcgccattcacccagcccaggtaaaacaatttgtccatcagcgtgtcatagccatcggcggctttgccccgcgtccaaagcgccatctgctcggcactgtaggcgccgatgcactgaccaaggatggcgtcgcggcggatgtcaaacgcgcagttggcgtcctcgggtgtcgcgcggattatctccagcattgcaatgtccttgtgtgacctcaatttgccattagcccatttgtgctaatcgacccttcccacctgcggcgctatattccccggcacttccgacgctcctccggcaccgcgcatccattgcgcgcgggttcgttgtgcgctggaaaaaccataacaaccccaaggaagaagcaccatgaaactccactcccccgttactcgccttgccctgctgggcgccctgatcatcggcgtagccggttgcagcaatatcaagcccaccgaagaccatctcaagacgctctcggagaccaacctgggcgagccggtaaaacgtatctccaatgtgcgcagcgactccatgaccacctactatgtggccaacaccgcatccggcgaatacaactgctccgtacccagcggcgccagcggcggtgcgttcgcaatcgccagctttggcctgatgaaacctgccgcctactgccagcccaaaggcgcacgtggcaacgggctgacgccattcatgcagtaatgttttcccgtctgaggtcgcgcaacctgccgcgcagttccgctgggcgcaccggcttggagagtattgcgatctgacggtcgtgcaacgcggcctggattttctccacgtcatgaccggtgaggatcaacgccggcaccgcccagccacgttgctggcgtagctgatcgatgcattcgataccggtggcgtggttgcccaggtcatagtcggcaacgatgatgtcgcagtcgctgaccaggccctgcccactggactcggcctgcacctcgcaaccccagcgctccagcagggcctgggtggcgagcagtacgttgtggtcatcttccaccaggcacactttcaaacccgtgagcaggccggcctggcgcgcatcggcgcgcaatgtcggttgaaccggcgcagtggcgagtgccaggccatgcaggcttactgaggtgccacggcccacccgcgaacgcaggctcacgcgcagccccatcaattgccccaggcgcttgacgatggacagccccaggccaacgccttcgacgtccttgtcacgcagttggcgcacgcgatagaactcctcgaagacctgtgacagatgctccctggcaatcccccgcccctggtcatgcacctccaccaccagaccgtcatcgcgaatacgcacgccgaccagcactggccgttgtgcagcgtatttgaagcaattggagagcaggttctgcaccatggtcgccaacatacccgggtccaccagtacccagtgggtgcaaggccgcaagcgtagctccacgccggcccagcgtgcggcttcggcgttctggcgcatcaggtcggcgaggaagtcgcccaggtggatcacctggtatttgggcagcagccggccattgtcgagggtatagagatcaagaatcgaacggaacagttgcgacacgttgagcagcgaacggtcgatgttatccaccagccgccgctcgtcatcccccatccgggcttcgcgcaggcaggcggtgaacaggccgatggagtggatcggctggcgcaggtcatggctggcctgagcgagaaaacgggatttttccaggttggcggcgatggcttcttcggaagccttgcgcgtacgctccagcaggatatgggcgtacaccgggatcaccgtgctggtgatcatcagcatcagcaccatgaacggctgcgcctgccacaacggcgtgagctggtacaccaccaacagcgccagcaacgccagccccgtggcaatcgccaggtagcgcgagccgtagcgcatgccgttgcccaggttcacccacaccatcaccgcatacagcggcaacgccgcttcaccgcccaccaccaggccgaacgaagtgccggtgtagtcgtgaagcatgccgaagatgcgccgcgccgggtaatgcccgggccagcgtgcgatgacctggcgcaacacgatggacgccagcaggaacaggaagatatacaggatcaccggcaggtaggtgtccagcgagtgcccgggtaggaaacccagtaggctgatatacacaatggcgatggtggccaccacaatgcgcaggttagcctggtcgagttcagagttggtctcgagacccatagtcatatccttgacatatccactgtaggagcgagcttgctcgcgaaaaacgctaccgataacgcgtgttgtctgatattacgcggtgcctgtgcgtccttcgcgagcaagctcgctcctacagtattgagaggggtaaagtaacatgcctcagcacacccttgccccaggaaggagcacaccatgaccggccggatcatcatcgccgacgaccacccgatgtttcgcgaaggcatggcgcgtaccgtgcaacgcctgttgcccgatgcccaggtgaaagaggccggcgacctggccacggtaaatgcgctgctgcgcgaggccggcgaagtcgacaccctgatcctcgacctgcgcttccccggcctgacctgcatcagccaactggccgaactgcgccagcaactgcgacgtaccaccctgatcgtggtgtcgatggtcgacgacgccgcgctgatcgaacaggtcatggccctgggcatggacggctttatcggcaagaacatcacccccgacgagatcggccaggcgctgctggcgatccgcgacggcgaagtgctggtcaagttcgcgccttcgggcctgctgccgctgggcactcacaccctcaccacccgccagcgggaagtgctgcgcctgattgcccagggcaagaccaacaaggaaattgccaaggccctggatatctcgccgtttaccgtgcgtatccatgtgtcatcgctgctgcgcacgctggacgtgccgtcacgggcggcagcagcggtgaagtattccggagagttgtaggtccaaatgtgggaggggcaagtcgaaccatcgcaccgcccctcccacattagaccgaggtgcagcagtcggcccttcacggctctgcatccgatatttatgctcaattcccagcttaataatattttattaatccccccccgccgcctaacttgacgtcatgcccaagctgaatccaactgcattacgcaaggacagacacatgactcaagcaataacaaaaatagacacgctggtagtgggagcgggtcaagctggcgtagccatgagcgagcacctgagcaagcaaggcgtgccgcacctggtgctggagcgcagccgtatcgccgagcgctggcgcaccgggcgctgggattcattggtcgccaatggcccggcctggcatgaccgcttccccggcctggaattcattgatgtgcccgccgatggtttcgcgcccaaagaacgcgtggcggattactttgaaacctatgcacgcaagttcaatgcaccgatccgcaccggggtggacgtcacatcagtggtacgcaacgtcggccgtcccggttttactgtgcacaccagcgaaggtgtgatcgaagccaaccgcgtggtggctgccaccgggccgttccagaagccggtgattccggccattgcgcccaaagacaccgcgctgcaccagatccattccgccgactatcgcaaccccgggcaactgccggcgggcgctgtattggtggtgggcgccggctcttccggggtgcagatcgccgatgaattgcagcgcgccgggcgccgggtgtacctgtcggtcggcgcccatgaccgcccgccccgcgcctatcgcaaccgcgatttctgctggtggctgggggtgctgggtgaatgggaccaggtggcgatgaagcccggccgcgagcatgtgaccatcgcggtcagcggcgcccgcggcggcaagaccatcgacttccgtgaactggcccagcaaggcatgaccctggtaggcctgacccaagcctttgacggcaacgtggccaccttccagcccaacctggtggaaaacctggcccgcggcgacgaaaactacctggccctgctggatgcggctgacgcctatatcgagcgcaacggcctcgacctgccgctggagcccgaagcgcgtcgcgtgtttcccgatgccgaatgcatcagcaacccgatcctgcaactggacctggcccaggccggcatcacctcgatcatctgggctaccgggtttgccacggattacagctggttgaaagtcgacgccttcgacgccgccggcaagccccagcaccagcgcggggtctccagtgaagcgggcatctacttcctcggcttgccgtggcaatcgcggcgtggttcgtcattcatctggggtgtgtggcacgacgccaaatacgtggccgaccacatcgccatccagcgtcagtaccttgagtaccgcgaacccgcaccggttgttcaccacacccctgtcagcgcctgagcactttttcctggagtttttttgatgcctacccacactcgcatccgcatgttcaacaccaaagaaacctaccccaaccagagcctggacaacgacctgtgccaggcggtgcgcgccggcaacaccgtgtatgtacgcggccaggtgggtaccgatttcgacggcaacctggtgggccttggcgatgcccgcgcccaggccgaacaggcgatgaagaacgtcaagcaactgctcgaagaagccggcagcgacctcagccatatcgtcaagaccaccacctacctgatcgacccgcgctaccgcgaaccggtgtaccaagaagtcggcaagtggctcaaaggcgtgttcccgatctccaccgggctggtggtctcggccctcggccagccacagtggctgatggaaatcgatgtgatcgcggttattccagagtaaggagactagccatgaccttttccatcgtcggccgttgcgcggaaaccggccagctgggcatcgccatcagctcatcgagcattgccgtgggcgcccgctgcccgtggctgcggcccggtgtgggcgcggtgtcgacccagaacatcaccctgcccgccctcggcccggacgtgctcgacctgctggaacagggcctggctccggccgaggccctcgaccaagccctaacgcgcaacggctacagccaataccggcaagtgacggcgattgaccacctgggccgcagcgtgcatttcagcggcagccagaccctgggtacccatcatgcggtatcgggcgagcaatgcgtggcggcgggcaatatgctcgccgaccgcgaagtcatcacggcgatggtcacagccttcgaacagggtgaagggcaactggcagaccggctgctggcggccatgcatgccgccatcgccgccggtggcgaagccggtccggtgcactctgccgcgctggtggtggtgggcgagctgacctggccgatcatcaatctgcgtgtggactgggccgatgaagccccccttgtcgaacttcaatcactctgggacgcctaccgcccgcaagtgcaggactatatcgaccgcgccctcgcccccgaccgctcccccggctacggcgtggccggagacgaccgatgagccgcagccgcgaattgctgcgcacgctggtggggttcgataccaccagccgcgagtccaacctgcagttgatcgagtttgtgcgcgactacctcgccggatttggtgtagccagtgaactcgtctacaacgcgcagcgcagcaaggccaacctgtttgccagcatcggcccggttgaactgccaggcatcgtgctgtcggggcacaccgatgtggtgccggtggatgggcaaccctggacattgccgccgttcgagttgaccgagcgtgacggcaagctgttcgggcgcggcactgccgacatgaaggggtatatcgcctgtgtgctggcgctggtgccggagttggtcaagacgccgttgcgcctgccggtgcatatcgccctgtcctatgacgaggaagtcggctgcctcggtgtgcgctcgctactcgcggtcttggagctgcgcccggtaaaacccatgctgtgcattattggcgagccgaccgaactcaaaccggtgctgggccacaagggcaaattggctatgcgctgcgatgtgcagggccacgcatgccattcggcgtatgcgccctcgggggtgaatgcgattgaacacgccgccgaattgatcagcgagctgggccgtattggccagcgtttgcgctcgcgccaggacccgaggttcgatccgctgttcagcacggtacagaccggcatgatcagcggcggcaaggcattgaacatcgtgcccgccgattgccgcttcgatttcgaagtgcgcgccctgcctgccatggacccaggtgaagtggctgaagagttgcaagcgtacgcgatgcagcaggtgctgccgaagatgcaggccgtgagtaagcagagttcgattcggtttaccgagttgtcggcctacccgggattggtcacggatgaacgcagccaggcagcggagttgatcgccgcgttctcaggctcgcgggactttggcaccgtggcgtttggcaccgaaggtgggttgtttgatgcggtgggtattccgaccgtggtgtgcgggccagggagcatggaccaggggcataagccagatgagtttgtgagtgtggaacagctcgacggctgcgatgccatgctgcgaaggatgctggactcgattcagatttgaagaaaatacagatccaatgtgggagggggcttgctctcgatgagggagtggcagtgaaagcagctgtgactgacacaccgccatcggaagcaagccccctcccacactgggtcctgcgttcagccgagtaaccgtgcgagctcttcacggcagtaatccacaaacaactgcaccggcttagtcagcggggcccgcctcagccacaccgccgacaaccccgaccccgtcaccgtttccgccaacggaatacacaccaccttctgcccatcataggtgtattcactgaacggcttagtcaccaggatcgagaacccaaacccacgccctaccatgccgcgcaccatctcgatggacggcgagctgaacacgatattcggcgtcagcccgcgctcttcaaagatgctcacgaagtaggtccggctgggcagcacatcgagcaagatcatcggctccagcaccaggtcggccagggacaccttggcctgttgtgcaaaacggtgatcggccggcagcaacgcataaggctgttgcggcggcatcagtggcgtggtctcgatggtgccgcccaggtcgtgttcgaacagcatcgccacatcgatactgcctgccgtcagcgcctgcaccagctcctgctgctcgccgtcgcgaatacggatctcaacccccggccagcgcgccttgaaaccggcgatcaaacgcggcaggtacagcggcgccacggtttcaaagcagccaatatcgatctgccccgccactacatcattgtccgctagggcgttctgctcgaactcatgggccacccgcaacagctccagggccttgcgataaaaacgcgcgccactgggggtgagcgaaacgccctgggcgtgatggcggataaacagctgcacgccaaaactctcctccaggtgcttgatcgccgtggacaccgacggctgggcgatatacagcttgcgcgacgcctcggcgacgctgccgcattcggcagttgtcacaaaatatctgagctggcgcaggttataggcagccatcggcacctccataaacgtgggatttcgccccaaacaagtgcgaaaaaatcgcgcttttttcatcgattcgagcccatgcaacataccggagcaaaaatctgcgcgagatactttttttaaggtctatagcaacaaacttactaatttacctccccgcgcccattgcagatgatcactccaacaacaaagcgccgccccgtgcagcgcatagcgaagtacgtcaacgtactcaccttgccttggagctcgtcatggttaccactgcaacatccagcgccccgcttatcgaaaaacacacgattggatacgtgcccccggaagatcgccatggaaaggtaagagacctgttcaccctatggttcggcggcaacattgcgccgttgccgatcgtcaccggcgcactgggtgtgcaactgttccacctcaacctggtgtggggcattgtcgccatcctcgtcggccacctggttggcggtgtgttaatggcgttgcactcggcccagggcccgcagatgggcatcccgcagatgatccaaagccgcgcccagttcggctccctcggtgcgctgctggtggtggtgattgccggggtgatgtacatcggtttcttcgcgtccaacatcgtgctcgccggtaaatccctgcacggcgtggtcgacgcggtgcccgtgccggttggcattgtgatcggcgccatcggctccggcatcatcggcatcatcggctatcgctttatccacgtgctcaaccgtattggcacctgggtgctgggcgccggcatcgtgctgggcttcggctacatcttcacccacgtgcagaccaccgacttcctgacccgcggcagcttcaacatctccggttggctggcgactgtttccctggctgcgctgtggcagatcgcctttgcgccgtacgtctcggactactcccgctacctgccggccgacgtacccgtcgccgcgaccttctggaccacctacctgggctcggccctgggttcgagcctggccttcatcttcggtgccgtcgccgtgctcgccaccccggtaggcatggacaccatggacgccgtcaaactcgccaccggggccatcggcccgttgatgctggtgctgtttttgctcagcgtgatcagccacaacgccctcaacctgtacggcgcggtactgtcgatcatcaccctggtgcagaccttcgcctaccgctggatccccacggccaaaagccgcgccgtgatctccatcatcgtgctggccgcctgttcgattgcggcagtgttcgcctccaaggactttatcggccacttcgtcgacatggtgctggtgctgctggtggtgctggtgccgtggacggcgatcaacctgatcgacttctatgcgatccacaaaggcaagtacgacatcgcctcgatatttcgcgtggatggcggcatctacggcaagtacaacccccaggcgttgctggcgtatgcggtggggattgcggtgcagattccgtttatgaacacgccgctgtacgtggggccgatttccgagcacatcaacggtgcggacctgtcctgggtggtggggttggtggtgacgtcgccgttgtacttctggttggcgagtcgcgacagtgcgtataagcgccgcatggatgggggcaagttggtgggtggggtctgatttacggcggctgtgcgtgggagaccttcgggtctgccgggggtgattcttcctggtctgcgaacccgcgcacagtcgccccccagtctgtttcgcagcagcaaagctgtgacgaaacccgcctcggcgggttttctggtttttgcagaactcaaacctaccgccaggatatgtcgaactcggtcaactgtgggagggggcttgccccgatacgtaaccacgatgcgaagcgagccgctcttgatcttgcttttgatctgaggcgccccgttaaaccacgctgtcggattacgggcacaccgagcctgagcgaggtgccgagtggtggggcgaggacctttgcttacttttgggtccttccaaaagtgagccgctgtaagagcggaaccctaagtggccgttacctaaataacggatatgtactcggtctaatccaacatgctggtcggctgtcaggccgccatcgggggcaagccccctcccacatttggatcgcggggtatcagttagttagcggttggctgtcaggccgccattggagcacccctcccacatttggatctgcatgggtcagttgaacctcacttcttacctcgaagcaaatagccttccggtgccatacacccaatgtttctctatgatgtggcctttcgctcaacgccccaggaaacacccatgcccaccctcaccttgcgcaacgccctccccgccgacgcccaccgctgctttgaaatcgaaaccagcgcctacgaaggcgaagaagccgccaccctggaaaagatcgccacgcgcatcgcgcagtatccccagggttttctgatcctggaagcagacgacgatgtggtcgggtttatcaactcaggctgcgcccacgaggtggtaatgtcggacgaagccttcaaggagttggtcggtcattcacccgaggcacagaatgtggtgatcatgtcggtagtggtcgacccggcgcatcagggcaaaggctatgcaacaaccctgatgactgagttcgtgcaacgcatgcgtacgctgggcaagcagaccattcacctgatgtgcaaggagcagcatgtgccgttgtacacccgcatgggctacacctatgtgcgcccgtcgccgtcggatcacggtgggatggcgtggcatgagatggtgatggtgctgtagcgccattcatggaaatcatcgtatttatgttgccaagagtaaaacccggttgggtaaaagcctaacccaggctttaaaggctgggcgggctacaaaccctgccagagccgaatcacagcctgaatgtgggcgccagcttgctcgctcccacgtctgaattgggtatcaaccaacgcgtcaccaactgccagaagccccaccaccgccactggaaccaccgccaccagacgaactgctgctggagctggagctgctggaactcgaaccggacccgccgcccgagccagatccagacccctcgccaaccttgccaaagataatcagcgcgacaaacgatgcgatgggaaacgccagcagccagccatcgcgtccgccatcaatcaccagcccggcgaccacgtacacggccaacgccgccagcagtcgcacgaaaaaccctgcgcggctgctcctccaggtgtgcctcatgatcagcagcagcaccaggtacaagcccagcactacccctacgcacagcggccatagcagccaatggataaaactgacgtccacatagtgatccgcaaccaccaacccgacgctatagaccagcagcccgatcacgccgtagaacagcgggcgtacctgccacaaggcaccgaaggtggcgccgccaatcaacagggtcagcggcatgacaaacaggaacatcggccattgttgaccgccaccgagcagtgccagcaacaacgtggccgccaccgcaaggatcaagcctttgcgccaacgcagcttgccggcggcgagcagcacgccacccaggccacccaggacaaacgccgccagtatcgcgataaattgggggttgaccccgggcccggccaccttgggcaggtcgccgccgtccaccaacacgatcagcgcatccacaccttgttggacaccaccagcaaagtccccctggcgaaacgccggggtgatgcgctcttctatgatgcggtgggccagcaggtcggtgaccgtgccttccaggccgtagcccacttcgatgcgcaccttgcggtcgcccttggccactaccagcaggatgccgtcgtcgacgtccttgcgccccagcttccacgcgcggaacagttggttggcatagtcctcgatgccgtcgctgccggtggtcggcaccagcaataccgcgacttgcgcacctttgcgctgttcaagctcggcgagttggtttttcaagcgctgggtggtggtggcgtcgagggtattggtcagatcaatcacccgttggtccagggccaccccgataggcgacgggtcagcctgggccaggctcatcacgccgacaagcaacagggccaatagactcaacaccgattgccgcagaatcatcaccatgctttgttacctgaagtatcttcctgaaggcgccgactttaccttatcgacgtataacacgtgaccccaggcctgcgactatctaaactgccgccacgcccacatagctattcgccatctacgagaacgccatggacctacgccaccgcaacaatgtcagtgtgatgggccatggcccttcgaccctggtgttttcccacggctttggctgtaaccaggcgatgtggaactacctggcgccgcactttctcgagcgttttcgcgtggtgctgtatgacttggtcggcgccgggctgtcggacctgagtgcgtttgacaaagccaaatacagcagcctggacggctatgcccgcgacctcaacgagatcatcgacgcctacgcccaaggcccggtgattctggttggccactccgtcagtgcgatgatcggcaccctcgccgaccgtttcacccccgggcgcattgccgcgcacgtgatgatcggcccatcgccgcgctatatcgataccgcggattacgtcggcggcttcaagcgcgacgatatcgaagacctgctcgataccctcgacagcaactacctgggctggtccagcgccatggccccagtgatcatgggcgccccgacgcaaccggcattgagcaacgaactcaccgaaagcttctgccgcaccgagccggacatcgccaagcagttcgcccgcgtgaccttcctctcggataaccgccacgacgtgcagggcctggccactccggtactgatcctgcaatcgagcgacgacttgatcgcccccgtggccgtgggtgaatacctgcatgctgtgatgcccaacagcacctattgcctggtggacaatgtcggccattgcccacacatgagcgcgccccaggcgtgcgcggcggcgatggactcgttcctggcgccatgggcagttgccgatgcctgactcgctgtttgacagcgccgcctgcgccctggccgtgacccaggaggacggtacgatcctgcacgtcaacccgcgccttagcgactggctcgggttcagcgcggccgagttgcgggggcgcaggttccaggatctgctgaccatgggcggacggatcttctaccagacccacttggcgccgatgctgcgcatgcatggcagcgtcaccgaggtgaagctcgatatccgccattgcgccgggcataaagtcaccgtcttgcttaacgccaaccaacgccagcagcccgacggcgtggtgtgtgacctggcgctgttcggcaccaccgaccgtgacaagtacgagcgcgaactgctcaatgcgcgcaagttggccgaagccctgctccaggaaaaaaccgccgccgaactggccttgcaacaggcccaggccgaattgagcgaggcctatgccatcgcccagcgccgggcgttgttcgccgagcagatggtggcgattgtcagccacgatttgaaaaacccactcaccgcgatccgcatggcttcggactttctccagcgcggcgagcgcacggccaaggagcgccagttgctggggcacatcggccagtcgtcggaacgcgctcaacgcatgatcgccgacctgctggacttcacccaggcccgagtcggccaaggcattaccatcaaggcggtaccgctggatttgcacaatgtgatccagcatgcggtggacgaactgcgcgtagccttccctgccgccacgctggtgcatcacgccgagggccttggccaagcgtgcctggatgccgaccgggtgcagcagatcattggcaacctcgtcgccaacagcgtggcctatggcgacctgctgcaaccgatcaccatcacctcgcgcctgggcgacaacgcctgcgccgtcgccgtgcacaaccatggcccggcaattcccgaaacactgcttgcggggctgttcgaacccatgacccgtggcaccgatcagggcagcgacgtgcgcagcgtcggcctgggcctgtatatcgtgcgcgaactggccagggtgcacggcggcgatgtggcggtgagttcctgtgtggtggccggcaccacctttaccgtgatgttctagtacaggtacgcggcgccctgcatgatcggttctacatggccggtcagtatcaccccgccctgcccgtcccattgcaccgtgaccgtaccgccgtcgcactcgaccgccacggtgtcatcgagcagcccgcgccgaattccattgaccaccgccccgcaacaacacgaaccggaccccaacggcacagcgccgccacgctcccagatgcgcaggcggatatggctgcggctcagcacttgtacgaaatgtacattggtcttggccgggaacagtgggtgaacttccagtgccgggccgaccgtcgcgacgttgatggcggcgatgtcctccacgaaaaacgtacagtgcgggttgcccatgctgcaagccgccgggctgccatcgatgggcagcacgcgggtgtcgatcgccttggccaggggcaccgctgcccagtccagcaacggcgcgcccatgtccaccgacacctgctgcccgtcgacgcgggtacacgtcagtaacccacgctcggtacgcagcacgacggtctgggtaccggcctcgtgcatcaggcggtcagccacgccgcgggtagcgctgccgcaagtgtgcaggcgcgtgccgtcggggttccagaattgaatacgcgcggcggcatcctcacagtcgagcaccaccgccagttgattgaaaccgatgcccgtgtggcgattacccaggcgacgggcaacctgcgcagtgatggggttgtcctggccacggcggtcgatgatgatgaagtcgtcgccgtgggcgtgcattttcacgaacggcaaggtcatgggtgcaggtcctgttgtcgaagtgaagcagttctaataacactgtaggagcgagcttgctcgcgaaaatcgtgaagacgacacgttttacctgcaagtacgcgttatcgttgacgttcttcgcgagcaagctcgcgcctacaaagggttgatggtcatgcttatcgtattcagcggcctgcccggcagcggcaagaccacgattgccagggaactggcgcgacagaccggcgcggtttacctgcgcatcgatgtgatcgaacaggcactgcgggacgcagcggtattgatgggcgatgtgggtgccagcggctacggcgtggcgaatgcgctggcgctgagtaatttgcgcttggggcagcgggtcattgccgattgcgtgaacccggtcagggagagccgccaagcctggcaggcggtggcgacgacagcgggggtagaactgatcaatatccaggtggtgtgttctgatcagcaggagcaccggcgccgtgtggaaagccgggtgggcgatgttcccgggctgacgtcgccgacctggcagtcagtgctggtgcatgagtacgaaccctgggatgaaccggcgttcaggcttgatacagcgcggatgacgccggcacaggcagtcgcgacagcccacgcacacctattcaatgtgggagctgtcgagctttagccggattcagtcggggaaattaccgcgcaacgcctcgagcccaccgctgtagacgccggcaaacagttcttccactgccgcatccgtagtgcctgctgccggggtgaacacgccggaccaagtcactttcgccgacgtctcagtcagcgcttcaacctgcagggtcgccagataagcactcaccggaaacggcgacgcctcaatggtatagctgtaggtgcgcgccacgttgtcgaagctctgcaagcgctcgacgatctggccgccgtcagccgtggtcaggtggcgcacacggccgccgtcgcctggctcgctcttggcgatgaagggcagccagtcgggcaggctgttgaagccgccgatcagttgccagacctgatcggccggtgccgggatttcaattacagaagatgctgttgccacgataaatactccaaacagagaaaaatcagatcgccatgctgtcgacaacgccgccgtcgacccgcaacgcggcaccggtggtggcagacgacagcggtgaagcaatgtacgccaccaggttcgccacttcatccacattagcggcgcgctggatgatcgaggtgggccgcgcattgcgcacgaacacatcggcctcttcccgtgcactgcgcccggactgggccgtagcgtccttgagcatctgctccaggccgtcggtgaaggtcggccccggcaggatcgcattcacggtgacgccggtgcccgccaggcgcttggccaaaccgtgggacaccgcaaggttggcgcttttggtcacgccgtagttgatcatgtcggccggcgtagccacgccggactccgacgacacaaagatcacccggccccagccctgctcgaccatgcccggcgcataatggcgcgccaggcgcacgccggagatcacattgacctcatagaagcgcgcccactcgctgtccggcgcctcgaagaaatcaacatcgttaaagatgccgaggttgttgaccaggatatcggcgcgaggttcggcggcgaacagtttctcggcgccctcaagggtgccgaggtcggccaccaatccgcgcagttcggcgccgggcaccacttggcggatgctggccaaggcgtcttcgaccttgcccgggtcccgaccgatcaccactaccgtggccccggattgcgccagggcctggctgatgcccaggccgataccagcggtgctgccgctgacgatggccactttgccgctcacatcgatgttcatacttaaactccttgggaattagagaggcaaaggcgcacggtcagatatcaatcgggcctcgcgcaacgcttgccagaaggctgctggaatcttctctgacaacgccgcgacgtcttcggcaatccgccccggacgactggcaccgggaatcaccgccgccactgccgggtgcgccagggagaactgcagcgccgcggctttcacgctcaccccaaacacctgggcgatcgccttgatctgctcgaccttgctgatgatcgccgggttggctggttggtattcgaagtgcgtgccgccggcaagaatgccggagctgtaggggccaccaacgacaatttcgacgtgctgggccaaggccgaatccatcaagcgttgcagggcgcgctcgtggtccagcagggtgtagcggccggccaaaaggaaaccgtcgggctgggcctcagccaggtccagggtcagttcgcaaggttcgacacgattgacgcccaggccccaggccttgatcacgccctcttcacgcaagcgggtcagtactttgaacgcgccggtacgggcctggttgaagtactccagccattggtcgccgtagaagtcctgggcgatgtcgtgaacccacacgatgtccaggcgatcggtctgcaggcgttcgaggctgtcttcaatggagcgtaaagtgacgtcggcgctgtagtcattgagcatcttgttcgggcggccgtgttcgaacacgccgcttttttcgccgaggtcgcgagagccggcttcgacttcatccagaatcacccggccgaccttggtgctgagcacgtagccatcgcgattgtagttagacagggcctggcccaggcggatttccgacaggcccgagccgtagaagggtgcggtgtcgaagtaacgcacgccgtggttccaggcggcctcgacagtggcctgggcttcatcttcaggaatggcgcggaacatattgccaaggggggcggtgccaaagcccagtacgccgggcagtttgtctttcaagctcatggtgggatcctcaatcggttcaagggggtgaccgttgagcagatcctagattgcgctgatcagaccgtccaagacatactgcgaccaacttgagtccccagaggtcttacatgatcgatctacgccaactgcgctacttcgaagtggtcgccgaagaagaacacgtcggccgcgccgccgaacgcctgcacatctctcaatcacccctgagccgccagatcgcccagctcgaagagcggctgggcctgaccctgttcgaacgcagccagcagcgcatccgcctgacccgcgacggccagaccttcctggccgaaaccaaggcgctgctgacccacgccaatcgcctggagtccctgggcaagcgcctgggccgtggggaagaaggcggcttgtgcatcggctatatcgaaaatgccatgcatgccggcgtactgcccaatgccctgcgcatcctgcgcgatgaccggcccaccgtgcacatcaagctgtacaacctgccctcccttgagcaattggagggcttgcgccaacgcagcctggacatcgccctggtgggcgaaccgcctgccgccgacgacccggacctgaccgccttgcaagtggtcgacgacccgatgctgctggccctgcccgaacagcatccgctgaccaggcaaagcgaattgttgcctgaacacctggccgaacaacaatggatcggcgtgcagcgcaaacccggcgccaaccccgccgatgatttcgtcgccgcctgcatccgtgccgggttcaccccgcagattcccatggaagccagcgagccctttaccgcattgggcctggtggcctcggggcttggagtggcgatggtgcagaagggcctgagccgcaacgcaccgcccggcgtggtgttgcgcgagctgccatggctgagctacaccacaccgctgtgggcggcatggcaccgggtcaacctgcgaccattggtggaaacgtttcgcaaggtgctgactgaaccaccgctatcgggagcaagccccctcccacatttcaaccgcgttttgcctgaataaatgcgatcaactgtgggagggggcttgcccccgatgagggagtgtcagcaagcatatccgtgactgacccaccgccatcggatcatcacaccagccccacatttctagcgcgccaacctcgccatgatccccgccgagttgacgaaaatcgcaatccccacaaacaccagcccaatcgcaaccccctgccccaggctcagctgttcaccgaagaatacataggacgtgaacagccccgacaccggtaccatcaacaacaacggcgccacccgcgaagccgggtatttcttcatcaggttgttccatacccggtacccgacgatggtagtgatatagcactggaacacaatcgagaaccccgctccccaggtcaggtcggtgaccaggtgggtcagcggctccgcaccctcgaaccacaaggtcatcaacaacaggacggggatcgaaaacaggctggaccagacgataaaggccaccatgtcctcaggctggttgaccttgacgatcaagttgcacaacgaccacgacaacgccgccagcaacaccagcaaaatgcccagcgtggtcgaggcgtgtgccgacaggtgcaggatcatgaacagccccagcgcagacagtagcattcccgccccgtggaccctgcttatgggttccttgagaaacaaccggctcatgatgagggtgaagaacgcactgaactgcaggaacaccgaagacatccccgccgacagcccgttgtgcatcgccacgttgaccacgccccacagcccggcgccgaacaacacgccataggcggccagcaggaagtaggaagcgccctgtggcttaggaatgaacatcaccaggggtaacgcacagaaggtgaaccgcagcagggtcagcacaaacgggtccaaatcctccaggcccaggccaatgaccgagaagttggcgccccagattaccgttaccgccagccctgcgattaaatcggatttactcaggcgcatggcccttcccccccgttatgccagcgtcttgggcggcacgggggctgtctataagctcctccctggaccgcagcttgtgcggggcgaaatttacgcaaagatctgcacgcgggtaactaaccatacggtcagtaggcaagggacggaaaaagtgtcttgaaaaaagcccttccgcttttcgccacactgccccgcccctttaaacaccgcctggggtcagagcatctcgcgcaagcgataccacaacatgcccagcgccagcagcggcgagcgcagtgccttgccgcccggaaaggtcatgtgcggcacctggctgaatatatccaggccgcggccgctgccggcgtgaatcgcttcggccagcagccgtgcgcaccagtgcgtgacgttgaggccatggccggaatagccctgggcatagaacacgttcgggtactgctgcaaccgtccgacctggggaaagcggttggcggtgatgccgatcttgccgccccactggaactcgatggcggtgttggccagttgcgggaacaccttgagcattttcgggcgcatatacgcggcgatgtcttggggatcgcgccccgagtaatggcaggcgccaccgaacaacaggcgtcggtcagcgcaaagccggtagtaatccagcccgactttctggtcgcacagcgccaggttctgtgggatcaactgttgcgccacgcgctcaggcagcggctcggtagcgatgatgtaactgccggccggcagcaccttgccgctcaaacgcggctccaggtcttccaaatgcgcattacacgccagcaccagttgggcggcgcgcacagtgcccgcggcgcagcgcacctgcacggtgtcgccatggatcagttccagcactttcgtgtgctcgaagattttcacgccaagggcctcggccacctgggcctcgcccagcaccaggttgagcgggtgcagatgtcctgagcccatgtcgaccaggccgccggcatacaccgtcgagcccaccacctgcgccatgtcctggggaccgaccagtcgcgtttcatgggcgtaccccatggccgccaaatgtgcctgttcacccttgaacgccgcaaactgcgccggggtgttggccagctcacagaagccccagcgcaggtcgcaatcgatgccatgctcgacaatgcgccggcccaccaacgccaccgagtcgatgccggcccgctccaggtaacgcacgccctcctcgcccacgtatttggcaaaccccgagacatcatggccgatgccacggatcaactgcccgccgttgcgcccactggcaccccagccaatgcgccgagcttccagcaggatcaccgagagcccgcgctgggccagttcgatggcggtgttgacgccggtaaaaccgccgccgatcacacacacatcggcgctcaggtctgtacccagggcggcacgctcaggcaatgcgtgggccgaggcgcgataataggactgggcgtggtcatgggacagcatcatttgttggtcttcactttgctccaggcgcgggtcatcaggcgcatggttgccggggtcggcgtggtggaaatatagagtttgtcgagcactgcctggggcggatacacctcggggttgtccaccagctccggggccatgaacggcttcgccgccgggttggcgttggcgtagcccaccgaggcgctgaccttggcgatcacttcggggtcgagcaggtagttgataaaggcgtgggcctgcttggggttggtggcgtctgccgggatcgccagcaggtcgaaccacaggttggagccttccttgggaatcgagtaggcaatgttcaccccattcttggcttccttggcgcggttggcggcctggaatacatcgccggaatagccgaacgcgacgcaaatatcgccgttggccaggtccgaaatgtatttggaggaatggaaataggtaacgtagggccgcaacgtcagcaacttggcctcggcttgcttgtagtcctcggggttctcgctgcgtgggtccttgcccatgtagttaaggatcgccgggaacagttcgtccgccgagtcgaggaaagccacgccgcactggttgagcttcttgatattctcgggctcgaacagcaccgcccacgaatcgatatggtcgatgcccagcacctgcttgaccttgtcgacgttgtagccgatgccattggtgccccagaggtaaggcaccgagtgggcgttacccgggtcgttctgctccagcaacttgagcagcttggggtcgaggttcttgaagttgggcaactgcgcacggtcgagcttgaggaacgcgccggccttcacctggcgcgccaggaaatggttggacggcaccaccacgtcatagccggtacgcccggcaagcaacttgccctccagagtttcattggagtcgaacacatcgtagatcaccttgatcgaggttttcgcctggaaatccgccaaggtggtctcgccaatgtaatcagtccagttatagacgctgaccgtcggcgcggcctgaccggcactgctgaatgccgccaccagggccagcgggagaagcttgttcacaagacgcatatcgacaccccttttatgattgtttttagacgctcaatagcaggaactcacgctcccaggaactgatcacccgcttgaaattctcgtgctcggcgcgcttgaccgcgacgtagccgcgcacgaatttctcccccaggtactgcttgaccgtgtcgcagtcctccatgcgtgccagcgcatcctcaagggtgaacggcaagcgcaggttgcgccgttcataggcgcggccttccaccggcgcactgggttcgatctgctcgatcatgcccaggtagccacacagcaggctggcggcaatcgccaggtacgggttggcatcggcgcccggcaagcggttttccacgcgcatcgcttccgggctggaggtgggcacacgcaggccaacggtgcggttctcttcgccccactcgacgttgaccggcgccgaagtgtccggcaggaagcggcggaacgaattgacgttgggcgcaaacatcggcagcagcttggggatgtacttctgcaagccgccgatgtgatgcaaaaacaagggggtcatgcggccatcggcatcgacgaacaccggtttgccggtggcgatctccaccacgctctggtgcaggtgcatggcactgcccggttcatcggccaccggcttggccatgaaggtcgcggcgacgttatgcttgagcgcggcctcacgcagggtgcgcttgaacacggtgatctggtcggcgaggtccagggcatcgccgtggcgaaagttgatttccatctgcgccaggccgtcttcgtggatcagcgtgtcgaggtccaggccttgggcttcgcaccagtcgtagacgtcttcgaacagcgggtcgaattcgttggcggcgtcgatggaaaacgattggcgcccggtttcggcacgcccggagcggccgataggggtcttcaacggcaggtccgggtcttcgcagcgctgggtcaggtagaactccatttccggcgcgacaatcggctgccagccctggtcggtgtagagctgcaagactttcttgagcacgttgcgcggcgacagttcgatggggttgccctgtttgtcgaaggtgtcgtggatcacgatggcagtgggttcgatggcccagggcaccacgtaggtggcgttggccaccgggcggcagatcatgtcgatatcggccgggtcgagcaggtcgtagtagatatcgtcgtcgacaaagtccccggttaccgtttgcagcaacacactttccggcaggcgcatgcctcgctcatgcaggaacttgttggtgggtgcaatcttgcctcgcgcgatgccagtcaaatcactgatcacgcattcgacttcggtaatcttgtgttctttcagccaggtggagagctgatcgaagggggcgttcataaggacctcgtcttgggtgggatgcgacgccggcttgtacttgcggcgcattgaggtctatcttgggccagccttcaaaccgcatctatccactttgcacgcagcacaacgcaccaatagagtgcgcacggatcacccatgacacaggcaaccgctttgcgcgtacaggccttcgctaccggcgatgtggccgcccaatgcagtgcgacacccggttgggtgcagcagtaccagcagatgtcccccgggcatttttccgggcgggtacgctacctcgacctgcaaggcgtgcaggtatacgaggagtgcatgaacacccgcgtggaacagcatttcaatgcaccacccggggccctggcgttctgtttcgacggcagcgacaacagcctgtatatgctcaatggcgaaagccgcaatacctggatcaccccggaaaactaccgtgaagtggcggtggtgttcggcccgcagtttgtacagcgacatgggctggacgtagcaaaacttgaagggttgttcatggctcccttgaggtgccagcagaacgcgctgttcacccgctggctcagtggcacgctgacgcgtttgtcggcactgaccgaccccatcagccgcgatgcccttacccagcaactgctcgacgactgcctgtttatcctcgacaacgcctgcgtgtgcctggaccgcgactcattgcaaaagcgcagcgaagcacgccggttgatggcgcgcatcggcgaatggacggcggatgcgccggatgaaagcgtcaacctgctggaactggcgcagattgccggcgtgccgttgcgccaattgcagcaaggtttcaagacctataccgggatgagcccggcgcagtggttaaggttgcgccgcttgaatggggcgcggcgggagttgctcaattcatccagcaccaccgtcgccgaagtggcgatgaactggtcgttctggcatttggggcggttctctaacagctatcgaacattgttcaaggaactgcccagcgaaacgctcaagcgctcactttgaaatgcagtcaaaaatatgggagggggcttgctcccgatggcggtagatcagtcacctgatactgagactgacccaacgctatcgggagcaagccccctcccacaggggatcgcatttcaaggctgggatttgaggaaggttgcgatcagctggttgacctgttccgccgcttccaactgcaccatatgcccctgccccggcagtatctccacctgggcctccaggccctgggcatggtcggccgggatgattgcatcgtcactgccccagatcaccaggctcggttgctgccccaccacgttgcgcaaatccaggcgctggcgcccgccttcaaacaactgcgcattgagttgcttcaaggcctgatccacgccttccaagcgcttgaacttgagcatgtcctccagcatctgccgcgtcaccagcgccgggtcgctgaacagttgcaccagttgcggcttgagcgcattacggttgttggcctcggtaaaaccgtgcaggtaatcgccattgatagccgcccccagcccagcgctggcgatcagggtcagggaggcaacgcgcgcgggtgcctggcgcgcgaccatcaggctgaccagcccgcccatggagtgcccggccaggtgcacgcggtcgagctgcaggtgatcgagcaaggccagtacggcctggctcagttcctcggcgtcccccgtttgcagggccttgcccgactcgccatgccctggcaggtccagggcgatcacccggcgttcggcggccagggccggttggttgaacagccagttgttcatgtcgccgccaaaaccatgcaccagcaccagcggtgtagcgccttcgcccaggtcgagatagcgcaacaggcgcccgcccacctcgatcttctgcgcactcggcccggtggcttcggcttcggcgcggctggagacaaagccggcgttgaagctgtcgatcaccgcatcgatctgcgcctcgctggcctcaccttccaccacgatccccagcagcgcgcccaccggcaaggtctcgtcgctcagcgccagcactcggcgcaatacaccgctgaacggcgcctcgacactgctggagatcttgtcggtttccacgtccaacacctcctcgcccttctccacccggtcgccgggctgcttgagccaggcatcgatgcggccttcggtcatcgacagcccccacttgggcatggtcaaggtatggatcatgcggcattcctcctgtcggcgatcttcagcaccgcggcctcgatcttcgctgcgttggggatgtacaggtcttccagggcatcggaaaacggcaccggcgtgtgcggcgcagtgaccatctcgatcggcgcacgcaggaaagaaaagccttgctgggccaccaacgcactgatgtcggtggcgatggaacaacgcggattggactcgtcgatcaccaccaggcgcccggttttttccacactctcaaggatgctgtcttcgtccagcgggctggtggtacgcaggtccaacacctcgcagtcgatgccctggcgcgccaggttggcggcggcttccagggcgacgtgcaccatgcgcccgtaggtcaccagggtcacatcgcgaccttcgcgcacaaaattggcctcgccgaacggcacggtgtagagctcttccggcacttcgccttgcaggctgtagagcatcttgtgttctaggaagatcaccgggtcgttgtcgcggatcgcctggatcaacatgcccttggcgtcatacggcgtagccgggcacaccaccttgaggccgggaatgtgcgtccacatcgaggtgagcatctgcgaatgctgggcggccgcgcgcaggccggcgccgtacatggcgcgcactaccagcggcgtggtggtcttgccgccgaacatgtagcgaaacttggccgcctggttgagcaactggtcgaggcagcagccgataaagtcgacaaacatcaactcgcacaccgggcgcatgccacgggtggcggcgccgacggccatgccgacgtagccgacttcggacaacggcgcgtcgagtacgcgctccgggaactcagggtaaagacctttggtcacccccagcacaccaccccaggcgtcctgctcgccgggcgaaccggtgccgccggacacatcctggccaataatgaacacgctctggtcccggcgcatttcctgggcgagggcttcgttgattgcctgctgatagctgattttgcgagccatgggattttctccacctgttgttgttattagcggtaagcgacgtagacatcactgagcaggtcgacggcctggggtttgggatcggacttggccaggcgcacggcgtcgtcgatcaactgcgcgacctcgccgtcgatacgttcgaactgcgcggcatcgagccagccttcggcattgcagcgctggcggaacagggcgaggcagtcgtgggattcgcgcaggttcttgacttcatccgggccccggtaggtttgtgcatcgccttcgaagtggccatagaagcggctgagcttcacttccaccaaagtcggcccttcgccctgccgtgcgcgctccaccgccacgcccagcgccgcgtgcaccgcgaagaaatcattgccatcgacaatcacccccggcatgccaaagcccactgcccgctcggcaatgtccttgcatgccaccgaccagccggaaccggtggcctcggcatagccgttgttctcagcgacgaacaggcacggcagcttcatgatcgacgccaggttcatcgcctcgaacaccgcgccctcgttggagccgccgtcgccgaagaacgccacggccacgccctggctgcccttgagtttggaggccagcgcagcgcctgccgccaacggcgcaccggcaccgacaatgccgttggcgccgagcatgcccttctcttggtcggcaatatgcatggagccgcccttgccgccgcacacgccggttttcttgccgtagatctcggccatcatgccgaacacatccacgcccttggcgatgcaatggccgtgaccacggtggttggaggcgatgcagtcttcatcgttgaggtgcgccatgaccccggcagcgctggcttcctggccggcatacaggtgcacgaaaccagggatctcgccggtggcgaattccacatgcaggcgttcttcgaagtcacgaatggtgcgcatcaccgtataggcatgcagcaattgatcggtggacaggtgagtggacatcttgttgttctccaggttgtctcgacacacaaaaggctggctgcggccagctgtaagcgcttgagcacaggctgtgccaaggcccacgaaaaaccggcaaagccttgacccagagcagtgccgaacggttgtgccgctgcgccatgccagcgcagaatgagacccgccattgcacagtgcaggctccgtctcaggcgggctgagacgctgcgtctcagcgctggctgttggtcaggccaaccttgtcggtcggcgcccatgggcgcttaatggcgggcataacaacaaggatcgagaaccggaggccttatgctcgccgcgaactccagagaacacgtcgactgcgtcagtcgcgtggtccgcaatgcggatcgactgccccaggcgccggtgccggcgctgattttcgattcatggcgccgttccatggagcaataccacctcgaccccgggtcgctgcaggggccgcgcattctcaccgaacccctgctcaaggaatgccgcgagcgcgctgagctgttcatgcgcatcgccagcgaagaagtcgggcaactgcaccaccgtgtgcgccacgccgactactgcgtgatgctcaccgacgcccagggccagaccctcgaccaccgcgtggacaccgccattcgcagcgactgtcgcaaagccggtctgtatctcggcacctgttggtcggaagccgaggaaggcacctgcggcgtggccacggtgctgaccagcaaagccgccgtgaccgtgcacaagcgcgaccatttccgtgccgcctttatcggcctgacctgttccgccgccccgatcttcgacccccagggcaacctgctgggggtgatggacgcctcggcgctcaaatccccggatgaccgacgcagccagcacctggtgcggcagatggtggcgcagagtgcgcaagccatcgaaaacgccttcttcatgcacagtgcccgcgagcattgggtgctccaggcccacggcacaccaggctatgtgaacagccagccggacctgctgctggcatgggatcaggacggccggctacgggccctgaacagcaaggcgcgccaggcattgcgccggcgcttcggccaggtgcccgactacatcggtgaagtgttcgacctggatgcgttgcgctcggtgacggaccaatcgacccaacacctgccatggctgggcgagcctggcgtattgcacgtgcgggtcaataccccgcgacgcaaaccgccgcgagccgttgcgcacgctcaggtcgacccgcgggtggaagaacacctgcgcctggccgtacgcgtcaaggaccgcaacctgccggtactggtgcagggggaaaccggcgccggcaaggaagttttcgctcgccaactgcacgaacgcagcgcccggcgtacggggccctttgtcgcggtcaactgcgcagcgatccccgagaacctgattgaaagcgagctgttcggctacgtggcaggggcttttaccggtgcatccagcaaaggcatgcaggggctgttggtacaggccgatggcggtacattgttcctcgatgaaatcggcgatatgccgctggcgttgcagacgcgcctgctgcgggtgatggccgaaggtgaagtcgcgcccctgggcggggccaagagccgcactgtggacatccaagtgatctgcgccagccaccgtgacctggccgcgctggtcagcgacgggcgctttcgcgaagacctgtacttccgcctcggctgcgcgcgcttttgcctgccgccgctgcgcgagcgcagtgacaagctggcactgatcaaccggttgctggagcagcaagcacgcggcggcgtctcggtcggcatcggccaggcggcactggaacggctgctgggctatgcctggcctggcaatgtgcgccagttgcaccacgtactggcgtatgcctgtgccgtgtgtgagagcgggaccatccagttggcggatctaccggtgcaggtgcgcggcgaacaggtttcgctggctgcagaacctagcgtgagccccgaacgtcaggtggtgctggacgcgttggtccggcaccgctggaagccgttgccgacggcgcaggcgctgggtatttcccgggcaaccctgtaccgccgggtcaaccaactgggcatcgacatgccccgcaagcactgacacaacggaattaaacatgtgggagggggcttgctcccgatagcagtgggtcagccaacatctatgtttgctgggctgacgccatcgggggcaagccccctcccacatttgaccgagcaggccttgagaggtcagcggtagacaaggccaccgtcgatcaacggcgcttgcccagtcatgtaatccgcatccggcccggccaggtaggccaccaacccggctacatcctcgggcgtttgtgcacggcccaaggcaattccgtccacgtacttcttgtaggtcgcccccacttcagccccggtaatctcggccatgcgcttgtcgatctccacccacatatcggtacccaccacgcctgggcagtaggcattgaccgtgatcccggcgcttgccagttccttggccgccgcctgggtcagggcacgcacggcgaacttggtggccgagtacacgcccagcagcgcaaagccttcatggccggcgatagagcaggcattgatgatcttgcccttttgcttgagcgccttgaatttcttggcggcggcctggataccccacagcacgccctgcacgttgataccgagggtgcgctcaacctgttccgggctgacgtccagcaatgagtcgatctgcgcgataccggcgttattgacgatgatgtcgaagccgccaagggtctggtgcgcatgctcaactgccgccaccacctgatcgcgcttggacacgtcggcgataaacaccgaggccttgcgccccagggccactacttctgctgccacggcttcaagcttggcaccattgatgtcgaccagggcgatgtcggcaccgtcctgtgccaggcgcagggcgatggcccggccaatgccttgcccggcgccggtcaccagcgcaacttttccagcaatactcatgacgatctcctgcaacggtgagagagccttgtctatcgcagatgcctgccggggctgtcgaggcgcaaggggtttggcgtagaggttgagacgctgtgtctcagcacgcgcgcgcgtaccgaacgcttgtaaaacctggccgttatgcctagcttatgcgccccgccctgcgctataaggccctgccccatggttttgcgttttcgtcccgtcgtcagtacacgtttggctctcggcctgctgctcagcggcggcatcggcagcagcctggccgcggagattgaactgccggcggtcaaggtccaggggcaggatgagtccggctaccgtaacgaaactgcctcggtgggcggtttcgatgaagcaccgttgctggacacgccggcctcgattacggtgatcaacgccgccctgatcaaggaccagcaagcgcgcctgctcagtgaagtgctgcgcaacgatgcgtcggtgggtgacagctatgcgccgattggctattacgaaaatttcgtggtgcgtggcttctcgctgaacgcggccagcagctacaagatcaacgggcgcaccatcaccggcgagcagaacgtcgccctggaaaacaagcagcaggtggaagtgctcaagggcctggccgggttgcagagcggcatttccgagcccagcggcgtgatcaactacgtgaccaagcgccccgaggatgtacgctcggtaaccgtctctaccgatgatcgcggcagcggctatatcgccacggacgtcggtggctggtttggcagcgagcagcaattgggcctgcgcgccaatgtcgcccatgaagacctcaattcctatgtggaacacgccaatggccagcgcgattttgtgtccctggccttggactggaacatcagccccgacgccctgctgcaactggatgccgaataccagaacaagcaacagcgctcggtgccgggttaccaactgttgggtggcaccgaagtgccccacgacgcctcgccgaagaagctgctggggcatcagagcggcggcaagcaagtggggatcgactcgctgaacctcaacggcaagttcgagtaccgtttcagcgaccagtggaaaggcactgtcagcgcggcgcgtagcaaggtggtgattgatgactacagttcgtttgcgtggggctgctattacgtcagcaactgcaatgccaacaccttcagccccgaaggtgactacgacatctacgactatcgcagccccgacgacacccgccgcgatgatgaaatccaggcagccatgaccgggctattcgacaccgcgggcctgggtcatgagttgaccttcggcaccagcgcatttcgccgggtggtcgacaagcgcgactcggtcaatgaatacatcggcagcggcaatatccatcaggatgcgccgagcttccctcccaccgacaagccgctcaatgatagccatcgcaacctcgacagccgccagtacgggttgttagtcaccgaccgaattcgcttcaatgagcaatggcaaaccattctgggtgggcgtgaagtgcgcctggacgaaaaggctttcgacaagaacggcgctgagtcacggcatacccagcagtatgtattcctgccccaggcctcgctgatctataagccgattgagaacatctcgctctacaccagctacagcaagggcctgtctctgggcggcaccgcgccgtggtttgccaccaacagcagcgaaaccctggcgcccaccacttcacggcagatcgaagccggggtgaagtacgattggcgccgcatcagtttcgccgctgccgtattccagacacgccaggcctaccaatattcgaagccggatggcgcgggcaactttacctatgtgcaacagggcgagcagaaaaacaccggcctggaactgtccgccaacggctgggccaccgagcgcctgcaaatagcaaccagcgtggccgccatccgcgcacgggtgagcggcagcggcaccccggactatgaaggccaccaggcgatcaacgtacccaagctgcgcgccagcctgtacgccgactatgcgttgccgtgggttaatggcctggcggtgctgggcggtgtgcaatacagcgccaggaagtcggccaaccgcaacggcactgtggaggtgggcgactatgcagtggtcaatctcggcagccgctacaccaccaaggtcgatggctatgaaacggtgtttcgcctgagcgtcgacaatctgttcgacaagcgctactggcgcgatgcgggcgagtacatgggcgatgactacttgttccagggcgcgccgttgacggcgcgcttgagtgcatcggtgaatttctgattcacccgccctaccggggttatttgggcatcttgcgaaagcccaccgccaggcggttccagctgttgatggtggcgatggccacgctcaggtcgacttgttcctgtgggctgaactcggcggccagggcattgaagtcttcatccggggcgtgggtctggctcagcagggtcaggctttcggcccaggccagcgcagcgcgttcacgcggggtaaagaatggggtctcgcgccaggccgacacggtgtacaaacgccgctcggtttcgccacccttgcgggcgtcggcggtgtgcatgtccaggcagaacgcgcagccgttgatctgcgagacgcgcaggcgcaccaattcgagcagcggcaattcgatggagagtttgccgaccgccgcttccagcgccagcatggctttcatggcgtctggggaagcggtgtagaaatcggtacgggtttgcatggtgttgctccagaacggtgggattggtgagcaggttagtcaccaaggcgtcctggaggaatagccaatccgggcgaagaacaggtgaccaatctacaggccacgcttgcgcagccattgcaggaaacccttcttcaccggcaccaccggcgcgtcttcggtcagggcctgggcggcatgccgacggaagtccagcagcgccttcatggcttcgccgatatcatgccgtgcgtccaggcagggcttgaggtattcattttcgatgcgataaagagtgcagtaggtcttggccgaaaaatctgccagcgccgcctgttccgagaggatgccggattcgccgatcacctccccggggcccatgcgcccagcctcgaacttgtgtccgtccttgaccaacagcaccgagaccacgccggattcgatgatgaacaagtgatcgctgacctcccccgccgccaggatcatctcgccggcgcggtaggtatgcagggtcatgttctggctgaaggtgtctttttcttcctggcgcaaggtggagaaaatcgacgagcgttccagcaacgcccgggcgccggacacggttggcggcgtgctgccctcggtggcggacagcagccccacgcccgccgcctgcaagtgccggtaggccaaatcgtaaagcaggttgcgcgtttcgcgcttgaggcccatggccggtacgaacccgctgatttcatattcgacgccgccactggtcgaggctttgaacgccacgctcggggcgggctgggccagtaatggccggcagccctgcattgcccgttccagggcttcgatcacggtttgcggacgtgcgtgggggctgacttgcaggctcactgccaggccgaacatgtccgccgggcgcgagaagttgatgatcttggccttggccgccagggaattggggatcaccgccaggctgccctgggaggtttgcaaacgcgtggcgcgccagtcgatatcggtgacacggccttcggtgccgtcgatggagatccagtcatcgatctggtaaggcttggtggtattgaggacgatcccggaaaacacgtcgctcaaggtactttgcaacgccaggccgacgatgatcgccaccgcaccggaggtggccagcacgcccttgaccggcaggtcgagcacataggccatggcggcgatgatcgcgatcaggaagatcaccgcgcccatcaggtcttgcaacaagcgcccggtatgcccgacccgctgcatcatcaccgcgccgagcaacaccgtcagggtgcgcgcagcgaacaaccaccagccgatctgcaacgccgtggcggccaggtgcaaggtggtgtcgtcagcatagggcgccccttgcatggggttcatgccgtcgttgaacaacacgacgctgaataccgcgaagatcaccaaccgcgcggcgagtttccagttggccaggtcggcggagataagacgccacacggcgatgtcgataaagatcaacgccacggcgcacagcatcgggtgatcagcgataaatgagggcatccaggcgactccagggcgaatgccgagaagatcgcatgaaatcgataagacgggtatagcgcaggaaaaaatgtgggaggaggcaagccccctcccacaagggttatttaaaccaacccggcattcaggcgtgcatctgcccgaacttgcccgactggaagtcggcgaacgcctgatggatctcctgctcggtgttcatcacgaacggaccgtggccgacgatgggctcgtcgatgggttcgccgctgagcagcaacaccttggcgtcgtcattcgactccagcgtgacctggtcaccgtcacgctcgaacagcgccagctgaccttggcgcgcaacttcatcgccattgaccagcacagtgccgctgaggatcaccagcgccgtattacgcccggcgtgcaggtccagcgtgaccgccttattggcattgaggcgcaagtcccacacgtcaatcggcgtaaaggtacgggccgggccatgagcaccggcgaattcaccggcgatcaggcgcaggttgccagcgtcgttcgccagtggcagcaccggaatatcgccatcgatgatggtctggtagccggcatcggccattttgtccttggccggcaggttgacccacagttgcaccatttccagcgccccgccgcgacgggcgaaatcctgggagtggaactcctcgtggagaatgcccttggccgcggtcatccattgcacatcgccggggccgatcttgccgccggcaccggtggaatcgcggtgctcgacttcgccgtcatagacgatagtcacggtttcaaagccgcgatgcgggtgctgaccgacgccacggcgctgttcggtgggcgtgaattcggccggcccggcgtggtccagcaacaggaatgggctgatgtgcttgcccatggtgtcgtaggaaaacaaagtgcgtaccgggaagccatcgccgacccagtgggcgcgagggctggtgtagataccaatcagctttttcatgtgtacctccaaagtgggtacacaataaatcgcctcactcctaagcactagacggcaaaaccggccctgatcgttctatgtataggacaatattttaacctggcgctggcgcaacaggtgaaatgcaacaaaggccgacagcgcaaaaccggcttgaataatcaccatcggcgcggcactgccatcgcgcaactggctcaatagcaaaccgctgcaggtggcaccgaacatctgcgcgaaccccatcagccctgccgccaaacccgcacggtgcgcattgggcatcaccgcgccggtcaccgcaccgggcaacaccaggccaccgccgagagtagccacggcaatgggcacatccagccctactaccgacagcccgaacagcgcgtagatcaccagcgccgctaccccgccgaccgcgaccattgtcacgcccatcgccacaatccgctgcggccccaggcgctggatattacgccgggtataggtggagcccacgatcagcatcgacacgatcaatccgaagttgaggccgtactccaggctgctgaaccccagcaggttgatgaacaccgccgaggagccggcgatcacggcaaacatcgcaccgtaggtgcaggccagggccacggcataggcccggtactggcggcccttgagcaggtccaggtattggccgcccagggtgcgccagtgagcggctttgggatcgaggtggtggttgctctcgcgaaagaacagcagcgccagcaccagcaccaggctgccgatcaccaacgccaggctgatcggtgctcgccaatccagtagcttgatcaacaagccgccaagcatcggcgcgacgacgatggcatacagcatgccgatcatggtcagcgccagggccggccccgcctcggctttccacacatcccgcaccaccgtgcgggccaataccaacgcggcgcacgcacccaggccctggaacacgcgggcgaggataaattgctggatgtcgctgaccagcagcatcgataacgtggccagcacatacaacgccaggccggcgatcaataccgggcgtcggccaatacggtccgacagcggcccgaacagcaactgccccaggccaaaggcaccgacaaacgctgacagcgccagcagtgccgagcccaccggcgccgccagcgcctgctcgatggcgcccaggcccggaatgatcaactgggtcgagacttcacccaaggccgttaaggcaaccagtaataacaacaagctgcgtgaaggtgccggggcgattgccatggggattatccgggggctggattaatttatatttcgaccataatatgcgtaaaaaattatgtccataattttttgcccaatggttacccctggagcacgccatgccccctctccccctgcgtcttctcacgcccctggccctgttgatggtgctcggtggctgccacagccaagctgacaacgccgctcaagcgccgcagccacgtcccgtattggcggccaccgtcgaagccgctggcacccagcaaagcgcgtataccggtgtggtcgctgcccgcaccgaaagcgacctgggcttccgggtcagtggcaaggtgatcgagcgcaaggtcgaccccggccagcgcgttgcccgtggcgataccttgctggtgctggacatcggcgacttcgaactggcgctgcgctcggccaagaatcgcgtcaacgccgcccaggcccagctgcgccaacgccgcgacgatgaaaaccgctaccagcgcctggccagtaccggcgcagtgtcacggcagatcttcgaccagtcggccaccaacctgcgtgttgccgaggcggaactggccgcggcgcagtccgatgccagccagatcgaaaaccgccgcacctactcggtgctcaaggccgatggcgacggcatcatcaccgacgtgcgagcagaccgcggccaagtggtggccgaagggcaaatcgtcgcgcgcctggcccacgacggcgcccgtgaagccatcgtcaacctgccggaaaaccagcgcgacctggccgcgcaaaaagccctggccttccccttcggcgcccccgatcaggccgtggccgcaagcctgcgcgagctgtccgccagcgccgaccccatcacgcgcacctaccgcgcccgctatgtgttgcacggtgccgtcgagcgtttcgccctcggttccaccatcaccgtacgcctgcaaggcaacggccaggccgcgcaaacccgcgtgccgattggcgcgttgcaggacgcaggccagggccccggcgtgtggctgatcggcgatgacaacacgctgaccttcgcgccggtgaaagtcgcccgcctcggccaggaagacgccctgctcgacagcggcgtcctgcctgggcaaaccatcgtcgccctgggggcgcacctgctgcacggcggcgacaaggtgcgcttgctacccgcccaggcgctggccctcaaccgcaagcaggaccaatgaccatgcgcgggctcaacctctccgaactggcagtcaaacaccgcgcagtgacgctgttcctgctcattgcaatcctggtcgccggaatgttcgcgttcggcaaactggggcgcgccgaagacccctcgtttaccgtcaaggtcatgaccatcaccgccgcctggccgggcgccaccgcccaggagatgcaggaacaggtggccgaccgcctggaaaagcgcctgcaggaactggactattacgaccgcgtcgagaccatcgcccagccaggctttgtgtcgatgcgcatgacctttctcgaatccacgcgcccgagcgaaatccaggcactgttctaccagacccgcaagaagctcagtgacgaagccgcgcaattgcccaaaggcgtgatcggcccgtttttcaacgatgaatactctgatgtgtatttcgcgctgtacgccctggaagccgaacacctgccccatcgtcagcaagtgcaaatggccgagaccctgcgccagggtttgctcaacctgccgggggtgaagaaggtcaatattcttggcgagcaggcccagcgggtgtttgtcgagttttcctatgagcgcctggcgaccctgggcatcaagcccgagcagattttcgccgccctcgccgcacaaaacgcggtggcgccctcaggctttgtcgagaccgctggtgcccgtgcgtatatccgtatcgacggagccttcgacagcctggcgctgattgaaaacgtgcccctgcaagtcaatggccgcgtgctgcgcattgccgatgtcgccagcgtcagccgcggttatgaggacccgcccagctaccgcatccgccaccagggcgacccggcgctgatgctcggggtgatcatggagaaacactggaacggcctggaactggaccagagcctgcaggcccaggaagccaaaatccgcgccgacctgcccctgggcgtgaacttcgtcaaggtctccgaccaggcgaaaaacatcagcctggcggtgaatgagttcatgctcaagttcttcgtcgccctggccgtggtgatgctgatcagcctgctggccctgggctttcgcgtgggcctggtggtggcggcagccgtgccgctgacgctgtcgatcgtgttcgtgatcatgctggtcaccgggcgcgaattcgaccgcgtgaccctgggcgcgctgatcatttccctgggcctgctggtggatgacgcgatcattgccatcgagatgatggtggtgaaactcgaagaaggttttgatcgtatccatgcggcgacctacgcctggagctccacagctgcgcccatgctgaccggtacgctggtgacgatcatcggctttttacccgtggggtttgcgcgctccggtgcaggcgagtacgccgggaatatcttctggatcgtcggctttgccttgatttcatcgtggttggtggcggtggtgttcacgccctatctgggcgtgaagctgttgccgcagatcaagcctgtgcccggtgggcacgatgcgatttatgccgggcgttattatcagaaactccgtcgcttggtggaggcctgcgtgcgcgggcgctggctggtgaccgggctggtggtggccgcgtttgtgctgtgcggcctgggtatggcggtggtgaagaaacagttcttccccgactccgaccgttcggagctgatcctggaagtgtatatgccgcccggcagcgcattcaaaagcactgaagcggtggcggcgcaggtggagaaagccctgttgcaggagccgcagaccagcatggtcgacacctacgtaggcggcggtgcaccgcggttctttctgtcgctgaacccggaaatgcccgacccggcattcgccaagttaatcgtgcaaaccccggactcccacgcccgtgacgcgttgaaagtgcgcatgcgcgagcgcatcgcggctggtgagtttccagcggcgcgggtgcgtgtcacgcaattggtgttcggcccgccggtgccgttccccgtggtgttccgtgtatccgggcccaacctggacgagctgcgcgggctgtccgagcaagtgcgccaagtggtggccgccaatcggctgacccgcgacaccttcctcgaatggggcgagcgcgccagcggttatcgcctggtgctggaccaggatcgcctgcgcttactcggcttcacccccgacgaggtcaagtcccagctcaacgccctgctcagcggcaacccgatcaccgaagtgcgcgagggcaaccgcaccgtgtcggtggtggcccgcgcccaaggcagccagcgcgaggacctcgccaacctgaacaacatgaccctgaccaacagcgccggtacgtcggtgccgctggctcaggtcgggcatttccaggcagtgatggaagagccgatcctcaagcgccgcaaccgcgcaaccaccgtggaagtgcgcgccgacatcatcgacggggtacagccgcccgatgtggaaatggccgtatacaaagacctgcaaccgctgatcgccaagctgccgaccggttaccacatcgacatcggcggcccggtggaagaaagcgccaaggccaacgtggcgctggcggcattgttcccgatcatgatcttgctgaccctcacggtgatcatgttccaggtgcgctcattcggcgtgatgttcatggtcttcgccaccgcgcccttgggcctgattggcgcagtgccgaccttgctgctgttcaatcaaccgtttgggtttaacgcgatcctgggcctgatcggcattggcggcatcctgatgcgtaacacgctgatcttcaccgaccagattcgccagaaccaggaccacggcatggcgattcgcgaggcaatcatcgaagccacggtgcgtcgagcgcgtccggtgatcctcaccgcactggcagcggcgctagcgtttattccgctgacgctgtcggtgttctggtcgtccctggcctatgtgttgattggcggggtgttggtgggcacggtgttgacgctgttgttcctgccggcgctgtgcagcctggtgctacgcgacgaggttgctgaaacgtcccacgtaaacgccggataagctctactccccctccctgcaaacctctgcaaagtccctcgcctgactgaacagtgcgagggattgcagatggtttttcttgttagtgcgctggttgcgtggccgtcccccgtggggagtggtcgcggatgacccacgccacccacatcgccgctatcgaacacgagctggatagtttccatcagagcctggtggagtaccgccagcagatgggcgcctggtattcgcgtgcgctggattcggtcagtcatgcagcggatatgccgtcgttgctgggcatggaccgggtgttacgggttggggattcccagcgttcggtaagccttagcgacgcggatttttctaccgtggcccgctgcccggtgggtggtgtgctgaagatcgagagcaaattcgaatcagcgtatgacgtgccgattggcgatatcccggttgaggtgattggcctggatgacggcagttccacgcgggtgatgctcgataagcacggcaagggttcgcactactgcgccgccggcgggcgctatcaggtgcgggttcagggtggtgtttcagcgcaacaagtggacgccttgtttacctcctatgccgggctgacggcggacttggaacagtggcttcggtcgcagtggaaaagcttcaaaccccactgggaaagctctactgccagcgcgattggcagcggcgtgctggcaggcagctgggcggcgatccatgacgtgtgggacagcatcaagctggtgcaggcgatgcttgaagacccgttgaagtacgtggagcaactgggcagcgaggcggccaagttggcgcagatcgccaccgatgcgcccagggtcatggagcaggcgatgctgctggccagtgatgaagcggcgctgtacctgttactgcgcaccgccacgatctggctggacgcgttaccgcccagtgaagttgcgcaggcagccgccagttttatggtgtcgctgctgattgatctggtgattggcgcagtgttgaccatcgcgttgccagcggcgggcgtggcgtatttgagcatgcgcctggtcaagtacggcaagcagattcttgaggctgccgtgggcttcgtgaagggcgtgctggcgatcctcacgaagttcatgcaggcggtggaccgctacaaagcggtggcggttcgcggggtggtcggcgggctgaagcagggcacgatgcagatgcgctggaaggcgcggcagaacgcggtgctgaagcagaaagagcgtgtggatgatgtgcctgtcgtggcttcgaatcccaagggggatgcgacggcgcctgcggacaagacggtcactcatggctgcccggtgtcgatggtcaccggggaggaattgctgaccctcaccgatggtgcgctggacgggatcttgccgtttgagtggacacgcttgtatcgcaccagtgcggtggaagtggattgtgggttggggtttggctggagtcatgcgctggcgcatcggcttgttgtgtcgggcgaatcggtggtgtggacggaccatgagaatcgccgtacgcagtttccgttgcccaccgattctcgacccgcgatcaccaatagcctggcggaagcggcgatctacctgggctcggcgcctgatgaactggtgttggcccaggcgtcgcggttttatcactttcgcgacggtgtgctggtttcgatcagtgatgcgtatgacaaccgcctgcgcatttgccgtgatcattccgggcgaattgagcggttggataacggcgctggtcgctcactgttgctgcgctatgagctggatcgcatcgtcgcggtggattaccaggttcatcgcgccaaagaccgtgggccctacgtctgggagaccgagcagaacgtcgtttcctacgcctatgacgaagacggacgactggtttgcgcgaccaatgccgtcggggaaagcgagcgttatcggtacgacgatcagcacgtcattgtcgagcggcagttggccggtggggcgagtttcttctgggcgtgggaaggctctggcaaggcggcacgctgtgtccggcattgggcgagtttttcgcagatggacacgcgttatgcctggggggatgacggtcgtgtcaccgtgcataacgccgatggtagccaggaagtgtatgtccacgatgaacgggcgcggttggtacaacgcatcgatccggatggcgcccaacatttcaaatcctacgataaaaaaggccgactgaccgtcgagcaagatccgctgggggcggtgacggcctatcagtacgacgaagccggacgcttggtggcgctgtttccgggggaggacgagccgacgtcctacgagcatgaaaatggctttgtacggattgtcaggcgcggtgaagcggtctggaaatatgagcgtaacagccagggcgacgttacgcgtaggaccgatcctgacgggcaggtcacggactacagctacaacaaacgtgggcagttaaccggagtttggtatcccgatcacagctgtcatcggctggtatggaacgaacgtgggcagttgcttgaggagcaattgcccaatggcgggattaagcgctatcgctatgacgatctggggcggcaagtagcgcgtgaggatgaatacggggcgctgacccgttacgaatgggacgccgtaggacggctgctgaaactgacccagcccggcggcgcttgccgggaattgagctacaacccctacggaaaaatcatcgccgagcgcgatgaactcggccacgtcacccgctacgaatacgaaggcggcctgcacctgatcagtcgccgcctcaatgctgacggcacccaggtccactaccgctacgacaacgcccggctgttgctcaccgagatcgaaaacgaagtcggcgaaacctaccagctcacctatcaccccaacggcctgatccaccaggaaaccggcttcgacggccagcgcaccgcttacgcctacgacctcaacggcaacctgcaggaaaagaccgaatacggcgacgacggcagtcagctcattacccgttacgagcgcgaccatgctgggcgcctcgtccggaaaaccctgcccgatggcagcctggtcgattatgcctacgaccgccaaggcaacctcctcagcgtcgaagacggccattgggccctggcctacgaatacgaccggcaaaaccgcctcaccgccgaacaccaaggctggggcaccttgcgctacggctacgacgcctgcggccagctgaaaaatctgcgcctgcccgacaacaaccgcctcaccttcaaccacgacaaaggcggccacctcgccaccgtcgagctcaatggcgaagtgctcacctcgcacctgttccgtgccggtcgtgaacaccaacgccaacaaggccagctgctcagccactaccactacgacgaccaaaaccgcctgcacgcccacgccgtcacacagcaggaaaactacctttaccagcgccaatacgactacgacaaatccggcaacctcacccgcctgctcgacacgcgcaaaggcgaacatcgctaccactacgaccccctcgcccgcctgacccgcgccgatcattcgcaggacgtacaggaacgcttcgcccacaacccggcgggcaacctgctcatgcaagaccgcccagggccagacatcgtcgcggcgaatcgcctggtgattcagggcgaccgtcactatgactacgacgccttcggcaacctgatccgcgaacgacgcggcaagggccatcagctcgtcactgaataccgctacgactgtcagcatcggctgatcagcgtgacgaagcccaacggcgaaaccgccagttaccgctatgacccctttgggcggcgtatcagcaagaccgtagatggcaagaccacggagtttttctggcaaggcgacaagctgattgccgaacatcacgcggaccgccaccgcagctacatctacgagcccggcagcttccgcccactggcactgctggaaggcttcggcccaaaagccacaacggcctaccactaccagctcgaccacctcggcacaccgcaggaactcaccacgcccgaaggcgaaatcgtctggtccgcccactaccgcgcctacggccagatcgcccggctcgacgtaggcaagatcgacaacccactgcgttttcaggggcagtatttcgatcaggaaagcgggctgcactacaaccgccatcgctactacaatccggatatcggtcgttacctgacgccggacccggtgaagttggcgggtggggtcaatgggtaccaatacgcgccaaatccgacaggctggatagacccgctgggcttgaatacatgcccagatgagaacggatgtaaacccagcgctagtgttcagaaccctaccgcgagtgttagccacggggaaccggccttaccgcaactgccccgctcgcagcggcaggcgcgaattgatgagcttgcagaggcaaacgcatatagacgtttagacgagcttgaaaaagcaacacccggagcacactttttagaaaaacacggaaagcagacgacactagcgtcacaactagaacgactacagacggctaaaaacccaacaacaggaataatcgaatatttcacatcagggcgaagaacgggagaaccaaaatacccgcctgctgctacccacttcttaagtcatagagatcaattgaatgctatatatcgcgctcagctaatcttcagaagaagcggacacgcccaatccatggagccaatacatatgggaaaaattataggtgaggggtattctggcaccgaaatgcaatacagccaacaatcgaaggcacgagtaatattaaatagagatggcaaacccaaaacagcctatacggaattatgaagatgaaaaccaaaacacctagcatgtcaataattcgcggcctgctattcacttatgacattgagaacactgatgatttaaaaagggaggagcggatcgcgtctgtagacgcaaatgacgaaaaagagctcgccgaactttttaatgatctgaccaagccagaatttctgatgtatacgagactagagcaagactggtttattgcctcaattgaacactttttagcaaaaaacgacagcttcgatgatgtattcaaaacaatgacaacttactttagcactgagatagttgaccaacaaaaattcatgagcgtgctattacgctgcttgcagcactacaagctagaaaccgatgcgagcggatgctcccaaacaaataaataacccactagaaaggaaaaccctatgcagctaagcacccagtttaaaagttatcgagctcaattcgctgtcctaaatgaagcaaccacaagagcagaacgtaatctacctccttttacaggagaggattattatggcaatccaatcgtccgaatcgaaatgcagggttgcggaagaggatacatacctaaccctgctgacctgaacaatccaatatttgatgaaaatatggatacagcgatcgcaaagtttgatcgtgaaacaaaaaaactttataccgtattccctgtgagcaacgaccaatgctgaaacaccctttcctgaatataccgtacgcaccaaaacttcggcatttcctaggcccgttcgatatttatgatcgcgaagaaactttaggtaaagagcttgcatgttacgatgtaaacattgacatcgaccgaacacaattaatcaaaaaatatataattgagaaattctcagacttaagttatcggcatcgtaaaatcctatgcgatacattggaggcagcacttatcgataaaacctatgatttttcgcaattatttagacaggctcctggctattattgcaacctgccttggggatggagtgaaatggacaatccaagaggctttttcgaagagatttacagattaactaatgagtggtggaaagaagatctccaaaaagccagcctcgaagaccctgccacatggtgaccacaagtattgaatacaccaaatatccaatgtgggagggggcttgcccccgatagcaggggttcagtcaatgcatgtgcaagctgacccaccgccatcgggggcaagccccctcccacatttggactgaggcgcatcaggtaatattcggcggctgagatatcgccactgctgcaagccccgcacatttgaatctacttcgtcctgtgatcccggatctgatcagcgcttggccagttccataatcatccggctcaacaaatacacccgcggcaccacactctctacctcggcatattcctccggtgtgtgaatattcccgcccactatcccaaacccatccaacgtcggcgtacctaccccggccgacaaactcgcatccgccgccccaccgctgccttcaatggtcaacttacgtcccagctcggcataaatgccctgggcaatcgccaccaatttatccgactccgctgtctgtggcatcggcggcaagccgcgttgcaggctggtcttcacgtcggtttcggggatcaacttgttggctgaaacccgggccaggtccttttcgattcggtcaaattcctccggcaaggcggcgcgtacgtcggccttggcggtggcttggtcggggatcacattggtgcggtcaccggccttgagcacggtgaagttgatggtggttttcttgtcttcatcgcccagcttgcccagttgcaggatctggtgcgcggcttccatggcggcgttgcgtcccagttccggggcgacgccggcgtgggcggccttgcctttgacttcgaccacggcggtggcgctgcctttgcgccacaccaccaggccgtcggctgggcggccgggttcgaggttgagggttacgtcgtggcccttggcggtgctgcggatcagctcggaggcggcttcggagccggtttcttcgctggcgtcgagcaggaaggtgatttgcgcgtagtccttgaagccctggttcttcaggaccttaagtgcgtagatgccggcgacgatgccgcccttgtcatccattacgccggggccataggcgcggccgtccttgatgtggaacgggcgctcggcggccgagccttccttgaacacggtgtccatgtgggccatcagcaggattttggccttgcctgtgcccttgagcgtggcgatcacatggctgttgttggcggctttgtccggcaccagttcaatgctgaaacccaactgtttcaactcgtccactgcgatatcgcgcacttgggtcaggcccggctcgtagcctgaacctgaatcgatgttcaccaggcgttcgagcagtttcagggcctcggccttgtactgttcggcatcagcctggacctgcttgtggggttcggcactgtaggccggcagggcgaaggaaaaggccagggtggcggccaggagggtacgcgggaaagtgaagagcatggaccgatccttgtttttttgttggaaggcgcgccaataccctaccccactagaccgagcgcaaccaactcccctgccctgcgctcacgcggttgcgcccgctgctcttggcttcgtacaacgcctggtcggcatcgttgagccaactgatggcgtcggcatgggccggctgataaagcgccaggccgatgctcaagctgacgcgcagcgccgggtcctgagtgtaggccaaggcgttgaagcgatcgcgcagcgcctccatgacctcagtggcacggttgagcggcatgtctggcaggatcacacagaactcatcaccaccgtaacgtccggccaggtcggtggtgcgcaggttctggcgcagcaccttgctcaactggcgcagcacgatatcgccggtaacatgaccgtaggtgtcgttgatggtcttgaaatggtcgatgtcgatcagggcgatggctgcaccagccgggcctcggcggcagcgttggaattcaatgtccaggtggtctttccaggccccgtggttgagcaggccggacaggctgtcggtgcggctcagggccagcagttcgcgtttgtggcgggccagggttaccgcctggcggtagcagatccagcccagggccatgggatacagcatcaggataggcaggcaggcatacacctgggcctgggtggtcacggcgatgaacgccggggcgaatatcagcagcgccgtgcccagccccagcgcctgtgccacccagccggcgaacatgaagcgcgggccgccgatggcaacgttgttcatgctcatcatcgacaaggtggtgacgctgggcagcgggttgaagtgcatcgcgccgacccagaagccaccgcagaaggagtcgaacaacaggctgcggcgttcactgcgcaacgtgtgggccgcacgcagggaaatttgaagaaccacatgcggccacacaaacgcgttgatcagcatccaaacccacacccatacagagggactcagcggatacatgccaaacgcgacgcagataaagccgagcgtgagccccaggaggcgtgatttgtacaagcgcgaagcgagcggaagtccatttcctccgacggctggcatgatggggtgcgatcctgggtgagtgtctcgagtctatcagggcagcggcaaatcgccactaccgcttagaagctgacgtcagtgtgaaaacccacgcgccagcatcaacgcaacgcccaacagcaacaccgcggtgatgcgctgcaacaacacccgccgcttggggttttccaacacgtgcttgatacgctggccgaaatagcaatacaggcagccgctggcaaattgcagcagcaggaacgtcaggccgaggatggcgatatccgccgctgaactgtgctcccccgacccggcgaactgcgggaacaccgcactgaacatgatgatggtcttggggttggaaaacccggtcaacagccctttgccgaacaggctgcgcgagccctccacggcgccggcgttgttgatcgccacaccgctgctggtccactgcttataggccaggtacaggatgtaggccacgccgacaaactggatggtctgggtaatggcgaggttgcccttgatcaactccgagaagccgacggcaaagatcaggatggaaatcaggtacgacacgctggcgccgatctgcgccgggatcgaactgcgcagcccgtccttcaagcccaggctcagcaacagcagggtcatggggccggggctgaaggtcatggtggcgcaaaacagtaggaagtagagaaacgaagacagggttaacgcacttgtcatggccagggaccttgagtggatagaaacagcaacggggcgagcgccgcaagcgcccacccctgggcccgtcaggcgacagcgatttcggtcgtcagggattcgcggtacatcaccgccaggtcagccagggctgccttggcagtctggttacgggtttcgaaagccaccaagcccttccagttggtctcgacgatggcctgcatgacgtcggcatagtcacagttgccgtcgtgaatgccgaaatgctgatcctgcacgccattgttgttgctgaaggaaatgcccttgatcaggtggtgatacttgcgcaccacttccgccggcaggccgttctcgatgttggcgtggccggcatcgaggaaaaagtacagattgctgtgggcttgcaggcgttcgaacacaaaggcgtattccgcttcatgggtgaagatgtagtggaacggccggtagttgacgtagttggacaggttttccaggtagatatccgtgcccttggcctcggcgtaaatcgccagttcctgcaccgacttgaggtaatgctccagggcgaccttcttggccatcagcaccattttcggttcgacgatgcaaccgccatgaatgatcagtggcgcgcccaggcggctggcgatgtcgatttctttcttcacatattccacggctgctgcacggaacgcctcgacgtcactggccagcggcgccttgaagttgccatggaagatcggcttgatgccggtggcagcgatttgcgcctgcagacttgcgatgcgtgcatcggtccagtcgtcgaccatttcgccaaacaggctgccgtcgatataccaatgggtgcagttgccttcgatggcggtttccaggcctttctcggcgcccaggtatttctggtgggctacaccggtgcagaacggcacggtggcgttgatcagtttgctttccatggatcgattcctttcgtggatggagcgtcaggcttctagaggttcggggagctcaatggccatgaagtcagccttggtcacaccgcaatccgggcatgtccagtcttcaggcacctcttcccaaggggtgcctgcgggtatcccgtcctccgggatacccaattcttctacgtacataaaaccgcagggagcacacatataagtcttcatgagaatgcagaatccattgcccgcttgtaggaaacttcgccaactcctggcgagatgccgcgcagtctaggggactggcattgcacaaggcaggtaaagtgatgcctaatccggcctaacttcaccggtaaaagcaccagcaaagacaaggaaggttcatgtttgtatcggctatcgcctttgtggatggcacccccaaggtgcaacagatcgtcgaggcgttcagccaggccatcgaaaacggcgaatgggcaccgggtagcaagttgccgtcggtgcgtgaactgacccaggtcctgggcgtcagcaagttcaccctcaacgaagcgctggaccgcctgcgcgggcgccacctgctcacctccagccagggtcgtgggtatttcgtggccatggacaacgcccgcccggcgtcggtgacctgggtcgacctgttgccccaggacctgctcagcgtattgcgccgccccttggtcaccgccagtggcgagctgcgtcccggtggcgggcacctgccggaggaatggctcaatggcgaggcaattcgccaggccatgcgcagtgtggtgcgcgcgccgtcgttgcgcatcgccgggctgggcacgccggccgggttgctgccgttgcgtcaggcgttgcaacagaagctgcatggcgagggcttgtcagtgccggtggagcaaatcatcacgacgcccaataccgtgcagggcctggacatgctcatgcgcctgctcgcccggccgggcgataccgtgctgcttgatgcgccgtgctatttcaacttccacgccaacctggcgctgcacggcgtcaaggtcatcactatcgaacgccgccccgacggcttcgacttcaccgccctcgaacacctgctcgccgaacatcgccccagcctgtacctgaccaccagcgtgttgcataaccccaccggccactccttcagcccaagccaggcgtttcgcttgctgcaactgacccagcagtaccactgccatatcgtcgaggatgacctctacggcgacctgcatcccaacccgccaccgcgcctggccgccgtcgccgggctggaccaggttacctacctgtcggggttctcgaagatcctcagcgccaacacccgggtcagctacgtggtggctgcaccgcaactggccgccaacctgaccaacatgaaactgatgagcggcggcgtgacctccgaactgttcgaacagatcgtctaccgcatgctcagcgaaggcagctacgccaagcatcgcaagcgcatggtgcaacgcctgatcgaggctggcgggcgcgtcgagcaatggctcaagcgttgcggctgcgaactgccgatggcctatgaaggcgggatgttcatctgggcgcgcctgccgccaggggtcaacggtgaactgctggcccaggaggcattgaaacgcagcatggtgctcgcgcccggcgcgctgtttggctacgatccggcccatcgcgactcaatgcgcttcaatgtggcccacagtgatgagccgcgggtgcagcgggtgtttgaggcgctgttgttgcatggagttgcccagcgcaattgccgcgcgtaagcgtcgcccaatgaacctttcaccccggcagcggaatcactcgcaacggccgcaccgacttataggaaaagctcgagtagatctccttgacgcagggcaaggtctgcaagacctcacgggcaaactcgccaaacgactccaggtccttggccactacttccagcaaaaagtcatagcgccccgacacgttatggcacgccacaatctcgggaatttccaacagccgctgctcgaacgcccgggcgatgtcctgggtgtggctgtccatcatgatgctgacaaaggccgtcacgccgtagcccagcgccttgggtgaaaggatcgcctgatagccactgatcaccccgctgtcttccagcgcgcgcaccctccgccagcacggtgaagtggtcaaggctacccgctccgccagttcggccacggtcaggcgggcgttgccttgcaatgcgtttaacagcgctttatcagtacggtccagcttgatgggcataacgtgcctctaatcattatttttatcggtgtttgatccacaaacgcggcttttcccaacattttttgcaaggtttatctgcggttatgagcatagcattgtaggaaataaggagcgcccgacatgaacaataaacacaacacattcggcttttctacccgcgccattcaccacggctatgacccccaagaccaccacggcgccctcgtaccgccgatctacctgtccgccactttcgcttttcccaccgccgaatatggtgctgcctgcttcgccggtgaagccagcggccacttctatacgcgcatttccaacccgaccctggccctgctggaatcgcgcatggctaccctggaaaacggcgaagccgcggtggcgttcagttccggcatgggcgcgattgccgcgacgttctggaccctgctgcgcccaggcgatgagatcatcgtcagccagaccctctacggctgcaccttcgcgctgttgcaccacggcatcggcgagttcggcattcaggtgcggcacgtcgacctgaccgacctggccgccctggaagcggcgctgtcgccggcgacccgcatgatctattgcgagaccccggccaaccccaacctgcgcctgatcgacatcgccgcggtggccaagcttgcccaccgccagccgaatatcaccctggtggtggataacacctactgcacgccgtacctgcaacgtccgctggagttgggcgcggatgtggtggtgcactcagccaccaaatacctcagcggccatggcgacatcaccgcaggcattgccgtgagcagtcatgccctggcgcagcgcattcgcctgcaagggctcaaggacctgaccggtgcagtgatgtcaccccaggacgcgtcgttgctgatgcgcggcctcaagacactggccctgcgcatggaccgccattgcagcagcgcccaggcagtggccgaagccttgcaggcgcacccggcggtgcaatgggtgacctaccctgggctgcggtctttcccgcagtacgcgctggcgaaacgacagatgaagctgcccggcggcatgattgcctttgaactcaagggcggcatcgagatgggccggcgcttcatgaacgcattgcgcctgttcacccgcgcagtgagcctgggggatgccgagtcgctggcccaacacccggcgagcatgacccattccacctacacccccgaggaacgggcgcagcacggtatcagcgaaggcctggtgcgtttatcggtggggcttgaggatatcgcggacctgctggcggatgtgcaccaggccctggccaagtgcagccgccccagcatgcgccctgccgcaacagcagcccacgtcctgagataacgcctcatcagacgttgttctttcctgcaagcggtggtcgaacttatcgctcgtcgctataggatttaatctgttttttttggttggaatccccttcccttcgccagcctgtactagcatgggtctcggcgggaagtattatcactgcgggttattcatattggtcatcttgttaaaccccgtcgctatatggctggatgcccgcgctcgatactcatggacgaattgatgaactcacacctgttcccccatataggcaaggtcatcgccagcaccggcagccgccattttccacgcatgctgcatgatcttatcctcacccaattggcagtggatgccacccatatcacccagctgcgggtcagcagcaaaggccatagccgccgcaagatcagcccggtctacaccgactcggtggcgaccctggggcctgagcaacctgcggcacaactgcacctcacacggcgcaaggacgatgtgcgctacgtgctgtcggtgtaccgctcacacccatccgagagtttttccgcgcaagagcgcagcatgctgcaggacttctccacgatgttgctgcccatggtggaaaagcacatcaccgcgatccagccgtgccgccaggacaatgggccgccagtgccgcaaaaccagggcatcgacaccctgcgccgacgcatccaggagcgcctggtgcagtcggggctgagcctgtccaagcgtgaattggaagtatgcgtgggcctgctggccggccgcaccgcgccggaactggccgagcaaatggcgctgaaggtcaacaccatcgaaagctacctcaagcgcgcggcgatcaagctgggcatcagcggtcggcattcgttgttgcggtggatgtacgccacagacgacaacacaagcttttaatcccacatttggtctgtgtcgcctgctcgacatgcattgttaaaggccagcaatccatatccctttaatttgcaggacgtttcctagacaatccttcgggcttgcgcctgctcaatccactggctggctagcctttgcttcgtcgctgcacatcagcgatcgggtgtgagatcccgtgtatgagcaggcaccatgcgctacaaccgtctatggcggctatgtgcgggcagacttcggtctggccgggtcctgctttccggtatctcaccccgcacatagctgccaccttttgacgtgtgagatcggcaaaagaatggctcccaatccaagcaggagcttcacccatgagcaaagttgtccccgatccaccctattccgtttttgttgcccacgaagacctgagcttcgaagacgcgatcgccagcatttcctcgctgctacgctgcgccaccaccaccgccaccgaaaccgccgagggcctcaaaggcacccaacgcgacatggcctgctccaccacccacttgatcgacatggcccgcaccctcgccgaccgcgcactggattgcctgcaaaccaaacctaccaacaccccataacccctgtgggagggggcttgctcccgatggcggtgggtcagccaattaatccatatctgacccaccgccatcggcagcaagccccctcccacattttgtgtccacggctgaccggctaccaatcgccccccaaccccaacaaccccaaaatgctgcgccgcaaatccaccagataaggatcatcccgatgcctgggatacggtcgctcaatcgtcaactgcgcctgaaccttggctggccgatcgctgaacacaaccacccggttggccaacagcagcgcctcttctacatcatgggtcaccagcaacgccgtatacccctggcgctgccacagcccaatcaactccttttgcatggtgattcgcgtcagggagtccagcttgcccagtggctcatcaagaatcagcagccgcggctcattgaccagtgcacgggccagggccacccgttgcgccatgccgccggagagttggcgcgggtaagcccgggcaaactggctgaggccgactttctccagggcctggtcgaccttcgccgcatggcccttgagcaagccctgggcctccaggcccaccgcgacgttgtcccacacccgtcgccacgggtatagcgtcgggtcctggaacaccaccacgcggctggggtccgggccggtgatgggctgcccgtcggccagcaacctgccgctgtccgccggctcaagcccggccaccaggcgcagcaaggtggattttccacacccggacgggcccagcaacgcgacgaactctcccgctgccacgtccaacgagacccgttccagcaccggcaagtgctggccgtccaaggcaaagccgtggctgaggttttcaatgctcagcgccaaccctgtcgatgccgctgctgttggtgcgagggctaccatttcatcgttcctttctgccaggcaagcaaccggtcacgcaccaggaacagcccggtgatcaaccccgaacaggccagggccatgatcaacaatgccgcgtacatattcgcgtaggccgcccagccctgggcccattgcaggtaaaagccgatgccggacttgacccccatcatttccgccaccaccaaggttgagaatgaggcgcccaagcccatgaacaggccgacaaacacatggggcatcgccgccggaatcgccactttgaagatcaggaaaccgggcttggcgccgagggtgcgggccacgtcgtaataagctttatcgacactagccacccccgaccaggtcagcaccgtgaccggaaaccaggtagccaaggcgattagaaacacgctggcgctccaactgctgggaaacaggaaaaaacacagtggcaacagcgccgtggaaggcaccgggccgaggatgcgcagcaccgggtgcagccaatagccgatgcgcgtggaccaaccaatggccacgccggcgataaaccccgtcgccgcgccaagggccacgcccgagcccagcagcaatgccgagtgcagcaggctgtcggccaagcgcgggtagtcttcgatatacaccgccagcagggcctggggcggcgcgaagaacggcaccggtaacagcgcaagcttggccgtgagcagttcccaaagacccagcagcagcggcaacgcaatcagccagggcgtggcattgcgcaggcgcagcgccaatgtcgacagcctgcgccccaacaggctcaaggtactgaacaccacggccacgcccacgcagaaattggccaagccttgggtcatcggccagtggcgtgtcgcgttgggccaatagctgatcagcagcgcgacggccacccaggctgctacgacggctgcgccgtgccagccgagcttgaaggccaggggtgggttgagggtgctggcgtcaactgaagacatcggcggtgatctccttggcgaattctaccgggtcggtgcctttgctgatcacctccacggttttcaggtcggtcacataggtggtgatttcctcagtcagcgctgcgcccaccgcgtggtggccgtgggtgtgatcgtggagaatcgcctgcacttcttcggtagaggtgttcagtgcaaaagcctggaagcctttggccacggcttctgggtgttgcacggaataatcatgggcttcgaggatcgcctgggtcagggccgcgaccacgcgcttgtcctcgcgcaccaacttgccggtgacgccgaccacgcagcaactgaggttggcgtattcctccaccaggttagtggacagctcgcgtgccacgccggacttgatcaggcggtacatgaacggatcactgccgctgaccgcctgcacttcgccacgctccaaggcggtgcccaacaagtcggccgggtacaggcgccattccacatcgcgcaccggatcgaccccatgctttttcagtaggatcgaaaagaaattgcgatccgggctggccatgtcggtgatgccaatggcctttccctttaggtcttccagcttgctcacgctgccgcttgccgcactgagcaagcgcaggcaaccaccgtgggtgccggcggtgagcttcacgtcgaagccctgttccagagccttgagccaacgcagcgccatgcccaccccagcgtcggccttgccggtggcgatggcttcgagcaatacctcggtggagttaccgaagttgaccagttccacgtcgaggttgtgctgagtgaagaagccctggccgtgggcgatcaccaccggcgccaggcacaccgcgttgagattgactgccaatttcaacttgcgcggtgcatcgaggcggatgaactcaccggtgccggcaggttcctgggggatgttgtggccggcgtgtgcgtcgccagcaaagaccaggcgcggcagcgtcaggctggccagggtcaggccggccatgccgagcagacggcgacgggttaaagggtcgaaggcagccatgcacgatatccttgtttatacgcagattgattgtgcttttattatattaatgactgattattatgatagaaacatataactctatagatatgccagattcagcaaaagccgaaaaaagcgccttaagctcagatcgaaagagtatttatcgaatggttttcagacccttatgcttcggttcattttgttgaaaaatcgagcgcctcatgacccttcgccaccctctcgccgctgtattaggattgctggcttttgctgtcgctgtaagtgcccaggctcaggaaactttgcgcatcggctaccagaaatcctcgaccctgatcaccttgctgaaaacccaaggcaccctggaaaaagctctcaaggccaaccacgtcgacgtcagttggcatgagttccccagcggcctgcccttgctcgaagcgctgaacgtcggcaacgtggatatcagcgccgatgtggccgataccgtgccgatcttcgcccaggccgcccaagcccagctcacctacttcgcccaggaagcgccctcgcccgcggcccaggccatcgttgtacgcaaggactcgtcaatccagcagttggcggacctcaaaggcaagaaaatcgccgtgaccaaagccgccggcactcactatttattgatcgccgcgttgaacaaagccggcctggcgtttgccgatatccagccagcctatctgtcccccgctgacggccgcgccgcatttgaaaacaacaaggtggatgcatgggtcacctgggagcctttcctcaccagtgtgcagcggcaactgcccacacgcaccctggcggacggcgccgggttggcgagctacaagcgttattacctgacaggcacgccttacgcccaggctcatcccgaggtgttgaaggtggtatatgcgcagttggaacaagccggtcaatgggtcaaggcccatccgcaggacgcggcaaaagtgctcgggccgttatggggcaacttggatgcagcgacggtggaagctgccaatgcgcaccgcagctaccaggtgcagccggtgacactcgagcaactgggggagcagcagaagattgccgatgcgttcttcaaggcggggctgttgcccaaagcggtggatgccaaggcagtacagacctggcagccctaaggtaaacaaggccgacgggaagtggtacaaaaggagccctgccccttttcctggagagcaccgccataatctccatcacatccctgcgttgttgttcacgggtcaggtccgacaggctgctggacaaacatgaccgcaacgatgtgcacatcagcctgctcgccccgcaagcggaactgcgggtccgcccacggttctacgagcccgaggtgcacagcatgctggcgcccttgggcccgctgttcgatgccgtaggcgtggcctttgtgcaaggggccgccggtgacgtggcctataccgctaccgatgagcggggtcacttcgccgccatgtcctgccaacacgccatcgccctgggccgctacgccggcaacaacgtcgccgccgacctgatcggcgtggcgccgatggcctacagccaacccaaatacgtgacctgcctcgacctcggtgcctggggcgcggtgtacaccgaaggctgggaccgccagctgaaactggtgggccaggaggccaaggcactcaagcagcagatcaacagtgtgtggatctacccaccggcggcagatcgggcagtggcgctggcggcggcggatccgttgattgcggtggcatgaggcaatttgtccgctaagagatggctccagatcgtcaaccttgcttgatcactcacccctgcataacgctaaatcaatatgcctatataattaaaagatctaaataactgtcaattttgacagtgcaaacccacgctgcccttatctatctttaagttgcctcaatacttaaacacgtgttgatgactcagattgaatgcgcttttcttcaaccaagttttatataaggaagactgatatggcactggtagaaaattacaacggctatgagatacatgaaggcctgacaggagggcattgggaaggtgataacctggttggtcaagtcaaggcttacacttaccaaaaaaatggcgaaaccagtacactgacttactatagtgtagatagagtcaaggagataattaagagcggccaagctcaattttgatgcaccgagcgaaatgggttgatattccaaatccgtcgcaggggatttgatctattgatgaatctcctgcgactattagataggcaccgtccttacttctctacaccctgaccaaaccgccgaatcgccaggcaataccccaccagcgccagcgccgccagcaacccgcccgccgcgccgatccaggcgaagccgaagtggctgccgacccaactgcccatcaacgcgccaccgccgatgccgatgttgtagataccggagaacatcgccatggccacgtcggtggcgtccggtgccagtaccagcaccttggattgcatggccaggccaaagcccatgatcgccatgccccagaaaatgctcaataccaccaggtaagactcggcgccgctcaacggcagcatcaaggccaggcacgcggcgaggatgaacactgcgccgaccacgaacaggtgggggttgaagcgatgcaccaggctgaacaacaacgaaccaataatgccagcaccaccgaacaccaagaggatcaacgtcaccgcactgccgcccagcccggcgacgccttcgacgaaaggttcgatatagctgtaggcggtaaattgcgcggtgactgtcatcgcggtcagcacgtagagcgccaccagtgccgggcgcttgaacaacagcggcaggctacgcagcgagccggagttttggctgggcagcggcggcaaggtgcgtgccagccagaacaccagggccgcggcgaacgcggcgatcaccaggaaggtagtgcgccagcccatggcctcgccgagcaggcggcccaagggaatgccgagcaccatcgccagggacgtacccgtggccaacaagccaagggcctgcacctgcttgccttgcggcgccaggcgtaccgccagcgaagcggtgatcgaccagaacagcgcgtgggccaaggcaatgccgatgcgactgaccatcagcaggccaaaactggtagccacgctggaaaggatatggctggcgataaacaggccgaacagtacgatgagtagtttgcgccgttctacgttgcgcgtcagcagcatcaccggcagcgaggtcagggacacgatccaggcatagatggtgagcatcaggccgacgctggccacgggcatgtcgaagctggcaccgatggcgctgagcaacccgacaggtacgaattcggtggtattgaacacaaacgcggccagcgccagggcgatgaccggttgccaattggcttggggggttgcggctgaaaggctcattgacgggcgcggtactctggcgatggtcaggcgccgcccaggacaagcgccgccgccgagcattctataggtttctcgggcggctgttgaggcggatcgtcgccccgggagctatggcgaagtcatggtaatcacgtagttgcccgactcgatgggcttaccggcattgtccaccagcagatagcgctggtcgtaatagcgcccctcgccactgtccgccaccagccgtacatgggcggcattgacgctggccactggctcaacactacgcacatctaagcggctgccgcgactgacactggcgcaaccggtcagctccatcaccgaaccgctgcgcgcatttgtcgcacagcccgactcgacgatggcgccagtgaacctgagggtgccctgcccaaccgtctgcgcagcgccgcaggtgcttgcccataggcaaaggaggctcgtcattaccgaaaaacgaccaacgttcatgccgacactccttcttgggttagtaagaagttagtcgtcggcgcggcggttaacttgagtttatttgcctgagaatgagcggtggatcacggatccacctgccccatcaactcaggaatactctccgggcgctgggcataacgctgggccagcgccgcgcacaccatcaactggatctggtggaacagcatcaacggcaagatcaacacgcccatgctcgccccggcgaacagcacctgagccatgggcacaccggtggccaggcttttcttcgagccgcagaacaggatggtgatgcggtcttcctggttaaagccaaatgccttgctcagcaacgtggacgccaccagcaccagcgcgagcaatacgcagcaggccaccaccagaccgcccagttgccacaacgggatctggtgccagatgccttcggtgaccgcttcgctgaacgcgccgtagaccaccagcaggatcgagccctggtcgacgaatttcagccaggctttattgcgaccgacccagtcaccgatccagcggcgggcgatttgcccggctatgaatggcagcagcaactgcacgctgatcttcaagatcgcgtcgaccgtggagccgccgtccccctgcacattgagcagcagcgccaccaacaacggcgtcaggaaaattccgaacaggctcgaagccgccgcgctgcaaatcgccgccgggatattgccgcgagccagtgacgtaaaggcaatcgccgactgcacagtagccggcaacgcgcagaggtagagcatgcccatgtacaaatctttgccaaccagcggcgacagcaccggcttgagcgccaggcccagcaacgggaacagcacgaaggtcaggctgaacaccagcaggtgcaagcgccagtgaccggcaccggcaacgatggcctggcgtgacagcttggcgccgtgcaggaaaaacagcagcgcgatggccaggttggtgacccagccgaaggccacggcggtctggccgctggccggtagcagggaggcaaggatcactgtggcgatcagggtcagggtgaagttatcgggtagaaagcgcgggcgggtcataagcaagtcttccaggggttgccaagagcgtcgtggcgactctaacgtaaccacctgttaccgactaacgccaatgagccagtaaatgccgcctaaaggacatgaaaaagccgtgcgacgcagtgttcccgggctttccagcctgccacggccggtgtatgggcgtactgaatccttgcccaatcgggcgctgacacgacggcacagtcacccgtgggtgcagttgtcctatgcgatttccggggtgctggagatccagaccagcgtcggccgcttcgtcgcgccgccgcaacgtgcagtgtggatcccggcgggcatgccccatcgggtgttcagttcgccccatacggaaatgcgcagtttgtacctcgattgcagcgtcactgcctgggcggccgagcgttgccaggtgctggaagtgagcagcctgctacgcgagttgatccgcagtttcagcgaagtgccggtggaatatgccaaggacgggcccgatggacgcctggcccaggtgctgctcgaccaactcgccgccgcgccccaggttgacctgatgttgccgttgccccatgacccacggctgcggcagatctatcgcagcctgagccagcgcccggagcagcagaccacactgggggattggagcgccaggctgggggtcagcgaaaagaccctaagccgcgtgtttctgagtgacaccgggctgacgttccgcgcatggcgccagcgcctgcgactgctgagcgccctgcccgccctggaacggggtgagcgggtgacggatgtggcgttgggatgtgggtatgaatcgacgtcggcatttatcaatgcatttcgccagcagtttgagacgacacctggtgagtttttccgctgatcctttggggctgtgaggatcaaaatgtgggagggcatttcatgtctagaatggggttggccgcctgcgctccatggggcccggacagaatatcgggatctattgtcatgcaaataacccacaaacccgcgctcggctggtattgtgccgcgctttgaaataccgctactgacctgcgaggaaatggacgttgaacactgacgaaaaaatgaccggggacctgtttgaggtcgataagcgcctgtcactcaagcccgtggtggacttcaacgcttacctgcgcagcgccttcggtgatggcccgtgcacctgcgtgcgttgcgctgccagcggtggtgatgaaagcggctatgaattccagcacacgttcaccttcgacggtaagccgatgcaccgtcgctttgcttcgacagcgggcagtgatgtgttgatggcattgaaaaaggcgtggttgtcgtacaccaaggtcgaactgccgctcagcggcgtgctggcgctggagatggtgaaggagtttgtcgagccgcagttgcacaagcgcctggcgccgttgttcgtggccagcgggctggtcaaggatgtggacggcgagttgcgcattcagccccaagccatggcctgacactgtaaatgtgggagggggcttgctcccgatggcggcgtgtcagtcaaccaatgtattggctgacacactgctatcgggagcaagccccctcccacatttgtaccgggtactttctagaaaccgggcacgccctgcacgcgcaactcaggggtcagttcctcttccagcggctcggtcagcggccgatcactgatccccggcagcaggatcaccttgcggcactcttcctcggctttatcaaacagttcatagccccgcgacgcctgttccaggggcagccgatgggtaacgattgcctcggggttcaggtgccccagttcgatatgctccaacagttcgggtaaaaagcgctgcacatgggtctggcccatcttgaaggtcaggcccttgtcgaaggcatcgccgaacatgaagccatggataaacccggcatacaccccggctacgctgaccacgccaccgcggcgcacggcagcgatgcactggcgcagggccttgccgctgctgccttcgatcttgagggtggtgaggatggtttccgtggtgctgcccttggcttcgaaacctaccgcatccaccacgccatcgacgccacgcatgccggcggtctggcggatgatggtatcggccgggtcatcgtcttcttcgaagttgatcgggatcacaccgtacatcttctgcgcataggccagccggtacggatggtcgtcgaccatgaagatttgcccggcccccagcatctgcgcacacgccgcactgagcaggcccacggggccggcgccatagatcgccacgctggagcccttgccgataccggcattggtcaccgcctgccaggcggtgggcaggatatcggagaggaacagtaccttttcatcggccagggtgcccggcaccttgaacggcccggtgttggctttgggcacccgaaccaactctgcctggccgccgggaatgccgccatacagacggctatagccgaacagcgccgcgcccggtggaatggcttttttattcaggatcgccccgcgcccgtcgttggtggtttcgcaggcggcgtattgctggagctggcagaaaaagcaatcgccacaggcaatcacgaacggaatcaccacgcggtcgccacgctgcaccgcggtgaccgccgggccggtttcttcgacaatgcccatgaattcatggccgaagatgtcgccgtgttccacggtggggatcttgccgcggtacaggtgcaggtccgagccgcagatggccgtggcggttacacgcagaatgatatcgtcgggttgttcaatggtcggatcgggcaccgtgtcgacctgcaccttgtgtgcgccctggtaagtcatcgctcgcatgctctgcgctcctgccgttgaggggttactaattaagggcggcgcaagtgcgtcagtgttccttccacctggtgcagcacccgatcagtggtcgcccctgccctgggccagcaactggtcgaccacatagcgcaggcactcgaggtcatcggcaccctcggcccgtgcctgggtgtaccagtgcaattgttcggtcgcgctattgccgcgccgcagcagtgcttgcagggaatcgaacagctgcgcctcgcccatggcttcggcggtggcggcaaaggtctgtcgggcgtattgcagccattgctcagcgctgcccatggcacccgtgtcgtccaacgcaaaccggcccgctgcgccgtagcgtttcgcctgccagcggttttccttgagcagccaacgcgcttgggcgctgaattcggcgccggggcgctccagggtgcaggcgtgggtgaccatcacccgaaacagcgtggcaagggccagggcatccgccagccgtgggcaggcgtcagtcatgcgcagctcaagggtcgggtaacgcgctgccgggcgaatgccccaccagccgttgccgtcggccttgattgcgcccatacgctgcagcaaagcaaggtagcgcaggtactcgttccaatcggcaaaatgttcgggcacgcccatgcgcggccactcatcacaagccgcctggcggtaactcatgaagccgctgggcgcgccgtcccaaaacggcgacgagcaactgagcagcaacaacaatggcagccatggcgacacctggttcatcacggcgatgcggtccaggctttgcgggacctgcacatgcacgtgcagcccacacaacacactgcgccgcgccacatactggatatcgtcgaacagttgctggaaatgcacctgtggggttggccgctgcatgcgccaatcggccaggggatggctgccggcacacacgacaccgaggccgaattcgctcagggcatcggccaggctgccgcgcactgtcgccaggtaatccaccgcttcgccgctggtggtgaagactggtgaggcggcctcgatctgcccctggaacatctcataggcgaagcccccgccaatcgcctcacggcaggccgccagcaccgccgccgagggttcggcaagcatgcagcgggtgtgcagatcggtgagcagatattcctcttcgataccaaaggtgagcatggacgtcagcgcagccgagtgacagtaagcgcgaccacggcgatgcgctccacaccttcgtaccccggtttgtcgagttcttcgccaaaaacgtcggggtccaattcacggtaggtccagccataggcatcgttggccaacagcggcttgaccgcttccaggaacggatcgccacccgccaccatcgccacgccggtgtagagcaccaggctgccgccaagggccaggcgcccgacggactcgctgacgatgcgcaccgacaactgctcgcccaacgcgccgccgccatggcgataggcgcgctggcaatcgtcattcatgtacggagggttggcgacgatcaggtcgaattcaccctcgacgctggccagcacatcgctgtgatagacgctgacgttattcagcccggccagctcggcattcaccgcagtcattcgcagggcgcgggggttgatatccaccgccagcacctcggcgtcatgccgcgcgcgggcaactaccagggcgccgacgccggctccacagccgatatccacggcgcgcttgagcggctcgaatcgctgttgcaaatgggcttcgatcacttgggcaaaacggtagctgtcggggccgaaaaataccgcatccgcttgcacggtggggtatggcgaatgggcaaacagcagcccatcgaggctcgaccaacgcaccgtgctgcgccataaagaatcgtgtttttcgatcgccccggcttgcagcaactcttcgcgaaacgcctccggcaacaactcattgtcaaacggcatcgaccagccgaacacgtcacgcatattcatcgccagcggcgtcgccaatcgccgatagacacgctcgtgggtcaggggcgtcggcgtgataaagcgataaccgctttccttcaaccctcggcccaggttcagcaaggcgcgatcagccaattgttgtgcagacatgagcaggttccttagcgcaaacgcgcgcgcaattggataaagcggcgggtcgcatacagccccgcgggcgtacagtgacggcgcgccgacatccaggggatcagcgcggtgagctgctggtcatcgggcagtttccacaatgaatccaccagggcctgagtgtccggatccgccgggcgatgctgctcgcgggagaaacggctgccacgacccggacgaaccggcggcacgcgctggctgctgatccagtccccggcgatccagtcatgcatcagttgtttttcatagccgctgaacacaccaaacatcgccgcgccggcgccctcgatcagttgccaaaagcggctctcggcgggatcctggttgcgtttgatccagcccttgtcttccagggccttgaggaaatcgccgatctgccccggcttggccagccactggttgacggtcttgccttcgaagcggcagtagtccgaatgcatgtgctggccaaaggtgcgcttgcgctcaagcatggcgaccacctcgtcctgcaggttgaactgcttgatcaccgccgtggtgcccgggccaagatcattgaggcgatacccttgcgccacgcgacggtagaaatccgccctgccctcgcccagcggcaacaagctcagcaccgattgcgcagccttgcaggcatggccgctgctggcgttgtcgatggtgacgtggagggtgaagtaataggggtcgatgcccagttcgctcagctcgtaggcggtgatcaataggtgcaggggcaactgttcgtagcccaggttgaagccgatgatctccggcaggaactcttcagcgcacaggcccagggccagttgcagcgcaccttgcaggtagtggtcatcgtccagtccggcttcgctgtcggcatcgtgttcactgagtaatttgcgatagatcaccacatggttctgcgcggcctcgccatcgcccaattcttccaggtaggtggtgagcaggccatcaaaacgcgggtcctgccaatagcgcagcaagccgttgagccaggcgccatccacctgtttagtcggccccacgcgctgcaggaaatacaacgcatgggctttgttctggaaatagcgacggggccggccttgctggcgttgctcaaggtaatcggcgtaagcctgggccacgtcggcgcaacgctgttcgacccaggccggcaactgctccggcatctggggcaattcactgggtgcctcgcgtacctgagccaattgcgcttgcaggaagtggcgcgcggcttcttcacagccatgggtttccccataaagctgctggtaaagctcctggtaggggccgtgagccgatggggtcatggaggccggctggcctgacagcgctgtaaggagtgtcatgatggcagtttccgcaaagtccgttacaacgggcctcccacaaggcggccccgcaagagcgctcaaaaatgtgcgcttctaaaaagcagagcattgggatgtgcgaaaaattcaaatgaggttgggttggggtagataagcggtcattgacggcacaacgcaggtccaaatgtgggagggggcttgctccctcccacattctgcacactctgatgaactatttacgcgccgcttcccactgcttgagcaagtcgttgtagttcacggtttcgcctttgggcttctcgttcgccagtttcggcttcggcgcacctggctggtcgaaccagtattgcgcgtcacgctcggggttcattttcgggccgcacaccggttgcaccttggagcgttccaggcgcgtcatgatcgcatcctgctccttggccaggttgtccaacgcctgttgcggggttttctcgccgctggcggcggcggcgatgttgctccaccacagttgcgccagacgcgggtagtccggcacgttggtgccggtcggcgaccattcggtgcgggcagggctgcggtagaactccaccaggccgccgagtttgggggccatgtcggtcatggcctgggagttgatatccgactcacgaatcggcgtcagaccgacgatggttttcttcagcgacacggttttcgaggtgacgaactgcgcgtagagccaggccgcgagtttctgcttctcgggggtggacttgaggaaggtccaggagcctacgtcctgatagccctttttcatgcccttttcccagtaaggcccgaccggtgacggcgccatgcgccatttcggcgtgccgtcggcgttcaccaccggcaagcccggcttgaccatgtcggcggtaaacgcggtgtaccagaagatctgctgggcgatgttgccctgggacggcaccgggccggattcggagaaggtcatgccggctgcttccggtggcgcgtaggccttcatccagtccacgtatttctgcgtggcgaacactgccgccgggccgttggtatcgccgccgcgggtcacgctggagcccaccgggtggcagtcctccacacgaatgccccactcgtccaccggcaggccgttgggcaagcccttatcgccgccgccggccatggagaaccaagcgtcggtgaagcgccagcccagggacgggtctttcttgccgtagtccatgtgcccatagatgcgcttgccgtcaatttccttgacgtcttcgctgaagaacttggcgatgtcttcataggccgaccagttcactggtacgcccaggtcgtagccgtatttttccttgaacttggctttcagctccgggcgttcgaaccagtcggcgcgaaaccagtagaggttggcgaactgctggtcgggcagctggtagatcttgccgtccggcgcggtggtgaaggacaggccgataaagtccttgaggtccagggtcggcgaggtgaaatccttgccttcattggccatcaggtcggtgatggattcggtcttgccgtagcgaaagtgcgtaccgatcaagtcggaatcgttgacccagccgtcatagatattcttgtcggactgcatctgggtctgcagcttctccaccacgtcgccttcctgcagcaggtcgtgggtcagcttgataccggtgatttcactgaaagccttggccagtaccttggactcgtactcgtgggtggtaagggtttccgacaccacgttgatcttcatcccacggaagggctccgacgccttgataaaccacttcaactcctcgagctgctgggcttcggtgagggtggagggcttgaactcgctgccgatccatttttttgcggcatcttcataagcatcggcccaggccgaggcgctcaaaccgctgagggccagtacggcggccaatgaaatgctatgtcgcagcttattgtttttattcaacatagagacctcctggttgtttattcataagggcactagccccaacgcatcacactcaacagccataccagggagagcgcggacgccacccagatgctccagtcggtaacgccgatcaccagcaaatgcaggtaggcgctgccgagaagtccgataaacaagcgatcaccacgagtggtactgatcggcagaaaaccgcgccgggcgatgctcggcgagcgcagttcccaggtggtcatgcccgccaggatcagcgcgatgccgccaaagaacagcgcagtgggggtggtccaggccatccattccatcatcgattcctctagacccggcccagggcgaagcccttggccacgtggttgcgaacaaaccagatcaccagcatgcccggcaggatcgtcaacacgcccgccgctgccagcacgccccagtcaatgcccgaggccgagaccgtacgggtcatcaccgccgcgatgggcttggcgttgactgaggtcaaggtgcgcgccagcagcagctcgacccaggaaaacataaagcagaaaaacgccgtgacgccgatgccggagccaatcagcgggataaaaatcttcacaaagaacttgggaaaactatagccatcgatgtaggcggtttcgtcgatttccttgggtacaccggacatgaagccttcaaggatccacaccgccaacggcacgttgaacaggcaatgggccagagccacggcgatatgggtatcgaacaggccgatggaggaatacagctggaaaaacggcagcagaaacactgccggcggcgccatgcgattggtcagcagccagaagaacaggtgcttgtcacccaggaagcggtagcgcgagaacgcataggctgccggcagcgccacgctcagagagatcaccgtgttcaggcttacgtagtacagcgagttgaggtagccggtgtaccagcttgggtcggtgaagatcaccttgtagttggccagggtgaactcctggggaaacagggtcaggccgccgaggatttcggtgttgctcttgaacgacatgttcaacagccagtagatcggcaccagcaggaacaggatgtagatcagtaacggaataagcttgcgcttgctcatgtcggtggcctcagcggttggcgtcggaatgggtcatggcggtgtagaacagccaggacaccaacaggatgatcaggaagtacaccagggaaaacgccgccgccgggcccaggtcgaattggcctacggccatctgggtgagcgtctggctcaagaaggtggtggcgttccccggcccgccccccgtgagtacgaaaggctcggtgtagatcatgaaactgtccatgaagcgcagcatcaccgcgatcaacagcacgcttttcatcttcggcaactggatatgtcggaacactgcccaggccgatgcacgatcaatccgcgcggcctggtagtagacgtccggaatggcccttaaacctgagtagcacaacagcgccaccaacgaggtccagtgccacacatccatcaccagcacggtgacccaggcgtccatggtgttagccgcatagttgtagctgatgcccatggcgttgagggtcgaacccagcaggccgatgtcggcacggccaaagatctgccagatggtgccgaccacgttccatggaatcagcagcggaatggcgaggataatcagcaccagtgatgaccagcgtcctttggtcggcatggtcaaggcgatggcgatgcccagcgggatttcaatcagcagcacacaggccgagtagatgaactggcgcagcaacgagtcgtgcaggcgcgggtcgagcagcacctgcttgtaccagtcggcgccgacgaaatagcggctggactggtcgaaaatgtcctgcaccgagtaattgaccacggtcatcatcgggatcaccgcactgaacgccaccagcaggaacaccggcaacaccagccaccaggccttgttgttctgcaccttgttcatggcgccacctccagcaggtaatcgtcggcgtagagcatcagccattgcgcggggaagctgatcgacgccctgccctccggcactggcttgtcttcagccaggcgcactttcagcggcgcgccgtcgaggttgagggtcatgatcttgtaggtgccgaggtcttccacatgcacgatttcggcttgcagggcgtcagggttgtactcgtcccatacgtggataaattccgggcggatgcccacttggagcttttggtagtcggtggcgctgatactttgctgcaaggcctcggataacggcagcagcgtgtcggcaaagccgacgccgccgggcttggcctgcacctcaatcagattcatcccgggactgccgatgaaataaccgacaaaggtatggctcggccgctcgaacaattcacgcggagtgccgaactgcacgatctgcccgccgtacatcaccgcgatcttgtcggcgaaggtggaagcttccagttgatcatgggtgacgtagaccatggtgatattgaactgctcgtggatctgcttgagcttgcgccgcagtttccatttcaggtgcgggtcgatcacggtcaacggctcgtcgaacaggatcgccgagacgtcatcgcgcaccaggccacggcccatggagactttctgtttttcgtcggcggtgaggttgcgggcttttttgctcagcaggttttgcaggtcgaggacttcggcaatttcctgcaccttgctgtggattttcgcctcggccatgccctggtttcgcagcgggaaggccaggttgtcgaacaccgtcatggtgtcgtacaccaccgggaactggaacacctgggcgatgttgcgtttctccggggtcaggtcgttgaccacctgggtgtcgaacagcacctggccttcagaggggctgagcaggccggagatgatattgagcaacgtggacttgccgcagcccgatggcccgagcaaggcgtaggcgccgccctgctcccatacgtggttcatttcccgaatggcatagtcctcaggccccgctggcgtaggactatagctatgggcaaggttacgcaaatggatctcggccatcaggcaaccctcgcgatacggcgcccgggggcctggaccaaatggccctggccatcgaacacaaacagtttatgggtggggatatacacgcggatcggcgcgtcgacgtcgtactcgtgcacccccggcaggtgcagcaccagcaggaaatgttcgctgcgtacatgcaggaaggtttccgagccgctgatctcggcgacttccacggtcacggccaactccaggtcatcgtcgttgctcggcaccaggctgatatggctggggcgcacaccaaagcgaaattcgccttcgccgatgggacgcaggtcgacgttgagcgggaaatgcacgaagttggcaaagctgacctcattgccactgatgcgcccgggcatcaggttgatcggcggctcggagaacagctcggcggcgagcacggtctgcggttggtgatagacctcggcggccttgccgctctggatcacgcggccctcgtgaagaatggtagtggtgccccccagggccagggcttcgttgggctcggtggtggcatagatggcaatggtatggcgcgccttgaacagctcgcgcatttcctgacgcagctcttcgcgcagtttgtagtccaggttgaccagcggctcatcgaacagaatcagttcagcatctttgaccaaggcacgggccatggcggtgcgttgctgctggccgccggacagttccaacgggtggcgctgcagaaacttctcgatgcgcagcattttggcggtttccagcaccttgctctggatcagctcattggacacaccggcctggcgcaacggcgaggcgatgttttcgaacacggtcatggtcgggtaattaatgaactgctggtagaccatcgacacattgcgcaggcgcaccggtttttgcgtgacgtccacgccgttcatcaggatgcgcccgctgtcgggcttgtccaggccggccatcaggcgcatcaggctggtcttgccggacagcgtgcgaccgagcaagacgttgaacgaaccggcttcgaaacgcaggttggcgtcgtcgatccaggtttggccgtcgacaacgcgggagacatgttccagggtcaatgacatgacacgacctttttattattggaatgaatctggcgagtcgtcagagcgagtttcgtgccaaaactgcaagcgcttgatacgtaagggaatgggttaatggtgatgttcaggagtgaacaaagtggctgaacaactgaacactttcggggttgacaatgaacagttctgaacaacactctcatgaccaacagaggataaaaatgtgggagggggcttgctcccgatagcggtgtatcagtcagcatttttttcactgatataccgctatcgggagcaagccccctcccacattgatctggttagatccgttagattgtgcacatccaataacaataaaaatgaaggtcgcaccatggccgaacccctggctcacgacaccctaatccaggattcctggcgccgttgccgcgcctttggcctggatcaccagagcgctcccagctttgaccaactccccgccgaaggcattcgccaactgttggagagccagcattcactggtgcagaccacccaccaggaagtgctgccctactacgagaacatcctcagcaattccaactgcctgatcatgctggccgacaaccagggccaggtgctgacctcgtggggcacccagcgctttatcgagcccaagctggcccgtggtttcagccctggcgccagctggaaggagcgttccagcggcaccaatgccattggcaccgcgctggcctgcgcccaggcggtgcatatcgaacacgacgaacactttctcaaggccaaccgcttcatgaccggctcggcagcccccattttcgatgcacagcgcgaaatcatcgcggtgctggatgtgtccagcgacagctacctgccgccctcccacaccctgggcatggtcaagatgatgagtcaaaccgtggaaaaccgactgatcctcaacctgttccgcggcgaacatttccaactgacgttcaataccggcctgagcaatctcgacagccagtgggccggcctgttgatcttcgatgaaagcggccaggtgctgtcggccaaccggcgtgcggacaatctgctgggtatcagcctgtcgcgggtgatgatcgaccgtttgttcaaggtctcgctgctggagctgctcaaccagccggagggcctgccgttctcgttgcaggcggcgggacgcaatcggttccagtgcctgttgaagcggcccaagcagctgccggtgcaagcccgggtgttcaatgaaccgacgccgccgccaaccccgaccccgatcaacctcaaaaccctgcattttggcgatgcacgggtggagaaagcactgcgccaggccgagcgcctgctggaaaaggacattccgttgctgatccacggcgagaccggggtgggcaaagaggtgttcgtcaaggccctgcatcacgctagttcccgcagccgccaggcgtttatcgcggtgaactgtgcggcgattcccgctgagttggtggaatcggaactgttcggctatgaaaaaggcgccttcaccggcgccaatcaaaaaggcagcatcggcctgatccgcaaagcggacaagggcacgctgttcctcgatgagattggcgatatgcccttgccgacccaggcccgcctgttgcgggtgttgcaagagcgctgcgtgcaaccggtgggcagcagcgaggtgttcccggtggatttgcgcatcatctcggcgaccaaccgggccctgcgtgagctggtgcaggccggacgctttcgtgaggacttgtactaccgcatcggcggcctgaccctggagttgccgccgttgcgtgagcgtaccgacaagcgggcgttgttccagcaactgtggcagcaacaccgcgagccgacccagtgggccgggctgagtgccgaggtattggggctgttcgagcagcatccatggccggggaatttgcgccaggtgagcagcgtgttacaggtggcgctggcaatggccgaagagcagccgatccgtgcggagcatctgcccgatgatttttttgtcgatctaaaagaggcggcaccgctgtctacacgcgagcgcctggatgacaacctggatctgaaccaacgccttgaggccgtgggcggaaatatttcccacctggcgcgggaactgggggtgagccgcaataccctgtacaaacgcctgcgccagcacgaaggttgatttaacgccaacgccaagacacaccggtgtaaacaccacgtccatcggcaggggtagagcgtgctgcgtccatgcccttgtcgtcgtaacccggcgtaacggtattggcataacgacggttggtcaggttgcgcaggtcgacccaggcttgccagtcctgttggggcgcgtcgtagccgaaggtggcgccgaaggtagtgtaggccgcggcatagtaggaattggcgtagtccaccgcgacccgtgaggcatgctcggtgttgaggctggtgtagaaacccgtcgggtggctgtagcgcacctgcgcctggtagtagtgcttggggatgccaggcagggtgttgtcaccgaaacgctcatcgtcgcggtattggaaatcgctgaaggtgtaggcctggcgcaggtcgagcttgccgctgcggccgccgtcccatagcgggctgagcaggcccagttccacaccctggtgcacagtggggctggcgttggattcggcgataacggcattgctggtggaggtctgcgcctgggtttccacggagagcagttcgtggcgtacttcggagcggtagagggccaggtcccactggccgagccatgcctcaccgcgcccgccgatttccagggtggtggcggtctggttcttcaggctgatgccttcgcgtgccaacccattcgcgggtccggtgctgaagtacttgttggaaccccagatcatcgaccaggcatggggcggctctaccgagcgactcaggttggcgtatacctgcaattgcggggtgaagtcgtagcgcaggccgatgcgcggggcgtagtcccagtcatgttggctgagcggcgcctggccgtcggggtaagtcacctgggtttcgcggcgggtgtagatcgcagcgaggccggtggtgagccataggtcggggaccagctccaggtcgttgccgatgtgcagcacggtgtcggaacccaggtagctgtagtcgcgggtcttggtgccaggggcgtagccggcggttttgccagtgggggtgcgcacgtactcggtggcgccattgttgggcatcgcctgggtggtacgcaggccgacggtggttttgctgacatggccgaacaggctgtcctggcggatgtagttgagggtgccgctgatatcggtgtaggcgactttcaggcggttgctgccttcgcgcaggtccatggggtagtcgtgataggccagcccgacctcgacccttgatgcgtcatccagttgcaaggtggtcttgttggcgatccaggtggagcccggttgcaggcgtttggaatcgcgagcggcattcacgctgttggcggcacgtggatcatggctgacctggtagcgcgtgagcttgccgggggaatcgttggtggtttcgcggtagcgcaggtagaaacgcgtttccaggtccgggttgaagcggtagccaaagttggcggcaatgcccttgccggtgccggcgctgtggtgctggtagccgtcggactctgaatcggtaaggctgatgtagtagtcggcatcccccagcacctggccggaactgacctcgcgctgggcgtagccgcgactgccgacctcgtagcgcatttgcagcttgggcgcgtcgtagccggtgtgggtcacgtaattgaccgaaccgcccaaggccaatgcgccctgatcgaacccattggcgccccgcagcacttccacccggctttgccacagcgggtccttgagttcataaggggtgccgcccgggccggtaagcggcaggccgtcgaacatctcataaaggccggagccatgggcacccgggctgcggttcaagcccgagccgcgaatggataacttcaccccttcgttattcgccgccttggcgtacaccccggcctggtacttgaacacatcttcgttagtgctgacacgcccctgttgcacgctgctcatatcgatgtagttggtgccgccgggcacgctgttgagctgcgcctgggcgatttcggcagcgctggcctcagtggtggtgacttcgaccggcgccaattgcaagccttcggcctgtaccagcgagctgagggtcagggcggcaaaaaggaacgggggttgacgcagcagcattggggcgggtccttggaattcaggagcgtggcaggccgagcccaccacgcgaacagtgatgggaaggcaggcacgcccgtcaggtcacgccttattgacggaccaggcggcgtccaagacagtatcgaacctgttttagccgtccggcgccttcaacgcgcgcatcagatcgtcggcctccgatcctgccgggaagcggaacccgcacatttgctccgtggccagaatctcacccagcgcatcgcgcaactgggtttccgtgggcgagtcacgcagcagcttgtgggccggcaacagcaactcggcagagacgccctggacagtcgcggcatcaatcacggcgaagaggataaaccgcaaacgtatttcgcgatccgtgggccaaaccgtttttcgtttacccaaggtagggcctcgtgtttaagaaaaatccgaggctattgcccgcagggacgcgtttcaagcagcaggaggcaagataggccgcttcctacagtggaaagggaaacaccgcaccgtttgagctatttatgcgcgctgccgcgtctcactgcaccggcagaaaattcatcagcaacaggctttgtgcgtaattgaggccgatgcggcggtaacgctcatcgaggatttcggtgagcaagtcgaggcgcgcgacgatcttgccgaactcgacagcgaaactgaggttgctgccctcttccgatatctcattggaaaacagcagcaatacaccgttggcatcctggcgttgactgagcagccaggtggccttctcgatattgcgtgcggcattgctgacgaactgcgggttgattgagtcagtcacataaaactgcgtgcgccctccgtgggcggtcacgagcatgctgccgatcgcgtagataaacgcaccgacccggtcgccacgaaagtcgggactcaaggaataactcagggcagccagatcacgccggtctcccagtgcgggcaagggttgacgattctcgatggcctgacggattacccgcgccgcgctcaccgcatccgggtaacccgactggcgccactggctggggttacgcaggtagagcttgctcatcagcaggtagaggctttgcaggttgtcgcgcatgcccagggtcgccatgcggtcgacgctggtctggaagaactcatcgggcttgccgctgctgaactgcctggcgatatcgcggccttgttgctggctgcaacccactacgcagagcgcgaacaccaaggccagcaacagcggccatagcgaggtaaaaacaattgacgttcgatccatcggcaccgggtctgattctgtgggctacccgcgggagtcgggtagccgggacagggatagatcagcagaatggaaaaaagtgcagccgcacgggtcagataagcataggactacaggcgctgatctgacccggcactggatgaacgggtgcgttaaagcagtatcgtggcaagcatgcccaaggcgcccaggcaaaacccgaccagcgcaccgcgccctggcgcttcatgaaacagcgaccacaccaccactggctcaagtagcaacaaggacgtgaccgagaccacggtgacaatccagatgtcacccaccgccctgtaccccagccaataggcgcccagcaggcaaaacccggcaaaacacatcaccacgacgggcagcacaaatgctccccaggagccgccgccggtgtgggccagcctggcggttaccacctcgctgtagattgcacaaaactccccgatcaccatcaaccctagagcaaaaactccgagtagttctttggacatatcaaaaattccttcgtattcagcgcgatatttttcagctcccagccagtgatgctggcgtccagggaggcattgccttcatacgaagtgcgtttgaaaaggcctgaattatcgaagtacttgtccatgctcgtatccttcacagggggttgaggctcagcggcccactagcgggcgtgtcgatcatagaggcaacgtgaagcaattcacaattatggaatgccgatattgaaggctaaaaaccgagcaaatagtatctcgcttcactcgagcgccaactttatagggatattgctctgcgccagctcgagttcccacgtgtgcgcaggcaatcaaacattgaggtttgccatgcgcctttccacactcgcacccgccgccgccttgctcagcctgttcacgctgaccgcccatgctgcggacctgtctgccctgacaggcgccctgtcatcggccctcggcggcgccaatcagaacactaccgctaacgccaacaacgcgtcctgccagcagcagatccgcgacctgcaagccaacatcaatgcggccaatgccaagggcgacaccctacgcgccacggccttccaggcagcgctgacacagaccaataaaagctgcgccaacggtagctacaatgcccaggcgcaggtggataccagcagtcaacgccagcaaaacgtgaacaaggctgcggatgcgattaatgcgattggtggactgtttaagtaagccgcacagtgatgtaagaagagcccgcggttgcgggctttttttcatctgcccgttagttatctgccgtgcacggcccaacgcgatataaatgctttaatgcacgcgatacccagatagcaaaggacaatgcgcgatgaacaaatacctcctgtgttcgctaatggcactgctcgcggggtgcagtacggggccttatctgcacccggaatcgtcggtgggccagaacgccctgctttcacgaacctgcccgggtgcacacgccgcaatcagttttacgccattgtccgaagaactcaactgggttcgcgtgctggtgtatgtggccccaccggggacactcagttggccgggtaaggtgagggctaccgacacagaacttcgcctattcggtcgcctgtataaaccgcatctgggcaaccccgtcacatcactttgggtaagtgcggcctcgcctgacgtaaccgtgaaactggcttcggggcagagctatcaggtcagtatcgagcagttgaaaactgggttcgaccccaagcaaatatccacgtcctcgattaaaggcacacctttgggtaaaggcgatatggacgacttcacgctgacctttccggatatcttcgtcaacggtgaaaaagtccccatggcgccgattcacttcaaaaagcgcgaagagcgttatgcgccggtgttcaactgctgaaccgaatcagtcggtgttcatgaaaccaaattaccttgcacagaagccagcttgatcccgagcgctacaaaagcggcggcgctggtatattgaatggtgcgctcttcatcgtgttccatacgtccgatgccgcacaaggagcacgcagcaacgatggagcctgtacatgcgtttgaatgccaggttcctgacgtactcggctggagtacaaatgcaatcaaactgtgggagggggcttgctcccgatggcggagggtcagtcagcacatctgatactgacccactgcccatcgggagcaagccccctcccacatttgggcgatggtgtgcttgagccaggcgtcagacagtgccagtaccacttgcgacgagacggggccagcagcctcgggccactgaaggccaaaggctgaaatgcaagggtctcagatactcccgaacacagccgggttcaccctcatggaaaaacgccctaacctgctttcatactgcgatgcctatacagcacccctttcttatcaaaaagaaaaatcatctggttgcccccagagtcctgacaaacaacgccctcagtttctccgtcgacaattccttggcatgccatgttcgatacatatggacggatttggcacttcagggttttgccatcctggatgatcaggtgatgggtggcggagatgtcttctggagcaggcctggggcaggagccgtcaccccaatcaacccctcgatgattgggttgtgagacgcaaccggcaagcaggaacaggggcaacagatatttgaaatttatgatcaccgtccttggttgcgaagaagatgagtacattcttcgtaaccatatctcgttttatcggaggtgttctttcaagaacggacgatttgcgcccccggcccagcgcgggccttcttgtttctagtgatcccccactctgctatggtggcgccctcataccgcaacgcaagcatcaaagaatggactcatggaagactgttgtaatcgtcgtgatgacgttgatcggcaaccaggtagtagcggcggaaaatgccaaccctttcgataaaggtctgatgatcacgacgttcctgccaactattctgattggggcaacgacgtctctcacgaccgaaccgccagagcttttcaaatcagccaaaaccgatgctcttgcctacataggctcgaatggcgagattcgcggtgcgcagtttgagcaagcatcccggcattatcgctcaacttatagatcgcccctcatgtccgatatgcaactcgcccaggcgattgcgactacatactgataccgaccgttaacctatcctccctgcaatcagcggcgggtgcctcgacctaatccaactccccgcctgctgccggtgcccattctgtaagagcgcatccgtactcggcccacagaacctgtgatcccttcccgttcaaagtcagccgctaatgctcttgcgcaatcgccgggagccagcccttggcgaattctcgggttttcgggtcgaaattgattgggtggccagtggggcatttaacctagccctatcgagccccctcgccagagcgtttgtcatcgtttctcccggcaatgaatcgggcgcctcctcaaaaagcatcttcccatcaactccgtagacccctatgaacaactccgttctgccgagaagcgacattcggacttggacgtttagaagcgtgccatcaggctgccgctcatctacggatcgagtatgaagggcgggatcagcccagtcccagaaaaccttacccctgtttctcatgtaagcgccccgatgttaaggcggcaattatgcgactggattggggaggaaaatagtacagagcgcaggaaattttctgtttccctgaggctcgatgtcactgatccacgtgccttggactgaggcagccaagcggtggagaggcctgatcatccactttaggcttcagaaaatgcgtccacgctgagtgagcagcgtcgtagcgtgcatttgcgtagctccactctacaccgccaatttttcccgcaactacaagcatcatcagatcacttatggctgcgtcgagttcgagcagacgtttgtgcgcttcgaatcggaagtcatcgttactggtcatggcccaagcacctgtgcaaaacatgagccgtagacattttcctgtacgaaaaattcttgcccgtacaacaaaatcgtcattccaagcatgctgttccacgatcagcctcgaatgaaacactgcatcacccgcagatctcgtcataaattgcctgaggtttgagtgccggcctagcaatagacaggtatccactggctgccaatacgtgactatgaatatggggcgggcaccggccatggccaacgttacacccgcaaattagggcaaacagactttgccaaccccctgcgaatgaacaccgaacacaacggtgaagacgagtgaatcagccaggctgaaatttgattcgaacctacttattgggctcgaatttcgcgaacatcatgccgaagaaaaagcccccgaccatggccagatagacagacttatagccggaaacgttataggccaaccagtagttagctgcggtgattacggcgaatgccaagaaaaactgcttacgagaaaattggcttaaaaaacgacttgccgccgcgttcatagccttgagtttattcattgcgcttccttccttgaaaaatgcggcaatcctaacttagacaccttttgtctgccatgctgcatccggtaaccgaagggcgacaactgcttatgattgctacgtgagcatgtaactagggctttaccgagctcttgatcacccaaacaccaacaagaacaaacgctgctgatttagccacggcgaacagagaatctcttccagcaaacaactcaaacgccgaaaatagtagcgagatcgtccctactaccaccaacccatagccaactgggcgcacgtacctgtggaacattttttcgtctccctgataaaaatgaaattgtagatttcctcacatcgtaaccttatcaacctttgcgccaccatccgcgatcacgaagagcggcgcctgaatgcacataatccatgagcaacgacatgtacgaggccagcgcacctgctgtgcttttttgattgcggcattatcttctggctatcgtcctcaacaccaccggaaccctgggccaatagcggtctatcccagcgttaatccacgacgaacaacttcgcccccctggtgctgaaagatcggtgcccctcagcgttgctgcccacctgatagctcatccccgcggtgagtgtgaactgacgaccatcttccaactccgtgtgcaactcaccttccaagcacaacaggatatgacctctccagcaccagtgatcggcaagatagccaggactgtattcaaccattcgcacacgtgtcgaaccaaactggcaagttcgccaataggcggtacccgtctgtccaacgtactcgataggttcgacagttgaccaatcggtcgtaccaaacggaacagcggtcaggtccatgtttgcctcatcaatggaagggggtctgcggaccgtacctatgcagtgatccttttcgatagacacagatgccccgcatttatgagatacaggcgcccaatcaagcgtgcagcctagaggaaagttttcggtcggggatgtgtgaaaacatttatcagcgcgattggcgcccagtgttggactgaaaatcgtgcttctacgcaaaacccagatcggctgagcattcgataattttcggatttctcatagatgcgcaagcttcaattttcccgaagcgtttttacacgctctaatgggtggccattgatcgtcgaaactcaaactaaaggctaaaggattccccagtcctacgcctgcaagaccaagaacagcagtttcaattccgtaacatccgtccgaaagctgccagcgagatcctcgaccttgaggatgcaagccgcctattgggtcacatcgacacgcggataaaccgagacagtttatagacacgttggcgagatcgttaagccgaccagatgaccgagacgtgcaactggttgcggaaatcgtcaacattaatagcccgacataaccaaaccccaggaatgcaaaagccccgctttcgcgaggctttcgtgtaaatcttggcgggaaaccagggattcgaaccctgggaacgctattaacgttcgccggttttcaagaccggtgcattcaaccactctgccaatttcccttgtgcatcacaggattatagtagctcatcccgtctcagcgggcgccataatacccgaatgaaacacactgtcaaactctctgcatcgcttgttacagggcgtctgttatgatctttgcgactgaacgtttcaaaactgaaggagtgtcgccatgcgcgaacagaattacgcagtgaatggtaacgcgcaggctgagcagcttgaagtcagccgcgtcttgcgcaacacgtacggactgctcgcccttaccctcgcattcagcggcgtgatggcctacgtggcccagcagatgcgcgttggttatccgaatatctttgtcgtgctgatcggcttctatggtctgttcttcctgaccaacaagttgcgcgattcggcctggggcctggtgtcggcgtttgccttgaccggtttcatgggcttcatcctcggcccgatcctcaaccgttacctcggcatggccggcggtgcggaagtggtcagttcggcgtttgccatgactgccctggtgtttggtggcctgtcggcctacgtgctgatcagccgtaaggacatgagcttcctgggtggcttcattaccgcgggtttcttcgtgttgctggcggcagtagtggccagcatgttcttccagatcagcggcttgcaactggcgatcagcgcgggttttgtgctgttttcctcggtgtgcatcctgttccagaccagcgccatcatccacggcggtgagcgtaactacattatggcgaccgtgagcctgtatgtttcgatctacaacctgtttatcagcctgttgcagatcttcggcatcatgagccgcgacgactgatcagtcagtcacaataaaaaatgccccgtatcgcgagatacggggcatttttatttccaggcctgcacgaatggtcagtactggttgggttccatttccagctcgaccttgaagcgcttgaagatatcctgctggatacgcaacgccaggttggcaatctcgcggcctgtggcggtgccgtagttgaccagcaccagcgcctgcatcttgtgtacccccgcatcgccgtctcgaaagcccttccaccctgccttgtcgatcagccagccggcggcgagtttcatttgcccgtcggcctgagggtatgcgaccaagtccgggtgttggctttgcagttcggcagcgagagcctgggacaccagtgggttcttgaagaagctgccggcattgcccagctctgccgggtccggcagtttttcccggcgaatgctgcagatcgcccggctgacatcgcttggcgtggcgtcggtaataccctgggcggccaggcgttgttgtaccgggccgtagtcaagtttcagctggctggcgcggctgagggcaaagcgtacccgcaggatcaaccagcgcccgacctcatgcttgaacaggctgtcacggtaagcaaacctgcattcgtccaggctgaaatcccgcagctcgccggtctggcgatccagggcggtgaggccggcgaacacatccttgatctccacgccgtaggcaccgatgttctgcatcggcgccgcaccgaccgtgccggggatcaggctgaggttttccagaccgcaaaagccgtgctcaagggtccacaacacaaacggatgccaggcttcgcctgcttcggcctcgacgaccacgtgcacgccatcgtcgtgcaccacgcgaatgccttgggtggccatgcgcaataccagcgcaggcacatcctgggtcagcaacaggttgctgccaccaccgatcaccaacagtggcagcgcttgtgcagctgcgtaggccagagcctcgcggacatccgcatcactgtgggcctcggcaaacaattgcgcacgcacatcaatgccgaagctgttgaatggcttgagcgatacctgcgcaagcacttgcaaggtcataagcggcccttcaattcgatcaccaataaatcgcaggcgcgctcgatcaggtccaggacccgctcgaaaccttgttcaccttcgtagtaagggtctggcacttcgtccacttcgccgtcaaagcggcgcaaaaacaagtccagttccgccttgccctgccccggctgcatggccttgaggttgcgcaggttgctgtggtccatggccaggatcaggtcatagcgcgcgaagtcggcgcggctgacctgttgggcacgctgggacgacaggtcataaccccgcgccagcgccgcacgttggctgcgctggtccggcgggttgccgatatgccattcgccggtgccggcagacgccacttcaacccggccagacaagcctgcatcacgcaatttatggcgtagcacgccttcagcggtcggcgagcggcagatattgcccaggcatacaaacaggacttccatcaggcgcccagcaggcgacggacgcgctccaggtcttcctgggtgtcgacacctgctggcggcgcctccaacgcatcgctgacatggatgcgcaccccgtgccacagggcacgcagttgctccagggattcggtgttttccagccagcaggggccccaattgacgaaatcatgcaggaaaccggcacgataggcgtatatgccgatgtggcggcgatacggcacgccttccggcaatatgtcgcgattgctggcgaaggcatcccgcgcccaaggcagggtcgagcgactgaacgtcagtgccaggccattgatgtcgctgaccactttcaccacgttcggattgaacagcgtttcaatatcttcgatcggttcggccagggtcgccatgcgggcttcgccatgggccgccaggttggcggcaacctggtcgatgacgctcggcgggatcaacggctcgtcgccttgtacgttcaccacgatggcgtctggcgccaaaccgagctgggtggccacttcggccaggcgatcagtaccggagttgtggtcttcacgggtcagtaccgcttcagcaccaaagcctttgcacgcctcgataatacgcgggtcatcggtggcgaccaccacgcgctcggcgctgcttttgcaggcttgttcccataccagttggatcatcggcttgtcgccgatcatttgcagcggcttgcccggcaggcgcgtcgaggcatagcgggagggaatgacaacggtaaaggcggtggtcatttatccaggcgctcatcggtagtcaaggtacgggcttcgctttcgagcatgaccgggatgccgtcacggatggggtaagccaggccggcgcccttgctgatcagctcggtcttgtcggcgctgagcttgagcgggcctttgcagatcgggcaagcgaggatatcgagcagtttggtgtccatgagtgtttcctggaaagaagcgttttaaggcaagagacggtcgggcagcagacgcatcagctgcgtgtcgaaccaggcgacgaacgccggtgacggcaccgcatccaccgcaaggtaccaccagtcgggctgggcaaaggcgcggcacttcaccgcgtccttttcggtcatgaccagcggcaatgacgggttaaaactcaagacctcggcgctgtagggcgcgtggtcggcaaaagcatggggtatcggctgccagtgtagcgtttcaagggtattgaagaaacgttgcggattgccgatgccagcgaccgcatgcacctgctggccctcgggaaagtaggctaccggcttgcgctcgccactgtgcaggttaatcagcgcagtgggttgcaggcgaaaggcaaagccatcttcacggtccgtcgcggcaccgttatacagcagcgcatcgacactctgcaggcgctccaccggctcgcgcaacggcccggcaggcaggcagcgtcgattgccaagcccgcgggcggcatcgatcagcaccagttcgagatcgcgggccaggcggtaatgctgcaagccgtcgtcggaaaggatcaggtccaggggttcactggccagcagggcctttaccgcgcgactgcggtcggggtcgatcatcagcgctacgccgctgcgctgcacgatcagcaagggctcgtcgccggccacgtcggcgctgtggccggcctcgacccgccacggcagttgcggtggcttggcaccatagccacggctgaccacgcccacgcgcaaaccgctgcgccggcagtgttcgatcagccacaggatcaacggcgtcttgccggtgcctcctacggtgatgttgccgaccaccactaccggcaccggcgattgatagatctcgccctcgcccgccacaaagcgcgcacgcttgcgttgcactacccggcgatacagtgactccagcgggcgcaacaacaccagtgccggatggccctcgtaccaggccttgagcaaacgatcggacatggccatcagggtgggctcgccgcctcgacggtggtcatgcgcaaatgactgaaaccgagcttgccggcagcgtccatggcggtgatcacggcttggtgctgggtcttgccgtcagcgctgatggacagcggcaactgggtgtcaccaccagattccttctgcaaggcttccatcaggctggcgaggtcgtttttctccagcaactgattattcaccgaaaacacgccatcggcgctgatggcgatgtccagttgcttgacctgctggtcgtcggcaggcgaaccgctcactgcttcaggcaaatcgacacgcagctgggtttcccgggtgaaggtggtggtcacgacaaagaacagcagcaggataaacaccacgtcgatcaatgacgcgaggttgatatcgacattttcccgttgcttgcggcgaaatttcacgctttaccctcgaccaggtccacgtcacggtcgccctgcaccacttccaccagtttgatagcttcctgttccatgccgaccaccagctcatcgatgcgccgttgcaggaagcggtgaaagaacaccgcgggaatccccaccatcaggcccgcagccgtggtgatcaaggccttggaaataccgccggcaagtaccgccgcattggtcgccatgcccgcgcccatgaacgagctgaagatgtcgatcatgcccaacaccgtgccgagcaggcctagcagcggtgccatggcggcgatggtaccgagggcgttgatgtaacgctccagctcatggatcacccgcgcagccgcttcttcaatgcactctttcatgatctcgcgaccgtgcttggagttggccagaccggcggcgaggatttcacccagcggcgaattggcgcgcagttccttgagtttttgcttgtcgagctgcttgttcttgatccagccccagacttgccccagcaggtgctcgggggtgacgcgactggcgcgcagggtccacaggcgttcggcaacgatgccgagtgcggcgatggagctcagaatgatcggcaacatcatccagccgccggatttgaccaattcccacacagtgaatgtcccctcgaaaaagtgcgccactttaccatataggttcggcagcggggtccgtcggctacaggcccgcccgtcgcggcccagagtctttggtaacgccggattacggtaacggttcgcgccagaacctgcgttgactgcgcgcaacagtcggtggaaggaacgttcccaggcgcaggcgcactgcgccttgttcagcgctgtcatatacccgactgcccagggcctgatagcgctccattacttgtggatgaggatggccgaatgcattgctgcgcccacgggagatcagcaccgatgccggcgccagccgctgcaggaagggccaggacgaagagctgcggctgccatggtgcggggcctgcagccaatcggtcggcaccgccagcggcgaggcaaggaatgcctgttcggcggcgcgatcaatatcgccggtgagcagcaggcgttcgccattggcctcgacctgcagtacgcaggatctcggattgccatcacttgcaccagcccattgccacagttcaaaggccacgccatcccactcccaccgctcgccactggcacaggcctgggtaccgagaaaccctggcaggccttcggtttcgccgcccaccacgcgcttgacgggcagcccccgggccactgcctccgcaccgccggcatgatcggcatcagcatggctgagcagcatcatgtccaactgccctacccccagctttttcaacgacggcaagacgacccgcgccccctggtcgacaggcccagaccggggcccggcgtcataaagcaaggagtgatggcgagtgcgcaggatcagggcctgcccctggccgacatccagctgcaccacgtccacctgcccatggggtatcgactccctgggtggaaaaaccgccaacaacagcatgggccagcccaataaccgaaacggcagccccttgggcaatagcaaaattactgcgccgaccagactcaccagccaatagcccaaaggtacttcggccggtatccaggcaggcagtcgcacagcaagcagcgccaggcccttgaacaagccgtccagcgcgccacccgccaaccacagcaaagcgtcaccggccaacggcacccacagcagcgccgtgcccagcagcgccaagggcagcaccaccaggctgatccacggcaccgcaaccaggttggccacgggtgcactgaggctgatgggcaaacccaataccagcaacaacgggaacaagccaatggcgatcaaccactggggacgcgtccagacctgccaggcgctccacggccccaggcgcccgctgaacgccaggaccagcgctgcgaccgccgcaaacgacagccagaaccccggttgcaggctggccaggggctcaagcgccagcacagcgttcagcgccagcaacaacggccaccaaacacccaagtgacgaaagcgcaaacgccacagcaataccaggcccaccatgacgcaagcccgctgcaccggcacgccgaaccccgccagcaggccataagccaacgccccggaaaatgccaagccgcacgcccacggcagccacggccaggttcggggccagcacccatggcgcgccaacaaagcgatcaagccgtagatcaaccccgccagcaagccaatgtgctgcccggaaatcaccagcagatgcaccgtgccggtgtcctgcaacacctgccaatcctcaggcgccagcccggaaccgtcgcccagtaccaatgcagccaagcccgcctcgcggccctgggcatccacggccagcaggcgctggcggacagcatcgcgccaggcattgcgggccggcgccaggcgctcgccgtcctttaccgtcgcggtggcgccgatacgctgggccagcaaccaggcctcatggtcaaacccgtggaaattaagcaggccggcaggccgctttagcgtcaatgccaggcgccagcgctccccactgttaaccgtcggcccgccatgccaggacacgcggatgcgcttgggcagccgcgcagtgcgcgaccggctgtcggccagttcgaagcgcacgcttgtgcccgtctgttgcggcaggccgatgacacgcccttcgacccagcgcgtctgcccatccagcaccggccgcaagcggtcatccagcgcccactgcgcactgatacaggcccaactcaaacccaacaggaagaacgccacgggataggtgcgaaaaggcagcagcatcaacaccagcaccaacatgcccaacacccctgcgccagacggtaacgcaggtaaccaacgcaacgccagtagccccagcgccaaggccaacatcgctgttttcatggatcatccttttccactgatccactcagttttagctggctgaccggcagcgcctatgatgttttgtcacaaagtctgaattttctgtttatagaatccgggcatacttgcccctcaaattgacctggaccccttatgccccggcgcttattcaaacggtacatgcccgatcccagcagtatcagggaacataagtcattacagtttcttggcaccctgctgcatgatccgaacctctggcacctgaaccggcattcagtggctcgtgccatggcggtgggtttatttgcggcgtttattccgattccgttgcagatgctgcttgcggcaatcctggcgatcgtcgtgcgcggcaatatgccgatcgccgtcagcctggtgtggctgaccaatccgatcaccatgccggtggtgtttgtgtgtacctacatgacgggcgcctggctgatgaacgtaccgccgcgcagcctacccgataacctcacatgggaatggatcagcggccagctgagcacgctctggcagccgttcctgctgggttcggtggtgctgggcctggtattgggggcgctggcctattgcttgacgatggcgtactggcgctggtgggtggcgcaccagtggaaaaaacgtaaattgcgtcggcgctgaaaagctaacgcgccagcaagcgcagatgcacccgcaggccctgcccggtattttccgcccataagcgcccgccctggcgctgcaccgcgttgcgggcgatgctcaggcccaggccgaacccaccatcgccgggccgcgagccgtccaaacgggtgaaaggcgcgaagatgcgttccaaatcccgctcatcaataccgccgccctgatcctgcagccagatatgccaataatccccctcgcgacacccgtcaagttgcacgcagccatcgtcgggagaatggcgtatggcgttgcgcaggatattttccagggcctgggccagtgcgttcaggttgccacgcacccaactgtccgccggcaacaggcacggcaagcgcgacgccggccagtggctttcgaaacaggcgttttcgcgcaacatgtcccacaaagcctggagttgaatgtcttcctggggcagcggtgctgtttcgctgtcgagccaggccagttgcaggctgtcttccaccaggcgttgcatggcgtcgatttctcgccccaggcgctcacgcaggcgggccgggtcttgctcgctgtcgcaggccacccgcaggcggctcaagggcgtacgcagttcatgggacatgtcgcgcagcaactgctgctgcaagcgcaccgtgccttgcaggcgttcggacatatggtcaaaggcgcgccccaactctcccaattcatcctggcggctggtcgcatcccgggacagccgcgtatgcaactggtccgcacgccaggcattggcctgctcgcgcaattgattaaggggcatgatcagcagccgatagaggccgatgcacagcaacagggtgaacaggcccggaatcacaccattggtgactatccgccagaacagttgatagcgccccggcataaaacgttgcggcaactcgatcaccagcgaccccaggccaggatcgaccggaaacggcaccttcatccagggcagccctgtgacatgccggctgaccggccaatccagcccgcgcaaaaaggtcaggcgctggctttccttgtcactcaggggcgtgttgctgagggattgcaaatcgttgccgatcacgccaacccaggtggtttcacgcttggccatcagttgcaaccaggcatccaccccggcgcgtccttgtgtgctccaggccagctcggcgcctgccgcatagccactgagaatctcccgcgacttgtccgacaggtacgcactctgctgctccatatatcggccccacgaccaactgagccagatcatcagcaaacagaacgcgatcaacaggcaggccagtttccagaacagcgagtgtttgcccggcagccgctcaaagcccttcatcaacaccactcagcacgtagcccttgccccacaccgtgcgcacttcacgctcggcatagccgatggccttgagtttgcggcgaatctggctgacgtgcatgtcgaggctgcggtcatggggcgcatacccacgctgcagcacttgctgatacaggaaggctttgctgaggacttcttcagcgttgcggtgcagggtttccagcagccggtactcgctgcgcgtcagtccggcccactgtgcctggcagcacacatcacagcgctcatcatcaaaatgcagcaccggggcattctcccgcatcactgcgcgcggcggctcaggccggcgatccagggccacccggcgcaggatggcttcaatgcgcacgcgcaattcagccatgctgaacggcttgggcagatagtcatccgcgcccaggcgaaagccgctgatgcggtcggcttcggcgcccagggccgacatcagaatcaccggcatggcgtggctctgacgcaaatgcgtgaggatcgacagcccgtccagccccggcaacaggatgtccatcaacaccaggtcaaatgcctggtctcgggccatttgcaggccttgctggccgttgcgacaccacgtcacctgaaaaccactgcggccaagctgctcatgcacgtaggcccccaacacagggtcatcttcgatggtcaggatagtaggtaggccaactgttgcgggagtcattagcgtctgcaagtcattctcaatcactgattattcaagattaaatggctacaggcaatcgccacccggcgccgaatggcccgaagattgccgcatgtcattaatttgcaagattccagaccgtgcaaatggctacactgcgcaggtggcgcgggccggatgccagcgtggataattgataacaacgtggtagcaggagagtggcgtgcttagaagaatggggataaaaggccgcgtactgttgctgaccttattaccgaccagcctgatggccttggtgttgggaggctatttcacctggatgcaactgtcggaattgcagagccagttgctgcaacgcggcgaaatgatcgccgaacaattggcgccgctggtggcgcctgccctgggccacaagaacactgaactgctggagcgcatcgccactcaatccttggagcagtcagacgtgcgcgcggtgtcgttcctcgccccagaccgttcgcccttggcccacgccggcccgaccatgctcaacccgccgcctaccggtaacagctcgcacctactgcagcgcaccggcaacgatgccacccgttatttgctgccggtattcggccggcatcgcaatctggcgggcgaactcatccccgatgagtctgaccgcctgctggggtgggtcgaagtggagctgtcccacaacggcatgctgctgcgtggctaccgcagcctgttcgccagcctgttgctgatcgccatcggtctgatgtgtaccgctgccctcgccctgcgaatcagccgcaccatcaattcgccgattggccagatcaagcaagccgtggcccagctcaaggacggcaacctggaaacacgtttgccactgttgggcagccaggagctggaccagctcgcgtcgggcatcaaccgcatggccgaaacactgcagaatgcccaggaagaattgcaacacagcatcgaccaggccaccgaagacgtgcgccagaacctggagaccatcgagatccagaacatcgagctggacctggcgcgcaaggaagccttggaagccagccgcatcaagtcggaattcctggccaacatgagccatgagatccgcacgccactcaacggcatcctcggctttacccacctgctgcaaaaaagcgagctgtcaccgcgccagctggattacctgggcaccatcgaaaaatccgccgacaacctgctgggtatcatcaacgagatcctcgacttctcgaagatcgaggccggcaagctggtactcgacagcgtgccgttcaacctgcgggacctgctgcaagacaccctgaccatcctcgcccccgccgcccatgccaagcagctcgaactggtcagcctggtgtaccgcgacacgccgctggcgttggtgggcgacccgctgcgcctcaagcagatcctgaccaacctgatcagcaacgcgatcaagttcacccgcgaaggcaccatcgttgcccgggcgatgatcgaggatgagcaggaagacagcgtgcagttgcgcatcagcgtgcaagacaccggcattggcctgtccaaccaggatgtccgtgcactgttccaggcgttcagccaggccgacaactcgctgtcgcgccagcccggcggtactggcctggggttggtaatttccaagcgtttgatcgagcagatgggcggggaaatcggcgtcgacagcacgccaggtgaaggctccgagttctggatcagcctgaacctgcccaaaacccgtgacgacgttgaagacctgcccggcccgccgctgctgggtcgccgcgtggccgtgctggaaaaccacgaactggcgcgccaggccctgcaacatcaactggaagactgcggcctggaagtcacaccgttcaacaccctggaaagcctgaccaatggcatcaccagtgcgcaccagaccgaacaggcgatcagcctggcggtgctcggcgtcaccgccaatgacattccacccgagcgtctcaaccaacacttgtgggacctcgaacacctgggctgcaaggtgctggtactgtgcccgactaccgagcagatgctgttcaaccaatcggtgcccaaccccaacagccagttgcaggccaagcccgcttgtacacgcaagctgcgccgctccctggccgacctgatcagcccgcgcccctcgcgcagcgaaccgggagagccgctgtccagccgtgcgccacgggtgctgtgcgtggacgacaatccggccaacctgctactggtgcaaaccctgctggaagacatgggggccaaggtgcaggcggtggaaagtggctatgcagccatcgatgccgtcaagcaagaaaccttcgacctggtgttgatggacgtgcaaatgcccggcatggacgggcgccagagcaccgaggctatccgccaatgggaaagcgaacgccacggcacgccgctgccggtggtcgccctcacggcccacgccatggccaacgaaaaacgcgccctgctgcaaagcggcatggacgactacctgaccaagcccatcagtgagcgccaattggcccaggtggtgttgaaatggaccgggctggccctgcgcaaccaaggccaggagcgcgccaacgacggcctggcccagggcgtacaactgctggtgctcgaccacgaggaaggcctgcgcctggccgccaacaaggcagacctcgccgctgacatgctcgccatgctgctggcttccctggaagctgatcgcctggcaatcaccctcgcccgcgaagccaatgacaaccatgccctgatcgaacgcgtccaccgtctgcacggcgccacgcgctactgcggcgtgccgcaactgcgcgcagcctgccaacgcgccgaaaccctgctcaagcaggatgatgccaaggccatggccgcgctggatgaactggacatggccattgcgcgattggccagtgaagccagggtcagcgcctgatcctgttttcatgggcaacgaatcaacaatgtgggagggggcttgctcccgatggcggtgtatcagttacagatatttcgactgacacactgccatcgggggcaagccccctcccacatttagtcagcatttccaacgtgtaaactgcagggagccttcttgatgcgcgtcattctgttcagcagccaagcctacgaccgtgacagctttctcggagagccgcgcccccagggcattgagctgcaattccaacccgcccgcctcaaccttgacaccgtggccctggccgaacaccacgaggtggtctgcgcctttatcaacgacgacctcagcgcaccggtattggagcaaatggccaaaggcggcacgcgcctgatcgccctgcgttcggccggctacaaccacgtcgacttgccggctgccaagcgcctgggcctgaccatcgtgcgcgtgcccgcgtattcgccccacgccgtggccgagcatgccgtggcgctgatcctggcgctcaatcggcggctgcaccgggcctacaaccgcacccgcgatggcgatttcagcctgcacgggctcaccggtttcgatctggtcggcaagaccgtcggcgtggtcggcaccgggcaaatcggcgccacgttcgccaagatcatggccggcttcggctgccagctgctggcctgcgatcccttcccgaatccgcaggtccaggccctcggcgcccgttacgtgagcctgcccgaattgctggccgaggcgcagatcatcagcctgcactgcccgttgaccgtcgacagccagcacctgatcaacgcccgctcactggcgcagatgcagcccggcgcgatgctgatcaatactggacgcggtggcctggtcgataccccggcgctgatcgaagcgctcaaggagggccagttgggctatctggggctggatgtatacgaggaagaagcccagctgtttttcgaggatcgctcggacctgcccctgcaagacgacgtgctcgcccgcctgctgaccttccccaatgtgatcattaccgcacaccaggcattcctcacccgcgaggccctggcggcgattgccggcacaacactggccaacatcgcggcctgggccgagggccgggcgcagaaccgggtcgagggatgatcagcggtcacataccaagctcatgataggccggcacccgtgataggatgccgcgcctatttggaggatccatggccgaacacgatttccgcttcagcttgctgagcccgcaacacaccctgatcgaatgccgcgccctggtgccgggccgttaccaggtcaccggcaacggtggttcgatcaagcatggcgacgtgctgatcgtcaccttgcgcggcagtaaaaccctgtcgatgcgcctgaccgtcgaaggtgacgcacgctactccatccgcccggccggccaatgggtcgccatggcccaggggccgaagttcggtgagctggagattcatacctggaaggtcaattgcgacagctgcgacaccgtgctggagtttgaatttgcggtggaaaccaagctgaccaaggagccactgcagccggctgccaacgcacgcatcaaagaactcggctgggccagcgaaggcgacaagcaccgctgcccgaaatgccagcaggctgcgcaatgaaaggcgcgttgttgctcggcgcaatcggtatgggcctggccggctgcgccgcggatggcgcgaagctggagcgcgaccacagctatgtggtggaatggatcggtgaacggccgctgatggactatgcgcacctgaccgtcaccctcggcgccgatggtcgtgcctatggcaatggcggctgcaaccactggttcgcgccgtacaccgtcgagggcgacaagctcagcttcggccagatcggcagcacccgcaaactctgcgccgaggcactgatggagcaggagcagcgctttttccaggccctgcaaggcgtgcagcgctgggacatctcgccgatcgaacagacgcggttctggccggccgagggtaagccgattcgcttgtggcttgaagaaggctgatatccccaatcttcggattgatgggatctcaatgtgggagggggcttgctcccgatagcagtgtgtcagtcaatacatcaattgactgttacaccgctatcgggagcaagccccctcccacactttctctgaggtgttgctttaaccgcgcagggccttgagcttgcccagcaccccttctgcggtctgttcccccatcaattgctcccgcaccttgcccttgtcatcgatgatataggtcaccggcaaggcctcgctgcggggaatctcgaagatcccatccgggttctgggccaggaccgtgaacttgattcccagtttgtcgctggcggctttcaactcctcaccctgaacattgtcgaagttgactccgaacacccccacaccctgccccttcaattgctcggccaaggcgttgagctcggggatttccgtgcggcacggtccacaccattcggcccagtaattgaccaccagccactgcttgtccaggcgttcggccgccactttctggccgtattggtcaacgccgtaatcgttaccgcagccgctgagcagcagggttgtgatgatcgccaatgcaccgatcagtcgccttgtcatggggtattccttcgcaaaaatgaacatgggctgcggcctatcgcctcttacggtttaaggacaggcgccagcgcaggtagaatacccgccaccttacgcaagatgcgacccgcacatgaccgatctgacgctttatcacaacccgcgctgctcgaaatcccgcggtgcgctcgaactgctggaggcccgtggcctcaccccaaacgtggtgcgctacctggaaaccccactggatgcggcgcaaatcaaggccctgctggaaaaactggggatcaacgcccgtcagctactacgcaccggcgaagacgaatacaagaccctcaacctggccgacaccaacctcagcgaagcgcaattgatcgccgccatcgccgcccaccccaagctgatggagcgcccgatcctggaaaccgccgataaagccgtcattggccgcccacccgagaacgtactggagatcctgccgtgagcgcgccctatgtgctggtgttgtattacagccgcaatggctccgtgagcgagatggcccgacagattgcccgcggtatcgaacaaggcggcatggaagcgcggctgcgcacggtgccggcgatttccaccgagtgcgaagccgtggcgccgagcattcccgatgaaggcgcgctgtatgccagcctggatgacctgaaacactgctcgggcctggccctgggcagtccgacccgtttcggcaacatggccgcgccgctcaagtacttcctcgacggcaccagcaacctgtggctcaccggcgcgctggtgggcaagcctgccggcgtgttcacctccaccgccagcctgcatggcggccaggagaccacgctgatgtcgatgctgttgccgctgttgcaccacggcatgctcatcaccggcctgccctacagcgagcaggcgctgctcgatacccagggcggcggcacgccttacggcgccagccaccactccgggcccgacggcaagcgcatgctcgacccccatgaaatcaccctgtgccgagccctgggcttgcgcctggccaagaccgccacgctgctggagaacggccgtggccaggaagcctaaaatcctgccgccccaggcatggctggaaccgcgggtcaaggttgcacgggcactgagcctgctggcgttttttgggctggtgggtttgttgtgcgtgtactacctgttcatcgccgacctgcacggggcgcgtccatgggtgatcctgctgatcgaactggtgccgctgctggtactcgcgcccgggatgatcataggcagcgcccgcgggcattcgtgggtgtgctttgtggtgaacctgtatttcatcaagggcgcgctggcggcgtacgacccgaaccgccagtggttcggggtgttagagatgctggcgagcctggcggtgttttgcacggcgctgttgtatgtgcgttggcggcatcaactgaaccgtcgactggccgattgacacgctcctacaatgatcaatggttgacggtatacgccagcatcatcgacaactggcacatcggacgcccactctcggcatgccactggttgaaggcgccctgcaccgtggccagatcccgcaggctggtcggcgccttgtcgacgatcttctgcgcgttcaacgccgccaccacgtcatagctcggcacaaacgtatccttgcccaccatccgcagaaaccgcggtgccgacagcccacccagttggtggccatgcttgctcaggtatttccataacccgacgatatcggtcaccggccaatcggcgacaaacgcaccgaagctgcccttctcctgctcgatatcgaggatcatctgcgcattgcgcggcacactcttgagtttgcccaggtggcggatgatgcgggtgtcctgcatcaggcgttccaagtgctcggcgcccatcagcacgactttttccggatcgaagccgaaaaaaacctgctcaaacgccggccacttggcatcgaccacactgtgcttcaagcccgcacgaaacacccgtagcgccaaagtcgacaggtaacggtcatcggtgatcttgcgcaattgcgccggggtcttgggcacaggcaggtgggcttccagctcggccgtcgaaccgaagcggttcagacaatattcgtgcagccacttgtaatcgcgcatgccctctcctggcagttgaattgaaaacggcgcccgcaagcgccgtttactagagcctcgacgaggcttagaggttcactacattgacgaaacgcgaagcagccgtctcatcgattttcaagctggtgaaatcgaacaggttgcgatcagccagttgagacgggatcacattttgcaggctgcggaagatgctctcggtacgcccgggggtcttgcgctcccagtccagcagcatgtccttgaccacctggcgctgcaggttttcctgggagccgcacaggttgcaggggatgatcgggaattgcttgaagtcggagtaggcctggatgtccttctcgttgcaatacgccagcgggcggatcaccacgttgcgcccgtcatcggcgcgcagcttgggcggcatggccttgagcgagccattgaagaacatattcaggaagaaggtctcgacgatgtcatcgcggtgatgacccagggccatcttggtcgcgccgatctcgtcggcaaaggtgtagagcgtgccacggcgcaggcgcgagcacagcgagcaggtggtcttgccttccgggatcagctccttgaccaccgagtaggtgtctttctcgacgatgtggtactcgacgcccagttctttcaggtaggccggcagcacatgctcggggaagccaggctgtttctggtccatgttgacggcgacgatctcgaactggatcggcgcgaccttttgcaggtgcagcaacacgtcgagcatggtgtagctgtctttgccgccggagaggcagaccatgaccttgtcgccatcctcgatcatgttgaaatcggcgaccgcttcaccggccaggcgacgcaggcgtttttgcagtttgttctggttgaccgtaagagtgcccatggcgcttggatccgctgaaggtgtgacgaaaagccgggtattttagcgatatgaacgaccaagttccaatgtgggagggggcttgctcccgatagcggtgtgccaggcactacaagtgctggctgatacaccgctatcgggagcaagccccctcccacatttgacagatcccgccgcgattaaacctcaggtttacagcgcaatttgctctaaaggccctacagttattccggtcatcccttcctatactgcgacttgaggtcgcacacaaactatccagacctttcaggccatctggccggtgggcgctccgatggggggcgatggtaataacgacaggagtgactggcatgatccatcacgtcgtggggctgtttacccatcccgaccaggaatggcgggaaattcgtggcgataaggaagaaagcattggccacatgtacctcactcataccctgattcttgcggcgatccccgccgtatccgcctttatcggcaccacccaggtcggctgggtcatcggcaaccgcgcaccggtcatgttgacccaggaaagtgcgctgtggatgaccctgatgtcttacgccgccatgctcggcggtgtagcagtgatgggggcgttcattcactggatggcgcgcacctacgacgccagccccagcatggcccgttgcgtggcctttgccacctacaccgcgaccccactgtttatcggtgggctggcggcgctctacccgcatatgtggctaggcatggtcgtcggcacggcggcgatctgctacacggtgtacctgctgtatgtggggttgccgactttcatgagcatcgacccggacgaaggtttcctgttctccagctcggtactggccgtgggcttggtggtactggtggcgatcatggcctttactgtcatcgtctggggcttgggcgtcgggccgatctataccagctgaacaaacaaaaccctgaggcaaggccaccgcaaggtggctttgtgcgtcatgcatgaccattcggcgcctgacagattcggaaacacctggttttgcggcatactgggtgtctctggagatatgtacagcatgcccgagcaactcaatacccgcgtcgaagattgtttcctgcaagccgaatcctttttcaaacgaagcttcaaacgcccccaggtcagcctcaagctgcggggccagaaggccggtgtcgcgcatttgcacgagaacctgctgcgcttcaaccctcagctgtaccgtgaaaacagccagcactttctcaagcaaaccgtggcccacgaagtggcgcacctgattgcccaccagttgttcggcgaacgtatccagccccatggcgaggaatggcagctgatcatgcgcggggtttatgaactgccgccggatcgttgccatacctatgagatcaagcgtcgccaggtaaagcgctatatctaccgatgcccatgtgcggacagtgattttccgttttcggcgcagcgccatggcctggtaaaccaggggcggcggtatttgtgtcggcggtgtcggcagaccctggtgtttactggcgaaactcgggtggaataagggcctcatcgggagcaagtcgaatcgtcgcaccgcccctcccacctttggatctgtgaatacattctaaatgtgggagggggcttgctcccgatgaggccagtacattcacccaaccaccttggcctgccgcaactcctctattcgctgagcactgagccccaactgcgccaacacttcatcactgtgcgcccccactggcgcaccaatatgccgtggcgccggcaaaccctcggaaaacttcagcgggcaggccaattgcgcttgtgtcgagccatcccctctgggcacctggctgaccagttctcgagccttcaactgcggatgttcaacagcctccgccaggctcaacaccggttccacacacgcatccaccccggcgaacagctcgcaaagttcctcaaagctgcgcttctcaaactccacccgcagggcctgcttaagaacggcctgctgttcaggcttcacgctgtgggccgccaactccggctgtcccagtgcctcgcataattgctgcataaacgctggctccaaactccccaccgacatccagcgtccatcacgactgcggtagtagtcgtagaaactcccaccattgagcacatggttctcccactcaggcgtcaccccacaggccaggtaaccggcgccggccatggcgttcaagctgaacgagcaatcggtcatgctcacatccaggtactgccccaccccgctctgctgcctggcaatcaccgctgccagcaagcccactacagcatgcagcgacccacctgccacatcggccagttgcacccccagcggcagcggcccgctgtcccggcgcccggtgtggctggccacgccggccaacgccaggtaattgatatcgtggccggcgcggtccttataagggccggtctggccgtagccagtaatcgatacatagatcagccgggggttgatagccttgagcgcttcataccccaaacccagccgctccatgaccccgggacgaaactgctcaagcacaatgtcatgacccttgaccaactcacgcacgatctccaccgcctctgcctgcttgagatccagggccaggctgcgcttgttgcgattgagataggcatggctcgccgacgtgccgcggtcatggggcggcaacacgcgcagcaggtccatacgcgtaggcgactcgatacgcaacacctcggcgcccatgtccgccagcagcaaggaggcaaacgggccgggcagcaaggtggaaaaatccagtactttaagggacgccaagggacctgacatagggactccatccgggttgcgaatccccacagactaggcagccttgcgcctgccggcaatcgtcagaacgatcagcggcagtgaccgttttgatcacggcgggctttttcgcggcggcggctttatcattggcccacgtttgttggcagagtgttccatgaagttcgcgattgcactgtatagcgccgcccacacgccctcctcgcgccgcgccctgttgttcgcccaggcggcgctggtcggtgggcatgagattgtgcggctgtttttttatcaagatggcgtgtacagcgcgtccaataacatcgttgccccccaggatgagcaagatatcgcccaccaatggcgcgagtttgtcagccagcaccagcttgatggcgtggtatgcatcgccgcggccttgcgccgtggcgtgctcaatgccgaggaagccacgcgctatcaacgcagcgcggtcaaccttgaggcaccctgggcgctgtcgggcctggggcaattgcatgacgctatacagggcgccgaccgcctgatctgttttggagggccatgacatgtccaaatccttgttggtaatcagccgccaggccccatggtccgggccaagtgcgcgggaagcgctggatatcgtgctggccggcggcgcgttcgatctgcccattggcctgctgtttcttgacgacggtgtgtttcagctggcaccgcaccaggacgccaaggctgtgcagcaaaaggacctcggtgccaatctgcaggcattggggctgtttggcattgatgacgtattcgcttgcagccatagcctggcggagcgcgggctcaccccgccggccagcgcccagcccctgggcaacgaagacatttgcaggctgattgaccgttacgaccaggtgataaccctctgatgtcgactttacatgtgctgtctcattctccgttcaccgatagccgcctcgacagctgcctgcgcctgtgtgggcgcgaagacgcgatcctgctctgcggcgatggcgcctacggcttgcacagcccggcgttgcgcaccaagggcgtgaaggtgtttgtactggccgaagacatgcaggcgcgtaatttgcccctgcccgactgggccgacagcgtggactacccaggtttcgtacaactgtcgatcgactacgacaaggtcaacacctggctatgaacaccttgaccgtaggcgctcgcgccctggaactggacaaggacggctacctcgtcgacctggatgactggtccgaagaggtggcgcaggccctggccgccgccgaagccctggagctgaccccggatcactgggagatcctccggctgctgcgccagttctatgcccaattccagctgtccccggccacgcgcccgctgatcaagtacaccgccttgaagctgggcccggaaaagggcaacagcctgcacctcaacaaactgttcaatggcactcccgccaaactcgccgccaagctggcgggcctgcccaggccgacgaattgcttatgaccgactttgcccccctgaccctcgcaacgcctgaagagcacccctttgcgcagttcgtgcgcatcctcggcaaaggcaagcgcggcgcgcgcaacctcacccgcgaggaagcccgggaagccatgggcatgctgctcgatgaaaaggtcgaggatacccagctcggtgccttcctgatgctgctgcgccacaaggaagaaagccccgaagagcttgccggcttcaccgaagcggtacgtgaacggctcaacgcaccagcgctgaatgtggacatcgactggccgacctatgccggcaagaaacgccacctgccgtggttcctgctcgcggccaagtgcctggcacaaaacggtgtgcgcatcctgatgcacggcggtggtgcccacacggcgggccggttgtacaccgagcagttgctggagactctacagatcccgctgtgccgcaattggcaacaggtcgagggcgcctttgagcacgctaacctggcgtttatcccgctaggcgactgggcgccgcaattgcaacgcatgatcgacctgcgcaacaccctcggcctgcgctcgcccatccactcgctagcacggttgctcaacccgctgaacgcgcgttgcggcctgcaaagcatcttccacccgggttaccagggcgtacatcgcgatgccagtggcctgctcggtgacaatgtgattgtggtcaagggcgacggtggcgagatcgagatcaaccccgataccctcagtcacttgtatggcaccactggcggccagagttgggacgaagagtggcccgccctctccgcccagcgtcacgtcaagcccgcgaccctggagcccgagcatctgaaagcgctgtggcgcggcgacgtcgaggacagctacccgcaattggccctgatcgccaccatggccctggcgttacgcggcctgggccacccacggcaacaggcattcgaattggcccagcaatactgggatgcacgggataaatcgatttagtcgatcattcacccccggtctttgcgcttttagttcgaactcatccctttagactgggctccaacgtttatcagccaaggagccagtcatgggtttactgatcgaaggacactggaaagaccagtggtacgaaagtagcaaagacggcgctttccaacgggaacaggcacaacgccgcaactgggtgaccgccgatggccagcctggccccagcggtgaaggtggcttccaggccgaggcaggtcgctatcacttgtatgtttccctcgcctgcccctgggcgcaccgcaccttgatcctgcgcaagctcaagggcctggaaagcctgattgacgtctcggtggtcagctggttgatgctggaaaacggttggaccttcgacaaggcccacggctccagcggcgacaaactggacggtctggacttcatgcaccagcgctacaccgccgagaccgccgattacaccgggcgcgtcaccgtgccggtgctatgggacaagaagctcaagcgcatcgtcagcaatgagtcggcggagatcatccgcatgttcaacagcgcattcaacgggctgactggcaacaccctggatttttatcccgacaccctgcgcccgaccattgacgcactcaacgaacgcatctatccggccgtgaacaacggcgtgtaccgcgcaggcttcgccacgtcacaacaggcttatgaaagtgcctttgatgatgtgtttgccgagctggatcatttggaacagcacctggaccagcatcgttatctggccggcgaatacctgaccgaggccgatgtgcggctgttcaccacgctgattcgttttgatgcggtgtactacagccacttcaagtgcaacctgcggcggattgcggattatgcgaatttgtcgaactggctgagggagatgtatcagtggccgggcgtggcggagacggtggatttcgagcatatcaagggacattactatgccagccatcgcacgatcaatccgaccgggattgtgccgaaggggccgttgcaggggtttgacaacagccatgatcgggcgcgactttcaggtaaaggtgtctttagttgatcgggatcatcggttgtatttgatggcctcatcgggagcaagccccctcccacattttgactgtgttcacaaatcaaaatgtgggagggggcttgctcccgatgcttttaaggctcagacctgagactgagccccttcgaaccatttgagcttctcgcgcagtaccactacctcacccacgatcaccaatgtcggcgcatgcacttcatgctccgccaccatgcgcggcaaatcggccagggtgccggtgaacacgcgctggttggaagtggtgccctgctggatcaaagcggccggcgtgtccgccgagcgcccgtgcttgatcaactgctcgcaaatgatcggcaagccaatcaagcccatatagaacaccagggtctgcgacggccccaccaagtcctgccagggcagatccgacgtaccgttcttaaggtgtccggtgataaagcgcaccgactgcgcatagtcgcgatgcgtcagcggaatcccggcatacgccgcgcaaccactggccgccgtgatgcctggcaccacctggaacggaatgccatgggccgccaattcctcgatttcttcgccaccgcgcccaaaaatgaacggatcgccgcccttgaggcgcagcacgcgcttgccttgcttggccaggtccaccagttgctggttgatctgggcttgcggtacggcgtggtcagcgcggcgcttgccgacgtacacacgttcggcgtcgcgacggcacagctcgagaatcgccggcgccaccaggcggtcgtagagcaccacgtcggcttgctgcatcaggcgcagggcgcggaaggtcagcaggtccggatcgcccgggccagcgcccaccaggtaaacctcaccgggcgcgtgcggcggtgcgccgttgaccttgtcgatcaacaggcgctcggcctcgtcgccctgcccggccaattgacggtcggcaatcggcccctggaatacctcttcccagaacgcccggcgttgctgcacatccgggtacaaacccttgacctgggcacgaaaacgcgccgccaacccggccaactgaccgtaggtagagggaatccaggtttccagcttggcccggatcaagcgcgccagtaccggcgcatcgccgccactggagaccgcaatcaccaagggcgaacggtcgacaatcgctgggaagatcacgctgcacaaggccggcgcatccaccacgttgaccggtacgcagcgacgcttggcgtcactggacacctgcgcgttcagtggttcatcgtcggtcgccgcgatgatcaaggtgcaaccgtcaaggtcggcctcctgataaccgcgcaaaatcagttccccgccactgcccagcaccagctcgcgcagctggtcttcgatctggggagcaaccacccgcagcaatgcaccggcgtcagccagcagccgggatttgcgcaaggcaatctccccgccaccgacgaccaacacacgactgccgcgcaggttatgaaacagcggcagaaattccatttagccgatgacctcaacgccgcccatgtacggcttgagcacctcaggcacacggatcgagccgtcagcctgctggtagttttccagcacggccaccagggtacgacctacggccaggcccgaaccgttaagggtgtgcaccagctccggcttgccggtttccgggttacggaaacgcgcctgcatgcgacgggcctggaaatcaccgcagttggagcacgacgagatttcgcggtacttgtcctggctcggcacccacacttcgaggtcgtaggtcttcacggcgctgaagcccatgtcgccggtgcacagggccaggacgcggtatggcagctccagcagttgcagcacccgttcggcattggcggtcaggccttccagggcttccatggaagtcgacggctcgaccacctgcaccatctcgaccttgtcgaactggtgctggcggatcatgccgcgcgtatcgcgacccgacgcgccggcttcactgcgaaagcatgggctgtgggcaaccagcttcaatggcaattgcttggcatcgaggatctcgccggccacgatgttagtcagcgacacttcggcagtcgggatcaagtacaggtcagcttcaccatcgcgagtgatcttgaacaggtcttcctcgaatttcggcaactggctggtacccatcagcgccggcgcctggaccaggtacggggtgtaggcttcttcgtagccatgctcaccggtgtgcaggttgatcatgaactgcgccagagcacggtgcatacgggcgatcgggccacgcagcaaagcgaaacgggcaccggacatttttgccgcggtctcgaaatccaggccaccggtcaattcgcccagggcgacatggtccttgatctcgaaatcgaaggctttgggcgtaccccagcggcgtacttcaacgttgccgtcttcgtcttcgcctaccggtacggattcgtggggcaggttcgggatgcccagcaggatcgaatccagctcggtctgaataccttccagctcgatcttgccctcggacagctcagtgcccatgcgctccacatccgccatcaacggcgcgatatcttcgccgcgctgcttggcctggccgatggatttggaacgcgcattacgctcagcctgcagtgcttcggtgcgggtctggacggtcttgcgctgttcttccagcgcttcgatgcgcgcaacatccaaggcaaagccacgggatgccaggcggtccgctacgtcctgaaggttgctacgtaacagtttggaatcgagcatgtcggtctctcgttatcaaagtttggtcaaggacaggccggcccaggtggcgagcagcccgccgaacacgctgatgcccaggtacccgaaggcgaccagggcctgcccgctttccagcaggcgcagcgtatccagtgaaaaggatgaaaaggtcgtcagaccgcctacaaagccgacaatcaagccggcgcgaatttcaattggcacttccgggcgcaacaggaaccagccatacaacagcccgataatcaaacagcccaccaggttgaccgccaaggtcgccgcataaaaatgcttcggccactgggcgctgacccaggtgctggtggcgaaacgcaataatgtaccagcgatgccggctatggacacggcaagaatcgtcttgagcactactttctccgctggcgggggctgagacggtcgagttgggccagatggttgagcttttcgccgatcttcagctccaggccacggggcaccggctggtagagcggcaacggttccagcgcatcggggaagtagtcttcgccggccgcataggcatccggttcgtcatgggcgtagcgatattcgtcaccgtaacccagctgcttcatcagtttggtcggcgcgttgcgcaagtgcatcggcacttccagcgagccatgttcggccgccgcccgcagtgccgacttaaagcccatgtaaaccgcgttgcttttgggtgcgcaggccaggtaggtgatggcctgggccaccgccaactcgccttccgggctgccaaggcgctcctgcacctcccaggccgccaggcacaggctcagggcacgcggatcggcattgccgatgtcttcgctggccatgcgcaccacgcgacgggcgaggtaaagcggatcgcaaccgccgtcgatcatgcgcgcgaaccagtacagcgcaccgtcggggttggagccgcgtacggatttgtgcagcgcggaaatctggtcgtagaaggcttcgccgcccttgtcgaagcgccgacgggtatcgccgagcaggctttgcagcaagtcgacgccaatttcgccgccgtcttcggccaggtccgaggcattttccagcaaattgagaaagcgcctgccatcgccatctgcggcggtgagcaggatcttgaagccttcttcactgacgctcagctggcgcttgcccaggcccttgtcttcattcaaggctcgctgcagcagcttttgcatcgccgcttcgtccaggctcttaagcacgtagacacgcgctcgcgacaacaaggcgttgttgagttcaaacgaagggttttcagtggtggcgccgataaagatcaaggtgccgtcttcgacatagggcaggaacgcatcctgctgcgacttgttgaagcgatgcacttcgtcgacgaacaggatggtgcgcttgccgtattgcccggcctgctgcttggcgacctccaccgcttggcggatctccttgaccccggccagcaccgccgagaccgtttcaaagtgcgcatccgagactttcgccagcagtcgcgccagggtggtcttgcccacgcccggcgggccccagaaaatcatcgagtgcagcgcgccctgctccagggcttcgcgcaaaggcttgccgcgagcgagcaggtgctcctgaccgacgtactcatccaggttggtcgagcgtaggcgcgcggccaggggctgggcaatcgggtcacttcgaaacagatccatgggcagcgcttgaaacctctgggcagtttattcctggatcacgtcggcacccttggggatgtcgaacttgaacttggaggcaggcaccggctggttggccttgaccccggaaaacaggatatcggtgcgctggccaacgctgtcgaccaggcgcatgttattgatcacgccgttgccgaacgacagggacagggtatcaaacagcgtgtccttggattttggcttgagggtgaactcgatcacgttgctggtctgcttggaagtgatgtcgaaactgtcgttgattttcgacacgtcacccgagagcagcagcgccggggtttggttcaggcgcgggtcgagcttcttgatggtcgcctgttccaggtccgggtcccagagggtgactttctggccatcagaaacgatggtctgctcggccttgccttcggtatgccagtagaacaaaccaggacgctgcaccgccatttcaccggcagtttcctgcagttgggtgccaccggcatccagggtcaactgcgagaaacgcgcggtcaaggtctgggatttgtccaacaggttcttcaggctggcgacggaagccgggtcagcatgggccgagacagcggtcagggccagggccggcaacaacagcatgcggataaagcgcatgggagtcctcattgaatggtcagggcgtggcgcgtgttgccacgcgccacggggtcagtcgcgcatctgcccgggggcgatgatttcacgcgagccgttggtgttcatggctgtcacgacgccggcgtgttccatggcttcgatcatgcgggcggcgcggttgtagccgatcttcaacttgcgttgtacagcagagatcgaggcacgacggctttccagcacgaaggccaccgcttcgtcgtacagcgcgtcggtttcggcatcatcgtcgccaccgccgctgccaccgtcgaagccgctgccggcttcttcgacgccagcgaggatgtcatcgttgtattccggcgcgccgcgcagtttccaggcttcgaccacgcgatggacttcgtcatcggacacgaaggccccgtgcacgcggatcggcaggctggtgccgggcggcatgtagagcatgtcaccgtggcccagcagttgctcggcgccaccctggtcgatgatggtgcgcgagtcgatcttgctggacacctggaacgccatgcgcgtcgggatgttggccttgatcaggccggtaatcacatccaccgacgggcgctgagttgcaaggatcaagtggataccggcggcacgggccttctgggcgatacgggcaatcagctcttcaaccttcttgccgacgatcatcatcatgtcggcgaactcatcgaccaccaccacgatggtcggcagcttggtcagcagcggggcttcatcatggatgctctcgcgcttgtacagcgggtcggtcagcggcgtaccggcatcctgcgcttccttgaccttggcgttgaagcccgacaggttgcgtacgcccatcttcgccatcagcttgtagcggcgctccatctcggccacgctccagcgcagggcgttggcggcgtccttcatgtcggtgaccaccgggcacagcaggtgcggaatgccttcgtagatcgacagttccaacattttcgggtcgatcatgatcagcttggcgtcatccggcccggacttgaacaggatcgacaggatcatcgcgttcacacccaccgacttaccggaaccggtggtaccagccaccagcaggtggggcattttcgccaggtccgtgatcaccggcttgccgccgatgtcatggccgagggccagggtgaccggtgatttgaagttgtcatattccggggtcgacagtacttcggagaaacgcacgatctggcggtcttcgttgggaatctcgatacccacggtggtcttgcccgggatcacttccaccacccgcacgctggttacggccagggagcgcgccaggtctttggccaggttggaaatacggctgacctttacacccgcggccggctggatttcgtaacgggtaatcaccgggcctgggtgaatcgagtccaccgaaacttcgacaccgaactccttgagcttgatttccagcaagtggccgacggccgccagggattccggggaataattgagctgtttcttttctgccgggtcgagaatcgagatcggcggcaaggtgccttccacggcgctgtcgatgaacaacggagcctgtttctctttctgcacacgatggctgggttccggcgccttgggcggtgccggcgcgatcaccggcggcacctgcttctcgcggtccgacatgtgcttgctcagggcttgctcacgctcgatcaagcgctccttgaccttggcctgctcgcgccggtccggggtgcttggggccaccacctcgttgacacgagtgtccacctcgcgaagctgcgcaaccatctgcttgcgctccacacgggcagcccaccagcggttggcggcgccttggaacaattcgaacagatcaagggtgatcttgccggtcacgtccatcaccttgaaccatgacaggtcggtaaagaccgtgaggccgaacaggaacagcgcgataaacatcagcgtgctgccctggatattcagggtcctgcgggccagatcgccaaggctttcgcccagggccccgcccgcgcccgccggcagcccggtcggtgcatggaaatgaatatgcgccagcgccgcgccggagagcaccaggaacaccaggccgatcaggcgccaggagaacagccagccgctccactgccatggctcatggcgctggcggaagatctgccaggtcttaatcgccagcagcagcgggaaaatgtaggcgaagtaacccaggatcatgaacaggatatcggcactgtaggaacctacggggccaccgaaattctgcacatcatcgatcttgctgttgtggctccagccagggtcgtccttgccgtaggtgagcaaggccatcatcaggaacaggcacagagcaccgatggcaatcagtgcgccttccttgagtcgataatgcaggtgctggcgccaggccggtacgactgctgctttaggtgctgcggcggatttcttcaaaacgggtcttttcctgcgcctttagcgcgtccatctgttgaatgactacacatgactgctctatcccgagcagctgaaaaatgaacgaatgttgctgaatctacttttaacaccgggtgatggataggtgaaatggcgataacgccacaatggccgcattgtacgggtttgcgtgcgcgatgccacacacttgcccttcacccggccgactggacaattgccttgtcacagccggttcaatttgagcatgcattgtctttgctgacaaaggcttatgagctgtatttagcaatccaggcaagcttggcagatggccggcatgcctcagccccgattacgaccacgcttgatgcacggagttgcagaaacacccgctcatgctaatcctggccgataacctattcgggctggccccctggcgccgggtcgacaataatcaacgcttgcggggcaggcgttgcctgccactcccctcccctgccataagcctggatgccatgctgacctggttacaacgcgacaccctgactttcccacccttggccaaggccatgcgcgaacccaatggcctgctcgccgccggtggtgacctgtcggccgagcgactgatccaagcctatcgtcatggctgctttccgtggttctccgaaggccagccgatcctctggtggtcacccgacccgcgtacggtgatctttcccgatgagctgcatgtttcacgcagtctcgccaagctattgcgccagcaacgctatacagtgacgttcgaccaagacttcgcagcggtcatccaagcctgcgcagcgccccgtgcctatgcggatggcacctggatcaccgaaggcatccagagcgcctatctggcgctgcaccagcgtggctacgcccattccgtcgaggtgtgggaccagggcgaactggtgggtggcctgtatggcctggcgatgggccaactgttctttggcgagtccatgttcagccgcgccgacaatgcctcaaaatttggtttcgccacactcacccgccaattgcaggcctggggctttgtgctcatcgactgccagatgcccaacgatcacctgcatagcctgggtgcccgcgccataccgcgcagcgacttcgcagacttcctgcgtaaacacttggaccagcccagctctggaccatgggtttcctaggcgactttcgcccacctggcttacacttatttcaaagctttaacccgagggttgatcatgaccgagctggcgcgcttgaagttttatgccactcaagcccactcttgcagctacctgcccgacgagcaggccaccacgctgttcctcgaccccagccagccgatggacgtgcatgtgtacgccgacctgtccgagatggggtttcggcgcagcggtgatcatctgtaccgacctcattgccaaaattgcaatgcctgcgtgccggcgcgcatccctgtcacgcagtttctgccggatcgaaatcagaaacgcatcctcaagcgcaacgccgacctgacggtaacggccaccaagccgcagtacagtgaagaatatttcgatctttaccagcgctacatcgaacaacgccacgccgatggcgatatgttcccgcccagccgcgatcaattttctaccttcctggtacgcgacctgccgttctcgcgcttctacgagttccgcctcgacggccgcctgctggccgtagccgtcaccgacctgctgcccaacggcctgtcggcggtgtacaccttctatgaaccggccgaagaacgccgcagcctcggacgctttgccatcctctggcaaataggcgaggcactgcgccaggaattggacgcggtatacctcggatactggatcaagaactgcaaaaagatgaactacaagacccaatatcggcccattgagctgctgattaatcaaagatgggtcacgcttaactagaaccccttggcttaaacaccctttttcgggcacaatgcacgccgcttttgcctggcgcagttgcaccgggccattcactggataccgagggctttactgcatgtcgaaagaagacagcttcgaaatggaaggcactgtcgtcgacaccctgcccaacaccatgtttcgtgtggagttggaaaatgggcacgtcgtaaccgcgcatatctccggcaagatgcgcaagaactacattcgtattcttaccggtgacaaagtgcgcgtcgagctgacgccctatgacttgagcaaagggcgcatcacttaccgcgctcgttaagcaagtcaatacaagacgcccggttatgccgggcgtttttgtgtgtgcggggtttaccaagcaatggagggccctgtgggagggggcttgccccactcccacagtggatctccactgttctgagaattgcatttcaagtcagcaaaaaggcgcctttcggcgcctttttttgttgctgcagaacgatcaggccatttccgccgtggtctcgaactcgaaggtcagctcgccatccttcaggtcgatatgcaccacgccgccatggtcggagagctcgccgaacaggatctcttcggccaatggccgcttgatcttgtcctggatcaggcgcgccatcgggcgagcgcccatcgccgcgtcgtagccgccctctgcgatccagctgcgcgccgcctccgtcacatccagctgcacgcgcttgtcttccagctgcgcttgaagctcggtgaggaacttgtccaccacgcttttgatgacctcatggctgaggcgaccaaattggataatggtgtccaggcggttacggaactccggcgtgaagctcttcttgatcacttccatggcatcggaggagtgatcctgatgcgtaaagccaatagaggcccgcgcagcggtttcagcaccggcgttggtggtcatgatcacgatcacgttgcggaagtccgccttgcgcccgttgttgtcagtcagggtcccgtggtccatgacctgcagcagcaggttgaagacttccgggtgagccttctcgatttcatcgagcaacagtacgcaatgtggctgcttggtgatcgcctcggtcaacagaccgccctggtcgaagccgacatagcctggaggcgcaccgatcaggcgcgaaacggtgtggcgctccatatactcggacatgtcgaaacgcaccagctcgattcccatggccttggccaattgccgcgccgcttcggtcttgccgaccccggtagggcctgcgaacaggaacgacccgaccggcttgtccggcgacttgaggcccgcacgggacagcttgatcgcggtggacagcgaatcgattgccgcatcctgaccaaacacggtgagcttgaggtcgcgctccaggttacgcagcagctccttgtcggaactggtgacgtgttttggcggaatccgcgcgatcttcgccacgatatcctcgacctgaggcacgtcaatgcgcttcacacgcttctcgaccggttgcaggcgctgataggcccccgcctcgtcgatcacgtcgatggccttgtctggcatgtgccggtcattgatgtagcgcgacgccagctcagccgcggcacgcagggcctcatcggtgtattcgatgccatggtgcgcctcgaagcgccccttgagcccgcgcaggatgccgatggtgtcttcaaccgaaggctcggacacgtcgactttctggaagcggcgcgccagggcacggtctttctcgaagatgccacggaattcctggaacgtggtcgaaccgatgcagcggatatcgcccgacgacagcaacggcttgagcaggttggaggcgtccatcaccccaccggatgccgcaccggccccgataatggtatggatctcgtcgataaacagaatcgcctgcgggcgttttttcagctcgccgagcagcgccttgaagcgcttctcgaaatcgccccggtacttggtcccggcgagcaaggcgcccaggtcaagggagtagacgacgctgttggccaacaggtctgggacctgattgtcgacaatgcgcttggccaggccttcggcgatcgcggttttacccacgcccgcctccccaaccagcaacggattgttcttgcgccgacgagcaaggatctgcgccacacgctcaacctcaagttcacgccccaccagcggatcgatccgcccctggcgcgccaattcgttgagattgctggcataggcatccagtggattgcccgaagaagaagactcaccgccctcgtcatcctgcatttcctgctcaccctcggaatgatcgccgtgcccaggcactttggagataccgtgggcgatgtaattgactacatcaatacgggcaacgctctgctgcttgagcaggaacacggcctggctttcctgttcgctgaaaatcgccacaagcacgttcgcgcccgtgacctcacgcttaccggagctctgtacgtggaaaacagcacgctgcaatacccgctggaagcccagggttggctgggtttcacggtcctcgtcatgcacggggatcagtggcgtggtggagtcgatgaactcctgcagatcatgcttgagcttgtcgaggttggcgccgcacgcacgcagaacggtggcggcagcttcgttatccaaaagtgccagcagcaggtgttcgacggtcatgaattcatgacgcttcgaacgagcctccttgaaggcaagattaagggtgacttcgagctcgcggtttaacatagcttcacctcatacccaagtggtcggcgttaaccgtccttctcgatttcacagagtagcggatgctggctttccctggcgtactggttgacctgcatggcctttgtctcggcgatgtcgcgggtaaacactccacatactgcccgtccttctgtgtgaacggccagcattaccttggtcgccaactcgcggttcaggttaaaaaacacctcgagcacttcgacgacgaaatccatcggtgtgtagtcatcattgaacaaaaccaccttgtacatcggcggcgcctgtagagcaggcttggcctcctggacagcaatgcctgcagaaccgtcgtcatcatgttcctgatccgggcgatcctgattgaatgttagtcgaatctggctgtttgcatgcatggaaagaaaggttcgtcagtggttcgattacagtggtgggggcgacctgtcagaatttcaactctgaccggctggtcgccttgactatcggcgaatcggtgttacaaccaatagagcccacagtgggtaaaaaaggtccgcgcagtcaaccttatttattcgggttaggacggatagacaggatgatactccagtgatggagtctggtgcagagggatatgggaatggctaggggtaaggtcaagtggttcaacaatgccaagggttacggcttcattgtcgaggacggcaaggatgaagacctttttgcgcatttctccgtgatcgatatggatgggtacaaaacgctgaaggcgggtcaaccggtgtcctttgatctcaaacagggcccaaagggcttgaatgcggtgaatatcaagttagtcaccccaccgtctgccgcagaaaaagttacagcgcccgatcaaaattcaaaaaaagaaacaggcctgatcagccactgaacaaagcactgaaagcaaaccggccgcccgattcatcagggcggccggttttctctgcctgtttacatatgcttgatcagcgcatcaccgaagcccgacgacgacaccagcgtagcgccatccatcaggcgctcgaagtcataggtcacggtcttggccgaaatagcgccgttggtgcccttgataatcaagtcagccgcttcgacccaccccatatggcgcagcatcatttctgccgacaggatcaatgagcccgggttgacctggtccttgcccgcatatttaggcgcggtaccgtgggtcgcttcgaacatcgccacggtgtcggacaagttggcccccggcgcgatgccgataccgcccacttccgccgccaaagcgtcagacaaatagtcgccgttcaggttaagcgtcgcgataacgtcatattcagccgggcgcaacagtatctgctgaagcatggcgtcggcgatggcatccttgacgactacgttcttgccggtcttggggttcttgaactgcatccacgggccgccgtccagcagggtcgcaccgaactcttcggccgccacttcgtaggcccattccttgaaggcaccttcggtgaacttcatgatgttgcctttgtgcacgatggtcagcgaatcgcggtcgttatccacgacatattgcagggccttgcgcgccaggcgcttggtgccttctttcgacaccggcttgacgccgattccgcagtcctggtcgaaacggatcttggtaacgcccatttcctccttgagaaacttgattaccttgatcgcctcaggcgaaccagctttccactcgatgccggcgtaaatatcttcggagttctcgcgaaagatggtcatgtccacgtcgccaggtttcttgaccgggctgggcacgccttcgaaccagcgcaccgggcgcaggcacacatacaggtcgagctgctggcgcagcgccacgttcagcgagcggataccaccaccgaccggtgtggtcagcggccccttgatggacaccacgtaatccttgaccgcatccagggtttcctggggcagccaggtatcctggtcgtagacctgtgtagccttttcgccggcgtaaacctccatccacgagatcttgcgcttgccgccgtaagccttttcaacagctgcgtcgaccaccttgatcatcaccgggctgatgtcgacaccgataccgtcaccttcgatgtagggaatgatcggttggtcaggaacattgagagaatggtctgcattgacggtgattttgtcgccgactgccggaacctgaatcttcttgtatcccatgctgaactccatctatggattgaacatctggctgcgttcgagcctactccagataaatggcgactgaaacctcgcgccatgctcatttgcatcgaaaacagcataaattgtcgcctacaagcctgaaatcaaagggaaaagtgccaatcctgagcacaacgtgcgactttaggcgtaaaccggcacctgcgacctttagaccaatggacgacccgccttttgtatgaaggctcggcgtaagcatagcgacctatgtataatgccgccgctgaccaaagagtcacgacagcggaccgctctagaacatggccctccgctgcaaagcaggactaatacaatagtccacccgcttgacgctcgactgatgcaacccaacatcaccgcgaagaaacctcgacctttcgctcatggatgacttgaacgaacgcgctccacccggcgcatctcgagtttctgcgcacgctttcagcaaagaagagagttaatccgaatatgcccacccgctcgaagatcatctacaccttcaccgacgaagccccagccctcgccacctattcactgctgcctatcgtagaggccttcaccgcttccgctgatattgccgtggaaacccgcgacatttccctcgcagggcgcatcctcgcaagcttccccgagcaactgggcgacaaggctatcccggaccacctcgccgaactgggcgacctggccgttacacctgaagccaacatcatcaagctgccaaacatcagcgcctcgaccccgcagctgcaagccgcaatcaaggaactgcaggcccagggctatgccctgccggactaccctgaaaccgtaaccaccgacgcggaaaaagaaacccgtgcacgttacgacaaggtcaagggcagcgccgtgaacccggtcctgcgcgaaggcaactccgaccgccgtgcaccgctgtcggtcaagaactacgcacgcaagcacccgcacaagatgggcgcctgggctgccgactccaagtcgcatattgcccacatgagcaatggcgacttctacggcagcgaaaaagccgtacagatcgaagccgctgatgctgtcaaaattgcgctgatcgcccaggacggcaccaccaccgtgctgaaggaaaagaccagcgtccaggccggcgaaatcatcgataccgccgtgctgagcaagaaagccctgcgcagcttcatcgccgctgaaatcgaagacgccaagcaacaaggcgttctgctgtcggttcacttgaaagccaccatgatgaaggtctccgacccgatcatgttcggccagatcgttgccgagttctacaaagacgccctgagcaagcacgctgcggtgctggagcagatcggcttcaacctgaacaacggcatcggcgacctgtacgcccgcatcaaggcgctgccggctgaccagcaagcgcagatcgaagctgacatccaggcggtgtacgccgctcgccctgccttggcgatggtcaactccgacaaaggcatcaccaacctgcacgtgccaagcgacgtcatcgtcgacgcctcgatgcctgccatgatccgtgactccggcaaaatgtggggcaccgacggccaactgcacgacaccaaggctgtaatcccggatcgctgctacgccaccatctaccaggcggtcatcgaagactgcaaggccaatggtgccttcgacccgaccaccatgggcagcgtgccaaacgtaggcctgatggccaagaaagccgaagagtacggctcccacgacaagaccttccagatcaaggctgacggcgttgttcgcgtcaccgacagccagggcaacctgctgatggaacagaaagtcgaggccggcgacatcttccgcatgtgccagaccaaagacgcgccgatccaggactgggtcaagctcgccgtaaaccgtgcccgcgccagcagcaccccggccatcttctggctggaccctcagcgtgcccacgatggcgtcgtagtcgagaaagtccaggcgtacctgaaagaccacaacaccgaaggcctggacatccgcatcatggccccggtggacgcgatgaagttcactctggagcgcacccgcaagggcctggacaccatctcggtgaccggcaacgtactgcgcgactacctgaccgacctgttcccgatcatggagctgggcaccagcgccaagatgctgtcgatcgtgccgctgatgaacggcggcggcctgttcgaaaccggcgctggcggttcggcaccgaaacacgtgcagcaactgctggaagaaaacttcctgcgctgggattccctgggcgagttcctggccctggccgcgtcccttgagcacctgggtgtcacgtacaacaacccgaaagccctggtactgtccaagaccctggaccaggccaccggccagttcctcgacaacaacaagtcgccatcgcgcaaagtcggcaacatcgacaaccgcggcagccacttctacctggcgctgtactgggcccaggccctggcggcacagtccgaagacactgcactgcaagcgcagttcggcgaattggcccagaccctggccgcgaacgaagcaaccatcgttgccgagctcaacgcagtacagggcaagccagtggacatcggcggctactacgcgccgaacccggagttgaccagcaaggccatgcgtccaagcaacaccttgaatgcggcgattgccaagttgaagtaaggttgtaaagctgcaaagaagccccggccaagtgccggggtttctgtttctaccgttcaactgtagaaaccggataaaaatgtgggagggagcttgctcccgatggcagtgggtcagccccagatgtatttactgaccctccctcatcgggagcaagccccctcccacactgactgtaatcctgctgtaagacgcactgcgtcctgaatcgaggcaaccatgacctggctcccccacatcaccgtcgccaccatcgttgaagacaacggccgcttcctgatggtcgaagaactcaagggcggccgcgccgtgctcaatcagcccgccggccacctggacccgaacgaaaccctcaccgaagccgccgtgcgcgagaccctcgaggaaaccggctgggatgtcgaagccaccggcatcgtcggcatctacctctacactgcccccagcaacggcgtgacctatcaacgggtttgcttcatcgccaaggccctgaaacaccacccggactatcaactcgacgaaggcatcctgcgcgcccgctggctgacccgtgacgagctgatggccgtgcgcgatgactggcgcagcgagctgatcatccgctgcatcgatgattatctggccggccacaggcacagcctcgaattgatccgcccttctctttagccttgcgggcgtgagcctgttagaatcgcgtcctttttcaagacacccgttgaaaccctatgcgtgatccagccccttctgacacacaaaagaagcgcgtcatcgtcggcatgtccggcggcgtggattcttccgtttccgccgttctgctcatggagcagggttatgaggtggaaggcctgttcatgaagaactgggaagaagacgatggaacggaatattgcaccgccatggacgacctggcggacgcccaggcggtgtgcgacaagatcggcatcaagctgcacaccgccaacttcgccgccgagtactgggacaacgtgttcgagcacttcctggctgaatacaaggccgggcgcacaccgaacccggacatcctgtgtaaccgcgagatcaagttcaaggcgttcctcgactacgccatgatgcttggcgccgacctgattgccactggtcactacgtgcgccgtcgcgatatcgatgggcgcaccgaactgctcaagggcctggacccgaacaaggaccagagctacttcctgcacgccgtcggcggcgaacagatcgccaagaccctgttcccggtgggcgagctggaaaagcccgaagtacgcaagattgccgagaaacacggcctggccacagccaagaagaaagactccaccgggatctgctttatcggcgagcgccgcttcagcgacttcctcaagcagtacctgccggcacagccgggtgaaatcaagaccaccgaaggtgaagtgatcggccgccaccacggcctgatgtaccacaccatcggccagcgccagggcctgggcatcgggggcctgaaagacgccggcgaagagccgtggtatgtgctggtcaaggacctggaaaacaatgtgctgatcgtcggccagggcaacgagcacccactgctgttctccggcgccctgctcgcttccgagatctattgggtcaacccgatcgacttgagcacgccgcgtcgcctgaccgccaaggtacgctatcgccagagcgaccagccctgcacactggaaaaaaccgccacgggctaccgcgccaccttcgatgacccgcaacgcgcggtcaccccaggccaatccgtggtgttctatgacggcgaaatctgcctgggcggcggcgtgatagaagttgcgcaagcctggagcagcccggcatgagcccgacccaggagcaattgacggcccttggcggtgtatttcttgccgccgtactggtggacaagatcgccaagaccggccaggtcaccgaagccggcctgacctgcatgctcggcagcctgttgatccgcgaccccaaggacaccctggaggtctacggcggtgacgacctggccctgcgcgaaggttatcgtgcactgatcggcgccttggagcgcgaccccagcaccttgcagcgcgagccattgcgctatgccttgtcgatgctcggccttgagcgccaactggccaagcgtgacgacatgctggaaaccatcggcaagcgcctgccgcagatccagtcccaggtggaacacttcggcccggcccacgaaaacgtgatcgctgcctgtggcgcgctataccaggacaccctgagcaccttgcgccaacgtattcaagtgcacggcgacatgcgcaacctgcaacaacccaacaatgcctcgaaaatccgtgcgctgctcctggccggtattcgctcggcgcggttgtggcggcagttgggcggtcatcgttggcagctggtgatcagccgacgcaaattgctcaaggagctttacccgttgatgcgcaacgaataagtcgcagcgacaggcccttttcaagccgttacgcgtaatacgccggtcagttggcaacggaccggcggattttttcatgtatgatacgcgccccatttcgttgcccgactgtccgagaacaccccatgcagctctcttcgctcactgcggtttcccctgttgacggccgctacgccggcaaaacccaggccctgcgccctattttcagcgaatacggcctgatccgtgcccgcgttctggttgaagtgcgctggctccagcgcctggccgctcaccccgccatcagcgaagtgccggcgttctctgccgaagccaacgctgtgctcaacaccctggcggaaaacttctctctggagcacgccgagcgtgtgaaagagatcgagcgcaccaccaaccacgacgtcaaggccatcgaatacctgctcaaggagcaagcggccaaactgccggaactggcccaggtcagcgagttcatccactttgcctgcaccagcgaagacatcaataacctgtcccacgccctgatgctgcgcgaaggccgcgatgacgtcatgctgcccctgatgcgccagactgccgaagccatccgtgagctggcgatccgtttcgccgccgtgccgatgctgtcgcgcacccatggccagccagcgtcgccgaccaccctgggcaaggaactggctaacgtggtgtaccgcctggagcgccagatcgcccaggtcgccgccgtgccattgctgggcaagatcaacggcgccgtgggcaactacaacgctcacctatcggcctaccctgagatcgactgggaagccaacgcccgcgccttcatcgaagacgagctgggcctgggcttcaacccgtacaccacgcagatcgaaccccacgactacatcgccgagctgttcgacgccattgcgcgctttaacaccatcctgatcgacttcgatcgcgatatctggggctacatttccctgggctatttcaagcagcgcaccattgccggtgaaatcggatcgtcgaccatgccgcacaaggtcaacccgatcgacttcgaaaactccgaaggcaacctcggcatcgccaacgccctgttccagcacctggccagcaagttgccgatctcccgctggcagcgcgacctgaccgactccaccgtattgcgcaacctcggcgtgggcttcgctcatagcgtgatcgcctacgaagccagcctcaagggcatcagcaagcttgaactcaacgagcagaagatcgccgctgacctggacgcctgctgggaagttttggccgagccgatccagaccgtgatgcgccgctacaacatcgaaaacccctacgagaaactcaaagagttgacacgcggcaagggcatcagccccgaagcgctgcaaactttcattgacggcctggacatgccagccgcggccaaggctgagctgaaactgctcaccccggccaattacatcggcaacgctgtagagcaagccaagcgcatctgattcaagcaagcccccttgagacgcccggccgcgccgggcgtttttattccagtctgaaaagtgctttttttcaataggttacacatgaatcctgatattcctcttcaacttctgggcggcatcacggcacgggaattcctgcgcgactactggcagaagaaacccctgctgatccgtcaggccatccctgacttcgaaagcccgatcgacgccgacgaactggcaggcctggctctggaagaagaagtcgaatcgcgcctggtgatcgaacacggcgagcgcccgtgggaactgcgtcgcggcccattcgccgaagatgccttcagcgccctgccagagcgtgagtggaccctgctggtgcaggcggtcgaccagttcgtgccggaagtcgccgaactgctggagcacttccgtttcctgccaagctggcgcatcgacgatgtgatgatcagcttcgccgcgcccggcggcagcgtcggcccgcacttcgacaactatgacgtgttcctgctgcaagcccaaggcaagcgcaactggaagatcggccagatgtgcagctccgaaagcccgctgctgcaacacgccgacctgcgcatcctcgccgaattcgaagaaagcgccgaatgggtgctggaaccaggcgacatgctctacctgccaccgcgcctggcgcacttcggcatcgccgaagacgattgtatgacctactcggtgggtttccgtgccccgagcgccgccgaagtgctgacccacttcaccgacttcctcagccagtacctgaccgacgaagagcgctacaccgacgccgatgcccaaccggtcagcgacccgcaccagatccagggcgacgccctcgatcgactcaagagccttttggccgagcacatgagcgacgagcgcatgctgctgacctggttcggccagttcatgaccgaaccgcgctaccccgaactggtagccggcgaagagctgggcgaagaagacttcatcagcagcctgcaagacggcgcgatcctggtgcgcaacccaagcgcgcgcctggcctggtccgaagtggacgacgacgtgctgctgttcgccagcggccagagccgttacctgccgggcaaactgcgtgaactgttgaagctggtgtgctcggccgacgcactgcacagcgaaaacctcagcgtatggctggccgacgaagacggccgcgacctgctgtgcgaactggtcaagcaaggcagcctggggttcgcggatgaataagattcacgtaagtgtcgcggactggcgaaaggatatcgacgagattcggcgcattcgtgaagcggtatttatcgccgaacaatcggttccagccgagctcgagtgggatgcggacgacgctggcgccatgcatttcctcgcattcgaaggcgactttccgattggtaccgcacgcctgctgcccagcggcgagattggtcgcgtgtcggtgctcaaggactggcgcgggctgaaggtaggcgacaagctgatggaagcggtgattgggatggctgaacagcgcggccagacccggcagttcctcagtgcgcaggtgtatgcggcgccgttttatgaacgactgggtttcaagatcgtcagtgatgagtttcttgaagtcgggattccgcatgtggatatggtgcgcgagggctgactcacgaccgcgtcgcctatatcgggagcaagccctatcagcaacaccacaaaatgccctgcttgccagggcattttgccgtctacgattcaacttgcgccccgccaggccgacaaactggcactatcaagcaaaatgactcgcagagataacggacatgtcgctacgcaccttgctcaccgccctactcctgaccgccagtgtttcggccatggctgccaccgaggtcgtcaacctgagcaaccgcaccagcgccgacctgctgcccgtggcgcagaacttcatcggcaaggacggcaccgtcagcgcctacggcaaccagcttatcgttaacgccgaccctgcgaagatagagggcttgcgtaccctgctctcccaactggacacgccggccaagcgcctgctgatcaccgtcgacaccaacgaaaccaaccagcagaacagcggcgacagccagacccgcatcatcagctatggcaccgtcagccgcgatggcggcatccagcagatccaggccagcgaaggcgtgcctgcgctgattcaggtcggccagagcgtaccgctgaccaccacgcaccaggatggctatggccgcctgcagaaccagacccagtatcgcaacgtcacccagggcttttacgtcaccgccagcgtcaccggcgagaccgtacacctggctatcagtaccaaccgtgaccgcatgagccaggaacgtcccgatgtagtgaatgtgcagagtaccgacacaaccgtcagcgggcgcctgggcgaatggatcaccctagcagggataaatcgcgagacccaggccgataaatcctctacaacccgcagctactctactcaaggccgcgatgacctgactttgcgggtcaaggtcgataccctgaactgaagcaccgaaaactgactgacgagtcgtataagactaaagatgtagtgcctgaaaaaaagcactacaaaacatttgacgatccaaaaaagcatgggcatgatggcctcgctcccgctaatcaggggccctggtaagggccttcggatcgccgctccaagctacccacccgagccgattcgtgtctgtaccgcccataaggcgtgtttgacgaggttgcgactggaacgaagttgtcccgagggacggaagctaaccaggtaacccggctacgcactgatggatcgtacaaaggcccacgacgcccgaagaccgttcgcagttcgcctttacctgctcaactccgccttgagccactcgttcatcccgtcgccttccccgccaagcccggcttgaccacctgagcttctggtcagcgagcagccatcaccacgcattcaatccgtggctggcaaatggaattttccacctagacctatgcgacgaggtttttccccatggcactgacacgcgaacagcaaattgcagcccttgaaaaagactgggctgaaaacccacgctggaaaggcgtgacccgcgcttattccgctgctgacgtcgtccgcctgcgtggctcggtccaacctgagcacacctttgcaaaactcggcgccgagaagctgtggaacctggtcacccaaggtgccaagccgtccttccgtcccgacaaagatttcgtcaactgcatgggcgccctcactggcggccaggcagtacaacaggtaaaagccggtatccaggcgatctacctgtccggctggcaagtggcagcggacaacaactccgctgaatccatgtaccccgaccaatcgctgtacccggtggactccgtaccaaccgtggtcaagcgcatcaacaactcgttccgtcgtgccgaccagatccagtggaaagccggcaagaacccaggcgatgaaggctacatcgactactttgcccccatcgtggctgacgccgaagccggcttcggcggcgtactgaacgcttacgaactgatgaagagcatgatcgaggctggcgctgccggcgtgcacttcgaagaccagcttgcgtcagtgaagaaatgcggccacatgggcggcaaggtactggtaccgacccaggaagccgtacagaagctgaccgctgcgcgtttggccgctgacgttgccggtacaccgaccatcatcctggcccgtaccgatgccaacgccgctgacctgctgacttcggactgcgacccgtacgaccagccgttcgtgactggcgagcgtactcaggaaggcttctataaagtccgcgccggcctcgaccaggccattgcccgcggcctggcctacgcgccgtacgccgacctgatctggtgcgagaccgccaagccggacctggacgaagctcgtcgcttcgccgaagcgatcaagaaggaatacccggaccaactgctgtcctacaactgctcgccttctttcaactggaagaagaacctggacgacgcgaccatcgccaagttccagcgtgaactgtcggcgatgggctacaagcaccagttcattaccctggccggcattcacaacatgtggcacagcatgttcaacctggcgcacgactacgcccgtaacgacatgactgcctacgtgaagctgcaagagcaggagttcgcggacgccgccaaaggctacaccttcgtggcgcaccagcaggaagtgggcaccggttacttcgacgacatgaccaccgtgatccagggcggcacttcgtcggttaccgggctgaccggttcgaccgaagaagatcagttccactgatcaactgagtacccggccaccgcggccccacggaagacctaaccgcagtgccgcacaacaatcacgccccgactggttcggggcgtttttttgcctgcacaaaacctaccgatgcactgcggaccaaatgtgggagggggcttgctcccgatagcggtggatcagcaacagctgggttggctgatactcagctatcgggagcaagccccctcccacaagtaattttgcgcaaaacattgatccagagcggtactcgcgcacatcaaatcggttaaaagaaccgtcgcggcaactaagcggcactcaaccaagtaacggcaacttcccccgccacatgagaaacaatcgcttaaaccccacgcaaacaatattcattatcatttagcgcttaaaaaattcgttacagcttaaacaaaacataattgatgaaaagctcgctaatgcccacaccacaagggctacagccccaagaaggtgcactatgtgcttattccaccgaataatttcaccccaggaattttacttgcccggtgtttagccataaaatcaccgcgattgattgcagtgcgacatatcgtcactgcatcgttactttttcgagctcagagacctttgctctctgttaaggatttccagcatgaccgaagcgacaggactcatggcccacaactggggctttgccattttcctcctcggtgttgtcggcctttgcgccttcatgctcggcgtctccagcctccttgggtcaaaagcctggggccgcagcaaaaacgaaccgttcgagtccggcatgctacctacaggtggcgcccgcttgcggctctcagccaaattctatctggtcgcgatgctgttcgtgatcttcgatatcgaagccctctttctctttgcctggtctgtgtccgtccgcgaaagcggctggaccggattcgtcgaagctctcgttttcatagcaattctgttggcaggtcttgtctacctgttccgagtgggcgcccttgactgggctccggaagctcgtcgcaagcggcaggcgaagctgaaacaatgaggctttggcaatgcaatacaatctcaccaggatcgacccggatgctcctaacgagcagtaccccatcggcgaacgggaaaccgtttccgacccgttagaagaccaagtccacaagaacatctacatgggcaagctggaagacgtgctgagtggcgcggtcaactgggggcgtaaaaactccctgtggccgtacaacttcggcctttcgtgctgctacgtggaaatgaccaccgccttcacggcgccccacgacatcgcgcgttttggcgccgaagtgatccgggcatcaccgcgccaggcggatttcatggttatcgccggtacctgctttatcaagatggcgccgatcatccagcgtctctatgagcaaatgctcgagccgaaatgggtaatctccatgggttcgtgcgccaactccggtggcatgtacgacatctactccgtcgttcaaggggtggacaagttcctacccgtggacgtctacgtgcctggctgcccgccccgccccgaagcattccttcaaggcttgatgctgttgcaggaatcgattggcaaggagcgtcgcccgctgtcctgggtcgtcggcgatcaaggcgtgtaccgcgccgagatgccgtcccaaaaagaacagcgccgcgaacagcgaatcgcagtcactaacctgcgcagccccgacgaagtctgatccagacccgcttcttttatagaacgaaaacctggcttcattctttacgttgaccgaaagcgataaaaaaccatgactacaggcagtgctctgtacatcccgccttataaggcagacgaccaggacgtggttgtcgaactcaataaccgttttggccctgacgccttcaccgcccaggccacacgcaccggcatgccggtgctgtgggtggcacgtgccaggcttgtcgaagtcctgaccttcctgcgcaacctgcccaagccgtacgtcatgctctatgacctgcatggcgtggacgagcgtctgcgcaccaagcgccaggggctgccgagcggcgccgatttcaccgtgttctaccacttgatgtcgctggaacgtaacagtgacgtgatgatcaaggtcgccctgagcgaaaacgatctcagcgttccgaccgtgaccggtatctggcccaacgccagctggtacgagcgcgaagtctgggacatgttcggcatcgacttccccggccacccacacctgacgcgcatcatgatgccgccgacctgggaaggtcacccgctgcgcaaggactaccctgcccgcgcaaccgaattcgacccgttcagcctgaccctggccaagcagcagcttgaagaagaggctgcgcgcttccgtccggaagactggggcatgaagcgttccggcaccaacgaggactacatgttcctcaacctgggcccgaaccacccttcggcccacggtgcgttccgtatcatcctgcaactggacggcgaagaaatcgtcgactgcgtgccggacatcggctaccaccaccgtggcgccgagaagatggccgagcgtcagtcctggcacagcttcatcccctacaccgaccgtatcgactacctcggcggcgtgatgaacaacctgccgtacgtgctctcggtggagaagctggccggtatcaaggtgccggaccgcgtcgataccatccgcatcatgatggccgagttcttccgcattaccagccacctgctgttcctgggtacctatatccaggacgtcggcgccatgaccccggtgttcttcaccttcaccgaccgtcaacgcgcctacaaggttatcgaagccatcaccggtttccgcctgcacccggcctggtaccgcatcggcggcgtggcccacgacctgcccaacggctgggagcgcctggtcaaggaattcatcgactggatgcccaagcgtctggacgagtaccagaaagccgcgctggacaacagcatcctcaagggccgcaccatcggcgttgcgcagtacaacaccaaggaagccctggaatggggcgtcactggtgccggcctgcgttccaccggttgcgacttcgacctgcgtaaagcccgcccgtactccggctacgagaacttcgagttcgaagtaccgctggcggccaatggtgatgcctacgaccgttgcatcgtgcgtgtcgaagaaatgcgccagagcctgaagatcatcgagcagtgcatgcgcaacatgccggcaggtccgtacaaggcggatcacccgctgaccacgccgccgcccaaagagcgcacgctgcaacacatcgaaaccctgatcacgcacttcctgcaggtttcgtggggcccggtcatgccggccaacgaatccttccagatgatcgaagcgaccaagggtatcaacagttattacctgacgagcgatggcggcaccatgagctaccgcacccggattcgtaccccaagttttgcccacttgcagcagatcccttcggtgatcaaaggcgagatggtcgcggacttgattgcgtacctgggtagtatcgatttcgttatggccgacgtggaccgctaagcatgaacagcacgcttatccagacagaccgtttcaccttgagtgaaaccgagcgctcggccatcgagcacgagctgcatcactatgaagacccgcgcgcggcgtcgatcgaagccttgaagatcgtccagaaggaacgtggctgggtgcccgacggcgctctctacgccattggcgagatcctcggcatcccggccagcgatgttgaaggggtggcgacgttctacagccagatcttccgtcagccagtcggccgtcacatcattcgcgtgtgcgacagcatggtctgctacatcggcggccatgagtccgtggtcagcgaaatccaggccaagctcggcatcggcctcggccagaccaccgccgacggccgcttcacgctgctgccggtgtgctgcctgggcaactgcgacaaggcgccggcgttgatgatcgacgacgacacattcggtgacgtacagcctgctggcgtgacccaattgctcgagggctacccatgaccctgacctctttcggcccggccaacctgatcaagcgttcggccgagacccacccgctgacctggcgcctgcgtgacgatggcgagccggtatggctcgacgaataccaggccaagaacggttacgccgctgcgcgcaaagtcttcgccgacatggcccaggacgatatcgtccagaccgtcaaagacgccggcctcaagggccgcggcggcgcaggcttccccacgggtgtgaagtggggtctgatgcccaaggacgaatccatcaatatccgctacctgctgtgcaacgcggatgagatggagcccaacacctggaaagaccgcatgctgatggagcaactgccccatctgctgatcgaaggcatgctgatcagcgcccgtgcgctcaagacctaccgtggctacatcttcctgcgtggcgagtacaccaccgccgccaagcacctcaaccgtgcagtggcagaagccaaggctgcgggcctgctgggcaagaacatcctcggttccggcttcgacttcgaactgttcgtgcacaccggcgccgggcgttatatctgtggtgaagaaaccgcactgatcaactccctcgaaggtcgccgcgccaatccgcgctccaagccgcccttccctgccgccgtcggcgtgtggggcaagccgacctgcgtgaacaacgtcgagaccctgtgcaacgtgccggcgatcatcgccgacggcgtggactggtacaaatccctggcccgtgaaggcagtgaagacatgggcaccaagctcatgggtttctccggcaaggtcaagaaccctggcctgtgggagctgccgttcggcgtgaccgcccgcgagctgtttgaggactacgccggcggcatgcgcgacggctacaccttgaaagcctggcagccaggcggtgccggtaccggtttcctgttgcccgaacacctggacgcccagatgtatgccggcggcatcggcaaggtcggcacccgcatgggcaccggcctggcgatggcggtggacaacacagtgaacatggtgtcgctgctgcgcaacatggagcagttctttgcccgtgaatcgtgcggcttctgcaccccatgccgtgacggcctgccgtggagcgtcaagctgctgatggccctggaaaatggcgaaggtcgcgagggtgatatcgaaaccctgctgggcctggtcggcttcctcggcccaggcaagaccttctgtgctcacgcaccgggcgccgtagagccattgggcagcgcaatcaaatacttccgctcggagttcgaagccggtatcgcgcccaccagcgccgccgtcccgcctctggcgaagccgatcgtagtcggcgcgtaacgcttaaacaggcgaagggtccgtgcccttcgcctgctcatgtgctgacgccgtaaaggctgtgtagatgcacatgaataacaagattccattagccacgcccgctgacaacgggccaacgaagaactttgaaccatggccactatccacgtagacggcaaagcgctcgaagtcgatggggcggacaacctgttacaggcgtgtctgtcactcggccttgatatcccgtatttctgctggcaccccgcgctcggtagcgtcggtgcctgtcgccagtgcgcggtcaagcaatacaccgacgagaacgacacccgtggtcgtatcgtcatgtcctgtatgaccccagccaccgacaacacctggatctccatcgacgatgaagaatccaaggcgttccgcgccagcgttgtcgaatggctgatgaccaaccacccccacgactgcccggtctgtgaggaaggcggtcactgccacctgcaagacatgacggtgatgaccggccacaacgagcgccgttatcgcttcaccaagcgtacccaccagaaccaggacctcggcccgttcatttcccacgagatgaaccgctgcatcgcctgctaccgctgcgtgcgcttctataaagactacgctggcggcaccgaccttggtgtgttcggcgcccacgacaacgtgtacttcggtcgcgttgaagacggcgtgctcgagagcgaattctccggcaacctcaccgaggtctgcccgaccggtgtgttcaccgacaagacccactccgagcgctacaaccgtaagtgggacatgcagttcgcaccgagcatctgccatggctgctccagcgggtgcaacatctccccgggcgagcgctacggtgaattgcgtcgcatcgaaaaccgcttcaacggttcggtcaaccagtacttcctgtgcgaccgtggccgtttcggctatggctacgtcaaccgcgaagaccgcccacgccagccactgctggccgatggcgccaagctgagcctggacgcggcgctggataaagccgccgacctgctgcgcgggcgcaacatcgtcggtatcggttcgccgcgtgccagcctcgaaagcaacttcgccttgcgcgagctggtcggcgccgagcacttctattgcggtatcgaagctggtgagctggagcgtatccgcctggtcctgcaagtgctgaatgacagcccgctgccagtgccgaacatgcgcgacatcgaagaccacgatgccatctttgtgctcggtgaagacctgacccagaccgctgcccgcatcgccctgtcgctgcgccagtcggtcaagggcaaggccgaagagatggccgatgccatgcgcgtgcaaccgtggctcgacgccgcggtgaaaaacatcggccagcacgcgctgaacccgctgtttatcgcctccctggctgaaaccaagctcgacgacatcgccgaagaatgcgtccatgccgcaccggacgacctggcccggatcggtttcgccgtggcccacgccctcgacgccagcgcgcctgccgtcgatggcctggacaccgaagcggtcgaactggcccagcgcatcgccgacgcactgctggcggccaagcgcccattgatcatcgccggcacctccctgggttccaaggcgctgatcgaagcggctgccaacatcgccaaagccctgaagctgcgcgataagaacggctccatcagcctggtggtgccggaagccaacagcctcggcctggccatgctcggtggcgagtccctggacgccgccctgcaagcggtgaccgacggcagcgccgacgccatcgtggtgctggaaaacgacctgtacacccgcaccgctgccgccaaggttgacgctgcactcaacgccgccaaggtgctgatcgtcgccgaccaccagaagaccgctaccagcgagcgtgccgacctggtgctgccagccgccaccttcgccgaaggcgacggtaccctggtcagccaggaaggccgcgcccagcgcttcttccaggtgttcgatccgaagtacatggatgccagcatcctggtgcacgaaggctggcgctggctgcatgccctgcgcgccaccctgctgaaccagccgattgactggacccagctcgaccacgtcaccgcagccaccgctgcgagcgcgccgcagttggcccgcatcgtcgacgctgcaccgtccgccgcgttccgtatcaagggcttgaaactggcccgtgaaccgctgcgctactccgggcgtaccgccatgcgtgctgatatcagcgtgcacgaaccgcgtaccccgcaagacatcgacaccgcgttcgccttctccatggaaggttattcggggtcggccgagccgcgtcagcaggtgccgtttgcctggtcgccgggctggaactcgccgcaggcctggaacaagttccaggacgaagtcggtggtcacatccgtgctggcgacccgggtactcgcctgatcgaaagcaccggtgactcgctgaactggttcgctgcggtaccgcgtccgttcaacccggccccgggcacctggcaggtcgtgccgttcttccacctgttcggcagcgaagagacctcttccaaggccgcgccggtgcaggaacgtatccctgcggcctacgtgtcgctggccaagtccgaagccgaccgcctgggcgtcaacgacggtgccctgctcagccttaacgtggccggccagaccctgcgcctgccgctgcgtatcaacgaggagttgggcgctggcctggttgcactgcctaaaggccttgccggcattccgcccgctatctttggccaaaccgttgacggtctgcaggaggcagcgcaatgacctggttcacgccggaagtaattgacgtgatcatttcggtggtcaaggccatcgtgatcctgttggccgtggtcgtggcgggcgccctgctcagcttcgtcgagcgtcgcctgctgggctggtggcaggaccgctacggtccgaaccgcgttggcccgttcggcatgttccagatcgccgccgacatgctgaaaatgttcttcaaggaagactggaccccgccgttcgccgacaaggtgatcttcaccctggcaccggtggtggccatgagcgccttgctggtcgccttcgcgatcatcccgatcaccccgacctggggcgtggcggacctgaacatcggcctgctgttcttcttcgccatggccggtctgtcggtgtatgcggtgctgttcgccggttgggccagtaacaacaagttcgccctgctgggcagcttgcgtgcctcggcccagaccgtgtcctacgaagtgttcatgggcctggcgctgatgggcatcgtggtgcaggttggctcgttcaacatgcgcgatatcgtcgagtaccaggcacagaacctgtggttcatcattccgcagttctttggcttctgtaccttcttcatcgctggcgtggccgtgactcaccgtcacccgttcgaccagccggaagcggaacaggaactggccgacggttaccacattgaatatgccggtatgaaatggggcatgttcttcgttggcgaatacatcggcatcatcttgatctcggccctgctggtcacgctgttctttggcggctggcacggtccgttcggcatcttgccgcagttggccttcttctggttcttcttgaagaccgcgttcttcatcatgctgttcatcctgctgcgcgcctcgattccgcgcccgcgctatgaccaggtgatggatttcagctggagattctgcctgccgctgaccctgatcaatttgctggtgacggctgccgtcgtgttgttgaacacgccagctgccgcggttcagtgaggatttgacccatgttcaaatatattggcgacatcgttaagggtaccggtacccagttgcgaagcctggtgatggtgttcggtcacggctttcgcaaacgcgacaccctgcaataccccgaagaagcggtgtacctgccgccgcgctatcgcggccgcatcgtactgacccgcgaccccgacggcgaagagcgttgcgtagcctgcaacctgtgcgccgtggcgtgcccggtgggttgcatctccctgcagaaagctgaaaccgaagacggtcgctggtacccggacttcttccgtatcaacttctcgcgctgcattttctgcggcctctgcgaggaagcttgcccgaccaccgcgatccagctcacaccggatttcgagatggccgagttcaaacgtcaggacctggtgtacgagaaagaagatcttttgatctctggtcccggtaaaaaccctgattacaacttctatcgtgttgcaggtatggccgttgccggtaagccgaagggcgccgcacaaaacgaagccgagccgatcaacgtgaagagcttgctgccttaaggaagaaagatggaattcgctttctatttcgcatcgggtattgcagtggtgtccacgcttcgcgtgatcaccaacaccaaccccgtgcacgccctgctctacctgatcatttcgctgatcgccgtggccatgacctttttcagcctcggcgcaccgttcgccggtgtactggaagtgatcgcctacgccggcgccatcatggtgctgttcgtgtttgtggtgatgatgctcaacctcgggccggcttcggtcgcccaggaacgcgtctggctcaagcccggcatctggctcggcccggttgtcctcgcagcgctgctgctgggtgaactgctgtatgtgctgttcgctcaccagagcggccaggccatcggccacaccaccgtagacgcgaaagccgtgggcatcagcctgttcggcccgtacctgctggtggtcgaactggcttcgatgctgctgctcgccgcagccatcaccgccttccacttgggccgcaacgaagccaaggagcaatgacgatgcctgctatccctttggagcatggtctggcggtcgccggcatcctgttctgccttggcctggtcggcctgatggtgcgccgtaacattctgttcgtgttgatgagcctggaaatcatgatgaacgccgcggcactggcgttcatcgttgccggtgcacgttggggccagccggatggacaagtgatgttcatcctggtgatcagcctggcagccgccgaggccagtatcggcctggcgatcctgctgcaactgtatcgtcgcttccacacgcttgatatcgacgctgccagtgagatgcgcggatgaacatgatctttctgactttcgtattccccctgatcggtttcctgctgctgtcgttctctcgcggccgctggtcggaaaacctctcggccctgatcggcgtgggctccattggcctgtcggccatcgtggctgcctacgtcatctggcaattcaacgttgcaccgcccgaaggcggtcactacaccctggtactgtggcagtggatgtcggtggagggcttcaagcccaacttcgccctctacgtcgacggactgtcgatcaccatgctcggcgtggtggtgggtgtaggcttcctgatccacctgttcgcgtcctggtacatgcgcggtgaagccggttactcgcgcttcttctcgtacaccaacctgtttatcgccagcatgctgttcctggtgctgggcgataacctgttgttcctgtacttcggctgggaaggcgtgggcctgtgctcgtacctgctgatcggtttctactacagcaaccgcaacaacggtaacgcggcactcaaggcctttatcgtcacccgcatcggcgacgtgttcatggccatcggcctgttcatcctgttccaacaggtgggcacgctgaacatccaggagctgctggtgctggcaccgcagaaattccaggtcggcgacttctggatcaccctggcgaccctgatgctgctgggcggcgccgtgggtaaatccgcgcaactgccgctgcaaacctggctcgcggatgcgatggccggcccgaccccggtttcggcactgatccacgccgcaaccatggtgaccgccggtgtctacctgatcgcccgtacccacggcctgttcaccctggcgccggatatcctgcatcttgtcggcatcgtcggcggggtgaccctggtactggccggcttcgccgcgctggtgcagaccgacatcaagcgtatcctcgcctactcgaccatgagccagatcggctacatgttcctggccctgggcgttggtgcctgggacgcggcgatcttccacctgatgacccacgcgttcttcaaggccctgctgttccttgcctccggtgcggtgatcgtggcctgccaccacgagcagaacatcttcaagatgggcggcctgtggaagaaactgccactagcctacgccagcttcatcgtcggtggtgcagccctggccgccctgccgctggtgaccgccggtttctactccaaggatgaaatcctctgggaagcctttgccagcggtaaccagaacctgctgtacgcaggcctggtgggtgcattcatgacctcgctgtacaccttccgcctgatcttcatcaccttccacggtgaagccaagaccgaagcgcacgcaggccacggcatctcccactggctgccactgtcggtgctgatcatcctgtcgaccttcatcggcgccatgatcactccaccactggccggtgtattgccagaaagcgtcggccatgccggcggcgcagacaagcacagcctggaaatcgcctcgggcgccatcgccatcgctggtatcctgctggccgccctgctgttcctcggcaagcgtcgcttcgtgaccgccgtggccaacagtggcatcgggcgcttcctgtcggcctggtggttcgctgcctggggcttcgattggatctacgacaaactgttcgtcaagccatacctcgccatcagccacgtactgcgcaaagacccgctcgaccagaccatcggtttgatcccgcgcgccgccaaggctggtcacacagccctgagccgcagcgagactggccaactgcgttggtatgcagcatccatggcggcgggtgccgtgctggtgatcggcgccatcgtcgtggtagcggtctgactatgtttaagtgcactgcgtactttgcgaacttgcgaaaggaaacgagcccgtcatgattctgccctggctaatcctgatcccctttatcggcggcctgctctgctggatgggtgaacgcttcggcgccaccctgccccgctggattgcgttgctgaccatgtccctggaactcgcactcggcctctggctgtgggcccatggcgactattcatttgctccggcaccgggtgtcgatccgaccttcgcgcttgaattcaagcacgtgtggatccagcgcttcggcatcaacgtgcacctggctctcgacggcttgtcgctgttgatgatcctgctgaccggcctgctgggtatcctctcggtactctgctcctggaaagagatccagcgtcacgtgggcttcttccacctgaacctgatgtggatcctgggcggcgttgtcggcgtgttcctggcgctggacctgttcatgttcttcttcttctgggaaatgatgctggtgccgatgtacttcctcatcgcgctctggggtcacagttcttcggacggcaagaaaacccggatctacgcggcgaccaagttcttcatcttcacccaggcttccggcctgatcatgttggtggcgatcctgggcctggtcctggtcaacttcaacagcaccggcgtgattacgttcaactacgccgacctgttgaaaaccaagatgtcgctgaccaccgagtacatcctgatgctcggcttcttcatcgccttcgcggtgaagctgccggtggtgccgttccactcctggttgcctgacgcccacgcccaggcgccgactgccggttccgtggacctggctggtatcctgctgaagacggcggcctacggcctgttacgtttcgccctgccgctgttcccgaatgcctcggccgagtttgcgccgatcgccatgaccctgggtctgatcgggatcttctacggtgcgttcctggccttcgcgcaaaccgacatcaagcgcctgattgccttctcgtccgtttcccacatgggtttcgtactgatcggcatctactccggcagccagctggcgctgcaaggcgcggtgatccagatgttggcccacggtgtttcggcggctgccctgtttatcctcagtggtcagctgtacgaacgcctgcacacccgtgacatgcgtgagatgggtggcgtgtggtcgcgcatcgcatacctgccggcgatcagcctgttcttcgccgcggcgtctctgggcttgccgggtaccggtaacttcatcggcgagttcctgatcctgatgggggccttcgtgcagacgccatggatcagcgccatcgccacgtccggcctggtgttcggttcggtctactcgctgatcatgatccaccgcgcgtacttcggcccggccaagtcggacaccgttttgcacggtatggatgcccgcgaactgatcatggtgctcggccttgcggtattgctgatcttcattggcgtgtacccgcaaccgttcctggacacttctgccgcaacgatgcatggcgtgcagcagtggttcggcaccgccttctcccaactcgcttcggcccggtaagagcgctatggaattcacgatccaacactttatcgcgcttgcgccgctgttgatcaccagcctcaccattgtggtggtgatgctggcgatcgcctggcgccgcaatcactcgcaaacgttcctgctgtcctgtgccggtttgaacctggccctgctgtcgatcatcccggccctcaaggtcgcgccattggcggtcacgcctttgatgatggtcgatgacttcgcgctgctgtatatcgccctgatcctggtggcgaccctggcgtgcgtgaccctcgcccacgcctacctcggcgaaggcggcaccggttacccaggtaacaaggaagagttgtacctgctgatcctgctggctgcggccggtggtatcgtgctggtcagcgcgcagcacctggccggcttgttcatcggcctggaactgctgtcgatcccgacctacggcctggtggcctacgccttcttcaacaagcgctccctggaagccggcatcaagtacatggtgctgtcggccgctggttccgcgttcctgttgttcggcatggccctgctctacgccgaagccggcagcctgagcttcaccggtatcggccaggccctggccgccaccaacagcccggcgccgattgcccagctgggcctggcgatgatgctgattggcctggcgttcaagctgtcgctggtacccttccacctgtggaccccggacgtgtacgaaggcgccccggcgccggtggccgcgttcctggcgactgcgtcgaaggtggcggtgtttgcggtgatggtgcgtctgttccagatctcgcctgccgccaacaccggcgtgctgagcaacgtgctgaccgtaatcgccattgcgtcgatcctgttcggtaacctgctggccctgactcaaaacaacctcaagcgtctgctgggttactcgtccatcgcccacttcggctacctgctgatcgccctggtggcgagcaagggcctggccgtggaagccattggcgtgtacttggtcacctacgtgatcaccagcctcggcgccttcggtgtgatcacgctaatgtcttcgccttacaaaggccgtgacgccgacgccctgtacgaataccgcggcctgttctggcgccgtccgtacctgactgccgtgctgaccgtaatgatgctgtccctggccggtatcccgctgactgcgggctttatcggcaagttctacattgtcgccacgggtgtcgaagcccacgagtggtggctggtagcatcgctggtgctgggcagcgccatcggcgtgttctactacctgcgcgtgatggtcaccctgtacctgatcgagcccaacctgcgccgtgtggatgccgagttgcattgggaacagaaggcaggcggcgtgatgctgctggccatcgccctgctcgcgttcttcctgggcgtgtacccacaaccgttgctcaccttggtgcagcatgcagtgctgggggtttgatcgcttaggttgatgcagtcaacagaacggcgcctttgggcgccgttttgcgtttcccaggatctgcttttcccctcccctgctcgctgaattttcctcctcgatctgcctcttcatccggcatctacccgatgaagccggccgtatggtgtttgcgttttaagaaagttcccacagcgcggtcacttgacctaacgcgggcgggccaccaaactctacgcaggctacgtacagaacatggatgctctatttatcgaactgccggcattcgagcggcatcgcaaggactatctgagtgaggagcttttccagggttttcaacaggagttaatgaaaaaccccgaagcaggagacgtgatcgaaggaacgggcgggttgagaaaggttcgcttcgttgatgaacggcgaaacaaaggcaagcgtggtggcctgcgagtcatttactactggtggtcaggcggcacgcaattctggttattcaccttgtacggcaagcacgaacagagcgacctgacaccccaccacaagaaagctcttaaacacatgctggacagggaaatcaaagcgagaacacatcatgaaacgtgacatcttttccgaactggtcgaaggcttcgacgccctggccgatgagcgccagggtaaaatcaccctgcgcaaccacaaggtccacctcaacaagctggcgccgctcaccgctgatgaggtgatcgccgtgcgccagcaactcaacctttcccggtcggtattcgccatgtacctgcgtaccaacacccgcaccctggagaactgggaacaaggccgggccaagcccaacgcccaggccgtcaccctgatccgtctggtagcgcgttttcctgaaaccgtggcgcaacttgccgcattgggctgacctgcgaaagcaaaaaaaaacgccccgattatcgaggcgttttttgcagtacaacagcgtcagaatgcaataccgaccttgaagccgtattcgtcacgcttgagcttggtgttgtcggccacataggagtcgtcgtcgagcttgtactcggtgcgggtgtagtacaggcccgccatcactggcaggtcgcccttctggttcatcagcaggctgacttcggcataggggttggtgcggtccttgaggtccacgctgtcgctgccaacgccgtctaccttgagtttggcacggccatcgatggtgtgacgggcgccggcttcaacgcgcagggtcatgtcatcgaactggtggttgtagcccagcgcagccttggcaaacggcgacttgttggtcagtttcatgtcgtagccattggtgtccggctcatagcgggtccaggtgtagccaccgcccacgatcacgtcgacaaagttgcgcgcatccagcgcggcacgccagccgaggtcgaggtcggcctggccttccttgagcttgttatcgctcttttcgccgtacttggcttcgataccggcctggtagataaaaccggactcggcagtgagcttgttgccgaagttatagaacaggccggcttcaggcatgtggtctttgtcgctttggctaccgccttcgagtttgaagtcgttgtagctgccgaggatcccgaaggtggaaatcgggtcggtggaaggtgcagcgaacaccacgccaggcgcagccaccagggccagcaacgaggtgttcttgaggaattttccgaatagtttggacatcgttttacatctccattttaaggtgggcaaagtattcaggaatcggttcgaaccttggcgtttgcaaaaagttcgaactgatttgcaccaaaaaggagaaaaaacggttcagcgaaggctctatctcaatattcttcaggattcatacagataaggcgctccacggcttcgctaagttgaggctgatccggcagccgaatgccgaaggtgtcgcgcaatagccccagcaattcatcggcagtccgaagcgtgcgcttttcactgggccgattcaggtaatggagcgcatagtgggcgttggctaaggtatgacgtttaccgggtgccagcagtgcggccttcaactgccccacaaacggcgaccccgggtgcgtggagacgtaccaattgccgatttcgtagtcgatgtctgcctggacttgcagatcgaacacatacaggccgcgccactcttcgccgacctgggcccagagcgtgtagctgccctgattgaaggtcaggcgatagggctcgtgggcagtggcctggggtgcgtcggtgtccagttgcaacgggctgctgggtaccatgccgccaaagccgacgtcggtgatgtagcgcacctcttcaagcgtcaccaggctcaggcggtgggtgcgcccggtgtgggcgtccggtggcccgccaatcaccacgcgaccggtgatgccgcgggcttcgaagcccagttcctgcagcagggccaggaacaactggttcaactcgtagcaataaccaccgcgcccctggtgcagcaccttgtgctcgacgctgggcaggtcgatcggcaccggcgcgtacatcagcgtcgacagattttcaaaggcaaaggtgcacacatggcgcagttgcaagtcctgcagggtttgcaaggtggggggtggcggcgaatcgtagcccaggcgtttcaaatagagatgactatgagtgagttcaggcatggcgcggtccttggcacgaggcggagcgtcactatgccgcgcccccgcatacgttgtcattttgaatgaacctttttgaacgctggcctatccatctataacaagacagggaggcaacatgagtaccgcaaaaatctacaccatccactatcagctacacggtaaacccaagtctttcgtggtgcgcgccgaagtgatgaacaacgccgaggcatggcattgggcggccgttgatgccgacattgcacatgtcagccgcatcggccgcgtgggtcacgagcaggtgaaaaaaaccacccggccctgggcggaaaagtatggtatcaccgacgtcagctggaccccgcccaaataaacaaagccccgcacgacggcggggctcggttcactttttcaagtcgcccaacggatcgtagggcggcttttttttcgcctcttccttagcctttttgtctttgtccaacggcgcgatggccgggcctatcggatcgacctgcgggtctgccacatccggcgagtccgggtcaaagcccagctcatccttgccgctggcatgttcattggagtgggggccatcggtacgcttgttcatcaggttctcctgttaaagcgggcgagctttgtcgtggaggttttccaggtcttcttcgacgcgctcgacatcatcgtccgggccacgctctttcgggtcattggggcgcaacgcatcgttgtcgcgctcttcttcaccgggcgtgcggttcgggtcgggtgtaccaggtggtggctgtttgtgttcggacatgacggcttacctcatgggggcttcacaaatttagagaaactgcccgtggctatcgttcaacttcattgctgcaagcatgagaagatggcagccctttctggagaccttcctcggatgttcgagctcaaaccctgcgaccccgtcacctaccgtcaacagacccgccgcagcacgctgatcgtcgccgtgctgttcctggccctggccatgctgctgtcgagcctggcggtgatgctgttcggcgagcccggaggcgacaactttcgcttcaatgtcggcggcgtatttgccggggtgttgattactgtcgcgctggtgcgtggcccgttctggacccagccctggctggcgccggctgtatacggttggcagctcaaacgcagcctgatgagtgtgaccaatgtaatgcacaaggtcaccgagagggtccaggccaacgacccggcggccatcaagttattgcgcttctatcacttggggctgacgcagatgcatgagctggacgccaactccagcgcccaggcgcaactggtcggcgagatcgaggctcataagacaaagatggaggctctggggatcgataccgaccaaacccggctcgatcccacatggctgcaaagcctgaaaagcgcttaacgcaacgtcagtgggcgaccttggcccgccagcagaacagcgcgctcacgataattgctgcgccagccaggccaaacacccaaggcgcagcggccaccggcagcaacaggcccgccagcagcggcccgaggcccgcgccgatatcgcgccatacggcgttggacgccaatgccgatacgcgcatggcacctgggttgcgctcggccaccagcgtggtcaccagtggcagttgcagggcacgcagcaccagcaccgccgccgcgccgacgatcacccaatgactgccgaacgcggccagggccagggcgctcaagaacgaaaacagcagtaacatcgacgtggccccgaagcgctgggccgcacgcccgcccaatgggctcaacagcaattccgacaggtagcgcaggcccatcaagccaccggcgatcagcaccgcatcaccgcccatgattttctgtgcctggagtgacaggccaaagataaacaagccgtccagcgccacgccttcgataaacgaccacagcgccacactgtccggccacttgaagcggcgccccggagtgctgtgcaaatcatgaccgctggtgggcaagccgcgggcgagccacagccccaccaggcagcaaccggcgagcatcagaaagatcgggcgcggccctgcccataacgtcaacagcccgcccaggggcaaggccagcatcggcccgaaggcgatcaatgcccgcgaacgccctgccctgcgggccgcgccctccggctcggaagtcgccagtacttgggtcgacaggttcaacgcggcaaaacacaggccccagaccaaccgcaggcccagcagcgcagcgaacccggacagcaccgaattgcccagcgcgcacagcgctgcggcaccggcggcgatcatgcaggtcaggcggtcgccgttacgcgcatagaaattcagtacatgccggtagccaaagatccgtaccaggcggttggcggccaacagcacgccggcctgggccagggtgacgccgaacgcctcggactccattggcagcaacagatagagcaacacatcgctgggcaggcaaaaccccagggtcaaggcggcgcggcgcgaagtgctatcggcagtgcgttgagtgaggctgggcataaagctgaaacattcagaaatattcagaccgccacactagcgttgccgccatgtgtttttcaaggacgcaggtgcagaagcgttaaaaaaccatactcaggtccaggcgcccttccctgaccggcgggcaccagtagtaaccaccggtcagtggcttactgatgcgatacagaccatcaacaatcccatcctccaacccgctcatacgtcgaagctgcgcctcgaacgcatcgaaggaatgcccgaaagcaagaaacatcaaacccgcctggccgttctcggcccagggcatggaacggcggaccacgaaggcctccggggtgaaactttcctgggccgtgcgcttggtatgggcggactcgggagcgtcatccagctcttcgttgtcgccatggcggcggccgatgatgtggtcacgctcctgggccggcaatgcggcgaaaccgtcgaggtcgtgctgccattgctggatcgcggcgaagctggcgccgctatcggtcaaggcggctgtcacggcggcatcgtcatgggggttttcggtgccgtcttcgtaatcggtcaggtcaaaaccggtcttgtagcggaagccttcggtcgattgcaccaggcgaaaagccggggccagggctttttcaagtgtgcggctgcgcagcagcaactcgccgcgatccactccgtgcaaccatacccacaacgcctgctgggtcgacgggttgtgtgcaccggggccgctgaccacggggaatgtacgcaagccttcaatctcagcacccagggcctttaccagcggctcaccgaaaccgaccacggccgccgcatccgtccactgcaccagtgcgtccagggcagcaggcacggcttgcagggaatcgagggcaaaaaacagatggcgggcctgcaaaggcaccggggcggcaagaatgcccggctggtactgactcatgtgaactccttctgaaaagccgcgcagtttacccggcgcacgcgacactgcgaacaagaatgcgcgtaagccttgccttggagctgccagttgggtgactctctagtcatgttttgcaactattccaggggtagcgacatgaccaccagcaacctgcttgcccaactgtttcccacgtccgttgcccagattcccgagcaatttcgcctggcggcgcccattgagcagcgtgattacctggtcgatggccaactgcgggtgtgggacggccctctcgcccgcgtgcaaagccccgtgcaactgggcgatgaacgcgtgcatatcggcagcacgccgctgctggatgccgataccgccctcaccgccctggatgccgccgtgcgcgcctatgaccgtggccagggtgaatggccgacgatgcgcgtggcagagcgcatccagcatgtcgaagccttcttgcggcgcatgcgcgaacagcgcgacgcggtagtcaagctgctgatgtgggaaatcggcaagaacctcaaggactcgcagaaagaattcgaccgcacctgcgactacatcaccgacaccatcaacgccctcaaggaactcgaccgccgcagcagccgtttcgagcttgaacaggacaccctcgggcaaattcgtcgagtgcccctgggcgtggctctgtgcatggggccttacaactacccgttgaacgagaccttcaccacactgatcccggcgctgatcatgggcaacacggtggtgttcaaaccggccaagctcggcgtgttgctgatccgcccattgctggaggcattccgcgacagcttcccggccggggtgatcaacgtgatctacggcagcggccgcgaaaccgtaagcgcgctgatggccagcggcaagatcgatatctttgcgtttatcggcaccaacaaggccgccagcgatttgaaaaagctgcaccccaaaccgcatcgtttgcgtgctgcgctggggctggatgcaaaaaacccggggatcgtgctgcccgaagtggacctggacaacgcggtgagtgaagcagtcaccggctcgctgtcgttcaacggccagcgttgcaccgcgctgaaaattttgtttgtgcacgcggatgtggtcgacagctttatcgagaagttcaatgccaagctgaccaccctcaagcccggcatgccttggggcgatggcgtagcgctgacaccgctgccggaagtgggcaaggtggattacctcaatgaactggtggccgatgcggcccggcacggtgccaaggtcgtcaatgccgaaggtggcagcagccgtggttcgttcttctacccggcggtgctgtacccggtgaacccgcagatgcgcgtgtaccacgaagagcaattcggcccggtggtgccgatcgtgccctaccgcgacctggaaaccgtgatcgactacgtgctggactcggatttcggccagcagttgagtatcttcggcaccgaccccgtcgccgtcgggcgcctggtggacaccttcgccaaccaggtcggccgcatcaatatcaacgcccaatgccaacgcgggccggataccttcccgttcaatgggcgcaagaactcggccgagggcacgctgtcggtacatgacgccctgcgcgtgttctcgatccgcaccctggtggcgaccaagttccaggagagcaataaggcgttggtcagcgagatcctgcgtaaccgtgactcgagcttcctgaccactgactacattttctaagcactcctcggttcaacaatgtgagagggtcggtgcgacgattcgacttgcccctcccacaatggactgagtcagccctgacgattgaggctcttttaataccgatgaacctgcccttctttgcccgacgcctgctgcgccccctgctcgacccgtaccgccgctatcgtcacgccaagctgatccacgccgtgcgcgtgtccatcggcttgctggcgacgatcctgttgaccaccggtctcaacctgccccacggcgaatgggcctcggtaaccatgctggtggtgatcggcgggttgcagcaccacggcaatatcggcaagaaagccgtggagcgcgcctacggtacgctgatcggtgccagtgtcggtttgctgctggtggtgcaggaagcctacgtcggccagccattgctgacctacctgctgatgtcggcgatttgcggattcttttcctaccacgccatcggcaaaggcgggtataccgcgctgctgtcggcgattaccgtatttatcgtcgcggggcacggtgacaatccgctgtcggacgggctgtggcgcaccgtagacatcctcatcggcatcgccttggccctggcgttttccttcgccctgccgctgtacgccgtgtattcatggcgttacaacctggccagtgcgctgcgtgattgcgcgcagatctacagccggatcatcaatggtcaatcggtgaccgatgatgaacacctcaagttgctcaaccgcctgaatgcagcaatgttgcaactgcgctcattgatgccgtcggtgtccaaggaagtgcggatttccatgaccgagttggacgcgatccagcgccacctgcgcatgtgcatcagcaccctggagattctcggcaatacccggcccgatcctcgcgatgagcaggcgacggcgcgcatgcaggtaatgttgaaggctgagcatcggcaaatcagggtgcagttggtggggatggcgcgggcgttgaagtcgggggtgacggagcggttggaacgcaacggccaggccagcggtggtgagtccacattggatgcacccgtctacagtgcactggatggatatcggttattgaccctgcaattggccgcgaatgtggatgcaatgcgtcaacgcttggccaaaagcgctggccggtggaagatctgaacgtatggggagttgatctgattaccaggatcaacacattcacactttctcttacatatttttcacgatttgttcacatcccaagacgtagggtgaagcctcatccgttacaaacgttgtacatcaagcccgccgccccagcgggcttttttttgcgtgctttttggcgctaaaaaacggccagctccttgtaagaacgagcttgctcgcttctacaaggagtttcggattggcttcagcgtgtcgcttgctcgcgaatggcccgctgggtatccagcaccttggccaacgccgtctcagcctcagcactctgctgtggcacgcgaatcgccgctgacaccaaggtaatcaacttggccatcacctccgcatccgtcgccgggcggcccaggctcatggaattcatcagcaggcgcagttcggtacccgccatcaccccggaaatcgccttgagggcaaattgcaggcgcacgcccagttcattgcgcggcagatccggcaaggccagggcgaaggcttcgaagaaacgctggaacaccggctggtaatgcaccttgaggtattcctggataaacggcgaggtgtcgctgtagacccgtcccaggaaacggatgaacgaacgcccttccccactggccgggtcgctgcgttccaggcccatggccggggcgaacagcacgccgagcagggtgtcgcaatccagagggccgtcggattcggcttcgcagcgggcgagcaattccaggcgctgctcgttgagcggctccaggcgttgcatcagcagggttttcatcagggagtccttgtccccgaagtgatagttcaccgcggccaggttgacctgggcacgctcggtaatctgacgtaacaaaacggcgtcgtagccgtacttgatgaagagtgcctctgtcgcatccagcaatcgagtcttggtaacgtttggagcgctgagtttcttcgcggccataagggttccacggcggaaatattgttttaaaaataatttgattttttataccggggtggtccgttgaaagcaagtagtgacactccgccatatcactgaaagcctgtataaccgggctgtacagtcatgccaaaaggaatttagccagcccgagaccctcagtcgagaaaacgtttcatagggtaaaaccgctctacatccacggctggcgaagcgtaaggaacgcggttactattcaaacaatattttaaaaacaagaaataaaaccagtccgtgacgcgtacagacagctcccgaacttgttacaaggattttccgggagcacgccgacaccgtcgagactgcaggcgtagtcatgatgacagacactccctcgcacccaggcttgatctccctgcaaggcatcggcaagcgctatcagctggccgggcaggaattgagcattctcaatgacgtgtgcctgtccatcgccagcggtgacagctgcggcatcctgggtgcctccggctccggcaaaagcaccctgctcaatatcctcggcctgttggacctgccgaattgcggccagtaccactttgccggccacgacattttcactgccacccccgatgagctggcggcgatccgcaaccggcagatcggtttcgtgttccagagcttcaacctgctgccgcgcctcagcgccctggacaacgttgccctgcccttgagttatcgcggtgtgtcgcggcatgaatcggtggagcaagcccagcgcatgctcgagcaagtaggcttggccgagcgcgcccaccaccgccctgccgacctttccggaggccagcgccagcgcgtcgccatagcccgcgccctagtgggccagccctcagtgatcttggccgacgaacccaccggcaacctcgacagtaccaccgcccaggagatcatggacctgctgctgaccctcaaccgtgagcaacaggtcacgctgatcatcgtcacccatgacgcgcacatcgccgagcgcctggagcgcaagatcctggtgcgcaatggcgtggtgcacgaggccgatcgccgatgagcctgcgggtcgagcagagcctgagccacctgctgcatgaagcgttcatcagcctgcgcaccctgggtaagcgttcgatcctggcgttgctgggcatcgtcatcggcagttcctcggtggtggcgctgatcaatatcggccacaacgcggcggtggacgcggcgatgattttcaaggacatgggcaccgataccctgatcgcccagttcccgcccaagggcagcagcaatgtgccgatgcgcacccggctcgacctcgatagcgtgcgcctggcggtgccgggcattgcgcatatcggcgccctcagcctgttcagcgggcccgtcgtgttccatggccgcaccaccaatgccaacctggtcggcagcaccccggatatctacgcggccatgcgcctggtcatgcgcgaggggcgtttcctgtcagccttcgacgccaacgaaacctacgccgtgatcggtgaccaactcgcccaggccctcggagcaccgggtgacccactgaggctgggcgatcgcgtgcgcatcaacgactatctgttcctggttgtcggcattctgcacaaccagccccgggccatgctgatgccggtgcaagccaacgaatcgctgtttattcccgccgagggtatgcgccgcatctatgccagcccgcagatcagcaatgtgatcatccgtgcgacgccggggcaggacatggaacgtattgcccgagacgctagcgctgcgttgcaaccccagctcaccgagcatgacgtcgacatcatcgtgccccagcagatgatcgacggcatgacgcgccaaagccgcacattcgcctatctgctgctggccctcggcgcgatctccctggtgggcggcggcgtcggggtaatgaacgtgatgctgatgaacgtctcggagcgccgccgcgagatcggcattcgcatggccctgggcgcgcgccagcgagatattcgtaacctgttcctgctcgaagccatcaccctcaccgccgtgggtgcgctttgcggtgcggtattgggcatgaccgctgcgtggctgtatgcctggctgtcgggctgggcattcgccctggcggtggccgccctgcccctgggggtgggcagtaccttgctggtcggcttgttcttcggcatctatccggcggtctcggcctcgcggttgcaaccggtggaggccctgcgcgatgagtaaatggttgtggttgctggcgctgatcagcctgcccggcgtggccgccgaggtggtcgtcaagccatcggcacccagcagcacgcgcagcgcctatgaccgcggcgtgtcgctcaatgcccaggtcaccaccatgaccctgggcgacgccgtgtacctgggcctgcgcaacaacccggcgatccgcagcgcctatctgcaacgggtggcgcagaagttcgacttgcgcgtcgccgaagacgtgttcaaccccaagctcaccctcaacagtaattaccgcaccagccggggctcccaggacaacgcccgcaatgccagtgtggcgccgaccagcagcctgctcggcgaatacggcacgcgcctgagcatggcctggacccagcagttgaataacgccaaccgcgccggccgctaccgcagcgacggcctcgacctggcgatcatccaaccgctgatgcgcggggccggctgggacgccaccaccgcgccgctgcgcctgtcgcgcctggccgagcaggccaaccgcctgaacctcaaggccaccgtggcgcagaccatcagccagatcattgccacctaccgcgaactcctccgcgcccaagagcaactggtgatcgtccaggaagccctcaagcgttccaacaccttgctggacgtcaacaaagcgctgatcagcgcagggcgcatggccgagttcgagatcgtgcagaccgaagccgatatcgccacccagcaattgggcgtggaagaagcccagaaccaactggacaccaaccgcctggccttgctgcgcctgttggccctggacctgtccacgccgattcgcgccaccgaagccctggaggccaaccccatggaaatcgacaagcgccaagccttcaacctggcgcagaaccagcagccggaatacctcgccgccctgctgggcagccagcaggccgatctcaacctggtcatcgccaaggactccgggcgctggcaggtggacttggtggccggcgccaaccaggtgcgtgacgcctacgacaacgacaacggccacaccaataaccgcacctgggacagctacgccggcgtgcaggtgcagatccccattggcgacatcagcacacgccaggccgaagtccgcgcgcgggtaaatgtggaggatcaggaaatccgcattaccgacgcccgccaggagctggagcgcaacgtcaacaacgtggtgcgtgacctcggcacccgctggcgccaatatgaaatttccaagcgcgccgtggagttgtcgcggcgcaagatcgagatcgagcgggaaaaactcagtgccgggcgctccaccaacttccaggtactgagcttcgagaccgatctgcgcaacgccgaaaacgcccagctcaatgcgctgatcgcttatctgaacgcccagacccagctcgatctgaccctgggcatgacgctggaaagttgggaaatcgccctcaatgactactaatcaaaaacgctggctggccgtcgtcttgatcgtactgctggcaggcgcggcagtcagcctgctcaaccaccgcagcagcgtcgagcaggccagcaccgccgagcaatggctggcggtaaaacccgacccgctggtgcaccagatcggcctggtgggcaagatcgagcccgacaacaccgtcaccctcacggcgccgttcgacggcaatgtgctggccaatctggtcgagcaaggccaacgtgtcgaagccggccaggtgctgttgcgcatggacccggccacccttgaagtgcaactgcgcgacgccctctccgcccaactcaaggcccggcgcgcggtacaggaaatgcaggactgggacagcagccccgcggtcagccgcgctcgccgcagtttgcgcaccgctgaaatgaccgccggcaatacccagcgcaaactcaccgagagcgaaaacctgttcaagcgcgggattattccgcgcaacgaactggacgatctcaagcagcaaacccaacagcagcaactggacctggcagcggcgcgcagtgaactgcaacaggcccaggaccaaggcagaggcgaataccgacagatcgccgagatggagctgactaatgccacggtcaagtaccaagccctgcaaaaactccttgaaggcaaggaggtcaaggcgccgttctccggcatcgtggtgcccgcacccggcagcaccagcaccgcccaaggaggcgccagcaacaacgcgccggtacaggcggggagcaaggtcagccagggtcaggtgctgttcgggctggccaatatcgaacggctgaaaatcgtcgccaaggtttccgaactggacatcaaccagttgcaccagggccaggcggtggaagtgatgggcgatggcttcgacggcgaacggctgaccggctcggtcagcgtggtcagtggcttggccatcgccagcgacaaccagggcagcgcgcagtttccggtgaccctgtcgatcccgaagctgacaccacagcagttgcaacgggtgcgtctgggcatgagtgcgcggctgaccatcgtcacctacaacaatgaccaggcgatcgtgattcccagccaggcgatccaggcagatatgacggtggagtaccgaccagcgatggataaaccggtggagcgggtgaaggtgaccaccgggcaatcgacgccgcagggggttgaggtgtttgggctgaagccaggttttgtgaaaacctcaaactaaacgcagatctaaatgtgtgagcttggttgccagtgccttggcctggagcgccacgtcggtcaccgccgtactctcccaccacatgccccgcaacggcgggcccatggcaaacagtcgctggctggcctggccctgggcatccagcaccgcgccggccgcatccgccgcaatccccaaggccaatggcccgggctggaccagcccgcgcttgagcagttgttgtggcaacggccgggccacgcggcgccagtcgtattcgatgccgctggagttgatcagcgccgcgcccgaaacccgggtgagcccttgctcgccacgatggcgcaccgcaatggcgacgacctcatccgacggcactaaacccttgaacgacgctgcgcgaatccgcaaccgtccttcttcctgcaaacgggccaccaactgcgcactcaacggtggcgagcggtggtgatggctttcccaccatggccgcacatgccgcacgaactggcgtttctcacgctcactggcctggctccataaacgtgcgatatgcacacgtacggtgtccagcggcgcctgccaatcgatgccttggtcgagtgcgatgcggcattggcggcgcacctcccgcagcaattgccgcgggctacgcaggcggtggtcggcggccaggaagtcgtcccaactcggcggttgccggcgcacatggggcaacagaccgtggcgcgaaaaaatctcgatgggcccgcgatgcccggcctgttccagggacaccacggcgtcgaccatggtcaacccggagccgatgatcagcaccgttgattgtgggccgagttgggtcatcgcttgcacgtcccatgggtccaatgcggcagcgttcagccccgtggactcggtctgtggcgtgcgcgcagccgggaacatgccggtggccaataccgcaaaagccccatgcagttgctcgccagtatcgagggtgagccgcgtcgacgttgcctcgacttgcaggtcgaccccttcggcacggatatgctcgactgtcgaagtggatagcgccttggcctcggccaggcgctgttgcgcatacagtccgaaaatgccccgcggcgggaacagttcgctgaccggcacgtgctgctggtccgactccggccacccaccgccagcgatgtagtcggtgagccattgggtcaggtcgtcggcattgtccgggtcgacgctcatgcgcgccgcattgccgttcaaggtgtggcccagctcgaccgcgctataggcctcgccgcgccccagctcagcacgcggttcgatcaccaggatgcgccgcgtgcccgccaggcgcagcagttgtacggccagcatcgtaccgctcaggccgccgccgatgatcagcacatcggcgttgtggacttgcatctcactttgttgcgcccaggccatagtgactcccgctatcaaaaccccatgagttatacctgttacttttgacagtatacgcagcccaattcaacccatagcctattcatcgtgcccctccttccaaaggaaacatcaaatgaataagcccaatcactccaaagccaaacttatttcgggaacctgcaccgccgtcgtggagggcgatgccgacttgaaacgctttgaaggccctccgattcacttctacctggatgaagatcgcaaccgatggttcatatcagccctcaccgagcccgtgccgtttgaatatcaccaacaaatcgagctgattttacccaacgagggccatgtcatagaaaaaacttatgagatcgtcaaagaatggggcgcgcaaggaaaagccaatgcttcatgggtgaaaaggacttctcataccttccaaccttatactgcctctggcggaagtgtgaaggttactttggatcccgccaaggagacagtacacctcattttcaactttaaagcggaacatggtacacgagtcgtcacccttacaaagggtgatatgaaagttaaaggcacaacgaaacgccgcatgaccaacgcaacaggttcagtgacctgcgatatcagtgatgccatcaaccgcaactatcggtcgatggagactgcgctcactacccagcctgcgtcaggtagttttccagcccatatcagcgtatggtcacgagagtttgtcccagcgcctgatccgaatccgtttgactaccgagtagtcttcaactttgcagaggcacttgtaccgggcacttataacttcagtccggataacagacaggtgcgtgcatttgtattcgacctcaatcgaaacgtcgcctggccaagcgacagcggtacgattacgctgacctcaatgcctaactttgaaacattagagggcccgctgtcaggggtctaccactttaccggtacagcaacacttacagatggcactaaactacggatagaagtcaaaaatgggaaactcaacatcgaaaaatagacccactgttgtttccagccccgtaagtttaagtagttagactcgtgacgcacaaaccgtcggcgctggtgagcgcctacggttttaactgttcagaaagcgattcagggtctgacttcatactttgcgacaggggattgcacctcgtaagcaattcaagacttactggctggcgaatggagtaacatgcgctttcaggtttgccctgcggtgaaaactaacagatataaaccatttgatggcccggttagatcacgacatttcgaacaaatcgcaccgccacatcaccctcattgcgatagccgtgggattggcggctggcgaacatatagaactcaccagccgcgacgattttttcttgatcgtcgagaatcagggtcaatgcaccttcatacacgaacaattgcacactccaaccctccgggtccggctcggggctgtagcgatcccccggctcaaggcgcatctcccataattccacttcgcggcgggcgttggccttggccagcaacaccgccttgctgccggggatctcaccggcccaggccagctcattgatacgactatggtcaggcgcatccggagcctggatcaagtcgctgaatgccacctccagcgcttcggccacacggtcgagggtggacaggctgacgttcttctcccccgcttcaatcgctaccagcatgcgccggctgaccccggacttttccgagagcgcagtctggctcaggtcggcggcgtgacgcaggcgacggacgttctggctgacgtgttgcaggaccgaggcccgttgtggattttctttgtgcactatattgctcaatcggtgggtgtgcgcagtatactgcccagcagtgcggcgcattgtgcggtccgtgcttttcccttgcaagaccgagccgccatgaccgccccgaactccccttcgcgtttcaaccgtttcagcaaggccgaatgcatcctggtggtgatcaccatgttttggggcggcacctttttgctggtgcagcacgccatgaccgtcagcgggccgatgtttttcgtcggcctgcgctttgctgcggccgccatcgtggtgggctgtttttccttgcgcaccctgcgcgatctgacgctgtttgagttgaaagccggagtgtttatcggcgtggcgatcatgtttggctacggtttgcagaccattggcttgcagacgatcctgagcagccagtcggcgtttatcactgcgctgtatgtgcccttcgtgccgttactgcagtggctggtactgggcaggcgaccaggcttgatgccaagcatcggcatcatgctggcgtttgccgggttgatgctgctgacaggccctgcgggcgcttcgctggatttcagcgccggggaaatcgccaccttgatcggcgcggtggcgattgcggccgagatcattctgatcagcgcatttgccgggcaggtggacgtgcgccgtgtgacggtggtgcagctggcgacggcgtcggtattgtcgttcatgctggtggtgccgatgggcgagacgttgccgggcttttcgtggttgctgctgttcagcgcggtgggcctgggcctgaccagtgcggtgatccaggtggcgatgaactgggcgcagcagagcgtgtcacccacccgggccaccttgatttatgccggcgagccggtgtgggccggggtggtcgggcgcatagccggggagcggttcccgccgattgcgatgctgggggcagtgttgattgtggtggcggtgattgtgagtgagttgaagacgcgggggcagaaggccgttgaattggccgatgagatggaacaggaacgccagggttgaggtccgaactccagcggcgtccaacggatagccatcgcgggcaagcccggctgccacattgagcggtgttgttggttgcaaagcggccacctgaaacaatgccaaatgagagccttcggcctatcttgtaggatcctgccacatcttgccgtttggtgatcgcgaaagcggcacgtatgatgcatcccaaactcccgcagattagaagcctatgtccctgatagttctactgcttctgccttttatcggcagctgtctggcggccttgctgccgcacaatgcacgtaacaccgaatccctgttggctggccttgtggcgctggtcggcactattcaagtcgccctgctctacccccagatcgcccacggtggtgtgatccgcgaagaattcatgtggttgcccagcctggggctgaacttcgtgctgcgcatggatgggtttgcctggctgttctcgatgctggtgctcggcatcggcacgctggtgtcgctgtatgcgcgttactacatgtcgccggatgatccggtgccgcgcttctttgcgtttttcctggcgttcatgggcgccatgctcggcctggtgatctccggcaacctgatccagatcgtgttcttctgggaactgaccagcctgttctcgttcctgctgatcggctattggcaccaccgcgccgatgcgcggcgtggtgcgtatatggcgctgatggtcaccggtgccggcggcttgtgcctgctggccggggtgatgctgctggggcatattgtcggcagctatgacctggaccaggtgctggcagcgggcgatcagatacgcgcgcattcgctgtacccggtcatgctcgccctggtgctgattggcgccttgagcaaaagcgcgcagttccccttccacttctggctgccccatgccatggcggcgccgacgccggtttcggcctatctgcactcggcgacgatggtgaaggccggcgtgttcctgctggcccgcctgtggccgtcgctgtccggcagcgaagaatggttctggatcgtcggcggtgccggcgccctcaccctcctcctcggcgcgtactgcgccatgtttcaaaacgatctcaagggcctactggcctattccactatcagccacctcgggctgatcaccctgctactgggccttaacagcccgctggccgccgtcgccgcggtgttccatatcctcaaccacgccaccttcaaggcgtcgctgttcatggcggcgggcatcatcgatcacgaaagcggcacgcgggatatccgcaagctcagtggcctggtgcgtctgatcccgtttaccgcgaccctggccatggtcgccagcgcgtccatggccggggtgccgctgctcaacggcttcctgtccaaagagatgttcttcgccgagaccgtgtttatctcctcgacccaatgggtggaaatcgccctgccgctgatcgcgaccatcgctggtacgttcagcgtggcttacgccctgcgcttcaccgtggatgtattcttcggcccgcccgccaccgatttgccgcacacgccccatgaacccccgcgctggatgcgtgcgccggtcgaactgctggtattcacctgcctgctggtagggattttcccggcccaggtggtgggttcgatccttgccgctgcggcgctgccggtggtcggtggcgtgctgcccgaatacagcctggcgatctggcacggctggaacgcgccgatgatcatgagcctggtggccatgtgcggcggcgtggtgctgtatctgctgctgcgcaagcaactcaagcgcgggcgcttcaagtacccgccgctgatcagctacttcaacggcaagcgcggtttcgagcgcagcctggtggtgatgatgcgcggcgtgcgccggatcgagaaacgcatcagcaccaagcgcctgcaaacccagttgttcctgttggtgctgctggcggtggtcggcgcgatgatccccatgctcaacagtggcctcagttggggcgaccggccgaagatcccgggctccatcgtgttcgtcaccctgtggttgctggcaattgcctgcgccctcggcgccgcttggcaagccaagtaccaccggctggcggccctgaccatggtcagcgtgtgcggcctgatgacctgcgtcaccttcgtatggttctcggcgccggacctggccctgacccaactggtggtggaagtagtgaccaccgtgctgattctgctcggcctgcgctggctgccgcggcgaatcgaagaggtgtggccactgcccaacaccctgcgcaaggcgcgtatccgccgggtgcgcgacttcctgctctctaccgtggtcggtggcggcatggcgctgttgtcctacgcgatgctgacccgccagacgcccaacgatatctcctcgttctacctcagccgcgccctgcccgaaggcggcggcagcaatgtggtgaacgtgatgctcgtggacttccgcggtttcgacaccctgggcgagatcaccgtgcttggagccgtggcattgaccgtctatgccctgctgcgacgcttccgcccgtccaaggaaagcatggagttgccgccacaacagcgccaactggcaccggacgtggccaccgacctggtcaacccacgccaggccagcgacaccgccctgggcttcatgatggtgccggcagtgctggtgcgcttgctgctgccgattgcgctggtggtctcgttctacctgttcatgcgcggccacaaccaaccgggtggcggttttgtcgccggtcttgtgatgtcggtagcgtttatcctgcaatacatggtggcgggcacccaatgggtcgaggcgcaaatgagcctgcggccgatgcgctggatgggctttggcctgctgtcggcgaccctgactggcttgggcgcgctgttcgttggctacccgttcctcaccacccatacctggcatttcagcctgccactgctgggcgacattcatatcgccagtgcgctgttctttgacgtcggcgtgtacgcgatggtcgtgggttccacgctgctgatgctcactgccctcggccatcaatcggtgcgggcacacaaaccgagcaaccaggccaaagtagttgccacaaccgaaggagccgcctgatggaagaagtcatcgcaatagccattggggtcctggcggcctccggcgtctggttgatcctgcggccacggacgttccaggtggtgatgggtttgtgcctgttgtcctacggcgtcaacctgttcattttcagcatgggcagcctgtttatcggcaaggagccgatcatcaaggacggcgtgccgcaagacctgctcaactacaccgacccgctgccccaggccctggtgctgacggccatcgtgatcagtttcgccatgaccgcgctgttcctggtggtgctgctggcatcccggggcctgaccggcactgaccatgtggacggccgggagcccaaggaatgacgtggatgaaccaactgattgtcgcgccgatcctgctgccactgctcacggccgggttgatgctgatgctgggcgaaaagcgccgcccacttaaggcccagatcaatctgttctccagtgtgatcggcctgggcatcgcgatcctgctgctgtactggacgcaacaaggcggccccggctcgattggcgtgtacctgccgggcaactggcaggtgccgttcggcatcgtgttggtggtggaccaactgtcggcaatgatgctggtgctgacagggatcatcggcgtgagcgcgctgctgttcgccatggcccgctgggaccgggcgggcaccagtttccacgcgctgttccagatccagttgatgggtttgtatggcgcgttcctcaccgccgacctgttcaacttgttcgtgttcttcgaggtgctgctggcggcgtcctacggcttgatgttgcatggttccggtcgtgctcgggtgtcgtcaggcctgcattacattgcgatcaacctgctggcgtcgtcgctgttcctgatcggcgcggcaatgatctacggcgtcaccggcacgctgaattttgccgacctggcgttgaaaatcccgttggtgccggaggctgatcgtggcctgctgcatgccggcgcggcgatcctcgccacggcgttcctggccaaggccggcatgtggccgctgaacttctggctggcgcccgcctactcgtcggccagtgcgccggtggcggcgatgtttgcgatcatgaccaaggtcggcgtgtacaccgtgctgcgcctatggaccctgctgttttccggccaggccggggcttcggcactgtttggcggcgattggctggtgtatggcggcatggcgaccatcatttgcgcggcactggcgatggtggcggcgcagcgcctggagcgcatggccagcctgagcatcctggtctcggccgggatcctgctgtcggcagtggggttcgcccagccgagcctgacggcgggggcgttgttctatctggtcagctctaccctggcgttgagtgcgttgttcctgctggcggagttgatcgagcgttcgcgttcggccaacgacctgccgctggatgaagaaatcgatgcgttgcccaaggccatggagtcactgcatccgcgtcctggggtgaacctggatgatgagcagaaagccgtggtcggccaggtaatcccctggaccatggccttcctgggcctgagctttatcgcctgcgccttgttgatcatcggcatgccgccgctgtccgggtttatcggcaagctcagcctgttgagtgcgctgatcaatccgttgggcctgggcaatgccatcgatgaaccgattcgccctgcggcctggggcctggtggcattgctgatcctgtccgggctggcctcgctgatcgcctttgcgcgcctgggtatccagcgcttctggaccccggaagaacgcccatcgccgctgttgcgtcgtaacgagtgcctgccgatcttctttttgctcggcctcagcatcctgctgaccttcaaggccgagccactgatgcgttacacccaggccgccgccgacagcctgaacaacccggagcgctacgtgatggcagtgctggcgacacgcccggtacccagccccgaagcccaggccgccgcgctggaggtgcagccatgaagcgtttgttccctgctccgtggctgtcattggcgttgtgggtgttgtggctggtgctgaatctgtcgatcagccccggcaacctgctgctgggcgcgctgctgggctttcttgcaccgttgctgatggcgccgttgcggccgttgccgatccgcatccgccgccccggggtgatcgtgcgcctgtttttcctggtgggtcgcgacgtgatcctctccaacctcaatgtggcctggggcgtcctgacctgcggcacacgagcgccgcgttcgcgctttatcaaaatccccctggacctgcgcgacgccaatggcctggccgtactggcgatgatcaccagcgtgacgccaggcactgtctggtcggaactggccctggaccgtagcatcctgctgctgcacgttttcgacctggatgacgaagcgcagtttatccagcacttcaagcacgcctatgaacggcccctgatggagatcttcgaatgagcgccctgctctccaatgcgatcctcgccagcctgttcctgttttccctggccatggtgctgacactgatccgcctgttcagaggcccctcggcccaggaccgggtactggcgctggactacctgtacatcctggcgatgctgatgatgctggtgctgggcattcgctatgccagtgatacctactttgaagcggcgttgttgattgcgctgttcggcttcgtcggctcgtttgccctggccaaattcctgttgcgtggggaggtgattgaatgatgccgttatgggttgaagtgagcgtggcggtgctgctgatagtgagcagcgtgtttgcactgatcggtgcaatcggcttgctgcggatgaagagctttttccagcgcatgcacccacccgcgctcgcctcgacattgggcgcatggagtgtggcgttggcgtcgatcatctacttttcgacgctcaagtccgggccggtattgcatggctggttgatcccgattttgctgtcgatcaccgtgccggtgactaccctgctgctggcgcgtactgcgctgtttagaaagcgcatggcgggcaatgatgtgcccaccgaagtcagtagccgcacagaaaaaagcaggtaagagcgagccagcgtgcgcctggaaatgcttgccagagcgcccgtcagcttgccaacaagcgcccgtcgagtgccattttcaccgttttgacgagcatcacagccaatgcaagcgtcaggaacaccaacaacccataagctaccaggcttaaaaacaagctctgttgcgcatcagcgtacttcaacgcggcattgctcaatgccgcaatgggaaaactgatcgaccaccacactggcgagaaaggcgctgcgtttcgaaacactttgaacgccaacactacaaacaggaacaggccaaagtaaaaaagaacgctggcaaaacggtcaacagcaccgaaaacgttcacataagccagaaatcctacggcaaaaggcgccaccatcaccataagtgaaggcgtcatgcccttggccatcgccggttcatgaatcagccgggcgaaaattcgattgaacagcaccactgccaatgtgctgcccattgcgatggcgaagaggttgagttcgtgagcccaggccatgggcatatgggccccagtcaccgcaatatccaatgccgcaacgcctggaatcaaccaggcaggcacggccaactgggcctcccggccgccgctgagcaaacgaaaaaccacgaccgccgccagcaacacagtcagcccactaccgaccgcccataacacctggcccaacagcgtgctgtatgacatcgctatggccgaaagcagcagtaacgcaatagtcacggtaccaaaaaagttgccggttaccggatgagaaaactctgcttttaccgcctcagggtgtttgatccatttgctcgtgtaacccaccactaataagacaaacaccagagccgaaagcatgccgatgaactcggcaagaatttcgccgaagatactggcctcactcaggccagggctggctaaccgccacgccaagctcaagccggcaagccccatgacactgccaaacaagttgatggggaggttcttgatcgaatgtgtaccttggctcgactcggcaggcttggccaccgacagattgctatgactcatgatgtacccaattgactgaaaatgacgtagacgctattttcagccaatcgaaatatggcaacaatcatcaactaacgacgttttcagccaaattcacagcctagacgggcaactcgatgaaaatcgctcttcttgcacccccacgtatccaaatgctcgacctcgtcggaccgaccgatgtattcgctgaagccgcacgccaactgggtaaacctcgtacctaccgaatagcggtgatcggggtccgacccggccctatcaagggtaccagtggcttgcgcgtggaaacggatgactgcattgaaaccttcgacgcccacatcgataccctgctcatcgccggcagcccggcaatcggcgatatcaccgataatcttcgcgtattgcactgggtgcgtcggcaggcgggcaaggcgcgtcgtgtcggctcggtgtgcagcggtgccttcgtactggctgcagccgggctgctggcaggccgtagggccaccacccactggaactccagtgcggccctggcccgccagtacccgaacatccaggtggacgccgatagcatcttcatccgcgatggcaacctgtatacctcagcgggcatcacggcggggatggacctggcattggccctggtggaagaggatcacggtcgggacctggcactgagcgtggccagggaaatggtgatgtacctcaagcgccccggcggccaatcgcagttcagtgcccaattggcagcccagagcgccgagcgcaacgcgattcgcgatatacagcattacatcatcgaacacttggcgaccgacctcagcgtgccactactggcccgacacatgggcatgagcgaacgcaatttcgccagggtattcaaggctgacgccggccagaccccagccgaattcgttgaacgggcgcgcatcgacggagcccgccaactgctcgacagcgccgatgtatccctcaagcgtctggccaatcaggttgggtacgccaatgtggatggtttcaggcgtgcgttcgtgcgtcgcctaggcattagccccaatgagtaccgcaagatccacgccccgcaaaagaatgcccgatgactgctgcatgagccctccaaaaggttagctaaatgacctgatatgcgcagcgagttcagccagcccctgatcatcagcccgtaccgaatcgtgagacgatatatacccctcatacgtctcaaagtacttatccaccttcgagctgcgaggtttgaacgcactgtcctgccccgttccgtgcatgggaaacagcttcgcatgcagatgatccacgccatacccttccagaatcatccccgtgcgcgccacatcgggaaacgcccggtcaatctgcaacgcagtctttttggccgccacagccagatcagccagcaccgaatccgactgcgcgaacgcataactgccgtagtgctgcttggggatcaccacactgaaacccggcgtgttggggaagatcgaaaggaacgccatatggtggtcgtcttcccacaggatgtgcgccggggaagtcttttgaacgatgctgcagaaaatacaatccatttgaatcaccgccagtttcgtcttgggtttggtcgtggcaaccatctaaagctaggatggaatgagcgtcaaaccctacgggcattttgggaaatgtcctaagacctgggtatgcccgctgtgctgagacaggagttcaccatggataaaaacatcattgtcatcggcggcgagtccagcgaagacatgacgcgcatgacccgcatcgacgaatatatcgtcgcttcgtcgggcaaaccccggcccacggtgctctatatctccaccgccaatggcgatgaccgtacgaagattgccgacttcacgctcaaataccaaagcgccggctgcaccgttgtgccattgacgtttttcattccgccttttccagccctggatcatgttgccgcgctgtttgaacaggctgacatcatctatgtggccggcggcaacacccgagccttgttggccatctggcgtgaatttgacgtgaccgcccttttgaagcaagcccaggaacacggcaaagtgctttgcggcgtcagtgccggcgctatctgctggttcgaccatgggcattccgactcagggggcgtatatgcgctgatcgacgggctgggttttctccctggcgcgctgtgcccgcacttcagctcagaggcgggaagagaatcttcgtttgttgaactggttcgacttaaaaacatacgccccgcctacgcgctggatgacggagttgccctgcatttcaagaacggtgaataccacgcgactgttcataactacacgactggtagtgcatatgaactcagcagcacttcggagcccattgcaaggaaacgccctacagctctttagggttgccgctcagaaaatggccgcctaatcttcggcggtcgctgcaaattcagcgaccgggtttcgcagcccggttaaactctagacgcacagcgtccacctaaagaagcagccctaaattgaacggtgttcaaaggtagaagtgatgagggatgccgctatgttggtacaagtagccccccccttttaccgtcagctattgaacacccgcaagcacgaacaacgtaaagcaccgtgacatattttccaaagaaacatcctacgtccgcgccagaaacccttgcttctttgtagtcaacgattgacccatagtcttctctttggtgcccgatactccattgagcgtttccagcgggcacaccttccactcaaacgtaaatcgaagtcacgcacagccgccacccaaaactttaccctctctatacaagtcaattaatggacaatcgggatgcaattcgaatataagaaattcttcgtgacactagcactcatctcgaatgcaatatacgctcaagccgaacagactcacttatcgacaatcctaaatataaaaatgaatgcaacctatctcgacattgatacagaaaccactaactctttcggcgtaaagctcatggcggcagttcgcctgacgctttcgacagaacacagttgtggcacttctaaactgcatatcacaccggactccatcggcgttcctgtcgaaaatttcctagcagaagttaagaaaatcaaaaaatacgctgatgatggagccgcactatttatcacacatcacgattgtgatcgaaaaataccgatggcaaccaaattcgctacctgcacgggtgaaatatgcagatcactcacagatgtgctaattgatggaaaaatgtacctagacaagaattaccgacccgttccagctgcgcgcagtctttttttcatagagcaaccccaaacttatgaccaaaaactaaaagcctggaaagtatatatctacgataaaaaaactaagaagattgcggccgatggattcgtcgacaatgaagactatgctgcgagcaaattcatccataaattccgcacctttcatagcaacggcatgatttcgagttctattgaaatgagtgcgcaggggcaacgtgaaggaaaaagcattgttcgccacaaaaacggaaaaattgaaaaatctataaattacaataacggaattatcactgacggcgagtacataacttacgacctgacaggaaaaatcaagatccgtgagcattatgtaaatggagtgctaaatggcccaagagtcaaactgtacgctaacggaaatcctgaatccatggaaaaatacttagacggcagtcgctcaggaatatcaaattattactatgaagacggcacactaaaaaatatacaagattatgaccgtgggcagttggatggctgggacgtcaaatatttcgcaaacggcgagaccgaatcacaaacactctataaaaatcagcgcattagaataagccacgaatggaacattgacggcataaaagtcagtcaatgggaacaagacgaaaatcataaccgccaaggcgacgacatagaatggtatgacaacggacaaaaaagaaagcactcaatctataaagatggaaaacttcatggaaagatgcaaggttggtctgaggatggaactcaactttattctaccgaatacgcacacggcgagagaaacggacaatcacggcagtggggccgagacgggacgttgatagaagactgccaataccaagcaggaaaaatttcagagccgtgttcggtgagacctccgctctgactatgcaggtcttggacacgaatagaggtttaattcgaaaaacttagcaatatgcaaaaaacgccccgaaccagtcggggcgttttttattcagcatgcagctttcaacggtcagtcagccaaccgccacgtcgtcccacccttcccgtcttccaacaccacacccatcgcggtcagttggtcacggatacggtcggattccgcccagtctttaccagcccgagcagccaaacgtgcctgaatcagcgcatccacttgcgccgcatccacacgcccttcagcgccggcctgcaggaagtcatcggcttccatctgcaacacacccagtacgctggccagttctttgaggcgcgccgccaggcccgctgccgcgtcgagatcagtctcacgcaagcggttgatctcacgcaccatctcgaacagcaccgcgcaggcttccggcgtgccgaagtcgtcgttcatgacttcggtaaagcgtgccacgaacgtttcgccaccagcaggtgccaccgctggcaagcctttcaacgcgtggtagaaccgctccagggcgcccttggcgtccttgaggttgtcttccgagtagttgatggcgctgcggtagtggctggacaccagcaggtaacgcaccacttccgggtggtacttttccagcacgtcgcggatggtgaagaagttgttcaaggacttggacatcttctcgccattgatgcggatcatgccgcagtgcatccaggcgttggcgtaggtcttgccggtggctgcttcgctctgggcgatttcgttttcgtggtgcgggaactccagatcgctgccgccgccatgaatgtcgaaggtctcgcccaggcagcaggtggacatcaccgagcactcgatgtgccagcccggacgcccggccccccaaggcgactcccagcttggctcgcctggcttggtggctttccacagcacgaagtcgagcgggtcctgcttggcttcgtcgacttcgatgcgcgcaccgatgcgcaggtcttcgatttttttacgtgacagcttgccgtagcccatgaacttggcgacgcggtagtacacgtcaccgttgcccggggcgtaggcgtagcccttgtcgatcaaggtctggatcatcgcgtgcatgccagggatgtggtccgtggcacgcggctccatgtcgggcttgaggatgttgaggcgcgcctcgtcctcgtgcatggcggcgatcatacgctcggtcagcgcgtcgaacgcctcgccgttttcgttggcgcggttgatgatcttgtcgtcgatgtcggtgatgttgcgcacataggtcaagtcataaccgctgaaacgcaaccagcgggtcaccaggtcgaaggccaccatgctgcggccgtggccgatgtggcagtagtcgtacacggtcatgccgcacacgtacatgcgcaccttgttgccatccaggggcttgaagacttctttggtcttgctgagcgtgttgtagatcgttagcacgatgtttcccttaagacttaatcactggccccacgaatctcgcaaggtcacggtacggttgaataccggagcaccaggtttcgagtccttgatatccgcgcagaagtaaccttcgcgctcgaactggaaacggtcttccggctgtgcgtcgccaagcgatggctcggcacgacaaccagtgagcacttgcagggagtcagggttgatgttatcgaggaagctcgcgctgtcttcagccttctcggggttcggcgagcggaacaggcgatcgtacagacgcacttcgcactcgatgctggcggcggccggcacccagtggactacgcccttgaccttgcggccttcagggttcttgcccagggtgtccgggtcgtaggagcaacgcagctcgactatgttgccgtcagcgtccttgatcgcttcgtccgcacggatcacgtagctgccgcgcaggcgcacttcgccgttcggctccaggcgcttgtagcccttgggcggctcttccatgaagtcatcgcggtcgatgtagatttcgcgggcgaatggcaatttgcgcaggcccagctcttctttctgtgggtgacgcggcagttcgaggtgctcgacctggccttccgggtagttggtgatcacgactttcaacgggcgcagcacgcacatggcgcgcggggcgttggcgtcgaggtcctggcggatgctgaactcgagcatgccgtagtcgaccacgccgtcggaacggttggtgccgaccatctcacagaaattgcggatcgacgccggggtatagccacgacgacggaagcccgacaaggtcgacatgcgtgggtcgtcccagccatgcacgtgcttttcatccaccagttgcttgagcttgcgcttgctggtgatggtgtagttgaggttcaggcggctgaactcgtactggcgcgggtgcgccggcaccggcaggctgtccaggaaccactcgtacagcgggcgatggctttcgaactccagggtgcagatggagtgggtgatgccttcgatggcgtccgactggccgtgggtaaagtcgtagttggggtagatgcaccacttgtcaccggtctggtggtggtgggcatggcgaatgcggtacatgatcgggtcgcgcaggttcatgtttggcgaggccatgtcgatcttggcgcgcagcacgcgggcgccgtccgggaactcaccggcgcgcatacggttgaaccagtccaggttttcttccaccgaacggtcgcggaacgggctgttcttgcccggttcggtcagggtgccacggtactccttggcctgctccggagtcaggtcgtccacataggccttgccagccttgatcagctcgacggcccagtcgaacaactggtcgaaatacttggaggcgtagcgcacttcaccggaccactcgaagcccagccacttgatgtcgctttcgatggcgtcgatgtattcctggtcttccttggccgggttggtgtcgtcgaaacgcaggtgcgtgacgccaccgaactcctgggccaggccgaagttcacacagatcgacttggcatggccgatgtgcaggtagccgttgggctctggcgggaagcgggtgacgatctgcgtgtgcttgcccgaatccaggtccgcctggatgatcgggcgcaggaagttgaccgggacggcaggtccggccttggaattcgaggtagggtcgacagtgggcttgctcataggatccttgaacagacaggttcgtggccgggtcaggccagataaaacaaagggcttatcatagccgaagctgtcaaccacctgacagagcgcggtcgaaaactgctgctttaattgctgctttaatgacaggcgcggtaaaaaaccacctcgaaattcccgccaggcacgctaaactgcgcgtcttggcccaagtttcgccaaaccggtcgtggcgcccaggcgtccaaacccacgaattccctgaaaagagtagtgaacatgactcaagtcaaactgaccaccaaccacggtgacatcgtcatcgagctgaacgccgagaaagcgccgatcaccgtcgccaacttcatcgaatacgtgaaaaccggccactacgaaaacaccgttttccaccgtgtcatcggtaacttcatgatccagggcggcggtttcgagcctggcatgaaagagaagaaagacaagcgcccaagcatccagaacgaggcggacaacggcctttccaacgacaagtacaccgtcgccatggcccgcaccatggagccgcattcggcctccgcgcagttcttcatcaacgtcgccgacaatagcttcctcaaccacagcggcaagaatgtgcagggctggggttatgcggtgttcggtaaagtcacccaaggcaccgacgttgtcgacaagatcaaaggcgtgtccacgacgtccaaggccggtcaccaggacgttccagcagaagacgtgatcatcgagaaagccgagatcatcgaagcgtgatattgctgatttcagacttgcatctggaagaggaacgcccggatattacccgggcgtttctggatctgctccacggccgcgcccgtggcgcccaggcgttgtacattctgggggacttctttgaagcctggatcggcgacgatggcatgacccccttccagcgttccatctgtgcggcgttgcgtgaactgagcgacagcggcaccccgattttcatcatgcatggcaaccgcgatttcctgatcggcaaggcgttctgcaaagcggcaggcgccaccttgctcaaggacccgagtgtcgtgcaattgtatggcgagcctgtgctgctgatgcacggcgacagcctctgcacccgcgaccttggctatatgaagctgcggcgcatcctgcgtaacccgattgtgttgtttatcctgcgtcacctgcctttgggcacacgtcacaaactggcgcgcaagttgcgcagtgagagcagcgcccaggtgcgcatgaaggccaatgacattgtcgacgtcacgcctgaagaagtgccccgggtgatgcagcagttcggcgtgcacaccctggtccacggccacacccaccgcccggcgatccacaagttgcagattggcgaccaggcggccaagcgtattgtactgggggactgggacaagcaaggctgggcgttgcaggtggatgaacaagggtttcaactggcggcgtttgacttcgtcaacccgcagttggcattgcctggcgcctgactctcaaacaccactggtcaatgtgaacagagattaaactgtgggagggggcaagccccctcccacagtttaattgcatttcagccttggctatcagtggcccgaggctgctggccctgcctttgcggtaaatggcggtttggccagccacaccagcaacatcaaccccatgaacatccaccccagcaacgtgaagtaatccacggtggacatcatgtacgcctggctggtgaggacttggtccagttgcgcgtacgccttctgccctgctccaccgagcgcctggatggcatcgcgggtcgccgagtcgtagggggtcatgctctcgctcatgtaggcatggtgctggtctgcacggcggatccagatccaggtggtcagcgaggccgcgaagctgccgcccaaggtgcgcaggaaggtcgcgagcccggcgccgtcggcaatctggtgcggcggcaggtcggacatcaggatgctcaaggtcggcatgaagaacagcgccacgccaatgcccatgaacagctgcaccagggcgatgtgggtgaagtccacttcgttggtgaagcctgcgcgcatgaagcagctcaagccaatcgccaagaatgccaggcccgccagcaggcgcaggtcgaacttgtgcgcgtacttgcctacgaacggcgacatcagcaccggcaggataccgatcggtgccaccgccagcccggcccaggtggcggtgtagcccatctgggtctgcagccactgcggcaggatcaggttgataccaaagaagcccgcgtagccgaggatcaacacgatggtgccaatgcgaaagttacggtgcgcgaacaaccgcaggtttaccaccgggtgcttgtcggtcatttcccagatgacgaacaccgccagggcaatcaccgagatcaccgcaccgatgatgatgaagttggattcgaaccagtccaggtcattgcccttgtcgagaatgatctgcaaggcgccgaccccgacgatcaggctcagcagcccaacgtagtccattggctggtaactggtgaccaccgggcgtttcttcaactgcgcacgcactaccatcaccgcaaagataccgatgggcacgttgataaagaagatccacggccagctgtagctgtccgtgatccagccgccgaggatcggcccggcaatcggcgccaccaccgtgaccatcgccaataacgccagggccatgccgcgcttggcgggtgggtagacggcgatcaacagcgtctgcgtcattgggtacaacggcccggcgaccaagccttgcagcacccgaaagccaatcagctcgggcatcgaggtggagatgccgcagaggaacgacgccagcacaaacaggatggtcgcccacaggaacagcttcacctcgccgaagcgtcggctcaaccagccggtgagcggcaaggcaatggcgttgctcaccgcgaacgaagtaatgacccaggtgccctgctctgaactcacgcccaggttgccggagatggtcggcaacgccacgttggcgatggtggtgtcgagcacctgcatgaaggtcgccagcgacaggccaatagtggccatcaacaggctgggtggcgtgaacgaggcgttattgctcatcagcgttgcgcagccttgggagcggcgacgctgttgtcatggatcaactgattgatcatggcatcggcctcggccaactggcgctcatacacattggtggtgaacgacgccttttgcggcgcctgttgcgccagcaccgggccgctctggtcgtgcaggtccacattcaccacggtactcaggcccacccgcagcgggtgcttggccaactcttcggcgttgatatggatgcgcaccggcacccgttgcacgatcttgatccagttaccggtggcgttctgcgccggcaacagggcgaatgcactgccggtgccggcgccgaggctatcgacggtgccgctgtacttgacgtcgctgccatagatatccgactcgatatccaccggctggccgatgcgcatgtcacgcagttgggtttccttgaagttggcatcaatccacagctggtccaacgggatcaccgccatcagcgcggtacccggctgcacgcgctggcccagttgcacggtgcgcttggctacataaccggtgaccggcgcgatcaaggtgctgcgcgcattggccaggtacgcctggcgtaattgcgcggcggcagcttgcacgtcggggtgcgacgaaatcaccgtgtcatccaccagggcattggtggtcttcagttgttgctcgaggttggtcaaggcgttcttggcggcggtcaggctgtcgcgggcgtgggacagttcttcctgggagatcgcgccgccctgggccagggtcttgcgccggttgtagttgtcctgggcagtttgcacgtcggccttctgtgcattgacctgggctttcatgccatcgacgttgctgtacaagccacgtacctggcgcacggtgcgcgccaggttggcctgggcactttgcaggccgacggcagcatcgttggggtcgaagttgatcagcacctgaccttcgtgcaccaggtcgccatcgtcggcgccgatgctgaccacggtgccggtgaccagcggggtgatttccaccacgttgccgttcacgtaggcgtcgtccgtgctttcattaaagcgcccgtagaactcgtaccagccccacacacccagggcaccgaggatgacgatcagcgccaggccgatcagcatcactttgcgtttgcgtgggttgttgtctttgggttgttcagttgcgttgttgctgtcggcagtggccatgacaaatacctcaaattattccgtgcgtgtagctggggtggtcgcagccacgttgctggcgttgtatccgccacccagggcctgcatcagttgaatcgacaggtcgatctgcgccgcattcagggccgccagctgacgctgggcctgcagcaattgctgctcgatgctgagcacatccaggtaattaccgatgcccgagctgtagcgctgcaccccggtgtcgtacgactgctgggcgatgtcggcggcatgttgctgggcctggatctgccgcccggtgtcgcgcagttgcgagagggtggtgccaatatcgcccaaggcttgcaccagggtcttgttgtactgggccacggccaggtcgtaatcggcgtcgcgggcgtcgaggtcggcacgcaggcggccgccgtcgaagatcggcagcgaaatcgtcggtgcaatgttgaagaaacggctggccgaaccgaacatcgcgtcccccagcaacgactcggccccggcgctcgcgctcaggttgaggttggggtagaagcgggtcttgcttgcgtcgatgttcttgctcgccgcttctacccgccaacgtgctgcgatcaggtcgggacgacggccgagcagctcggcgggcaataccgaaggtacggcgacggcgctgggcttgagcaccgccggacgggccaactcgctaccccgatccgggcctttgccgagcaacaccgccagggcgatcttggcgctttgcagttgtttttccgcatcgatcagctgcgactgggagctggcttccaggctctcggtctgctggtattggtattcgctgtcgatgccggaactcaggcggcgcttgctcaggtcgagcatctggcgggtgcgcttgaggtcgtcgaccgccaggtcgcgcacgatatgcgcctggcccaggtcgctgtaggccttggccacgttggcggccagggtcaggcgtgcggcctgttggtcgacttccgcggcgcgggcctcgcccaaggcggcttcccaggcggcgcgctggccgccccacaggtcaaagttgtagttgaagctggcgccgatattacgcaccgtcgagtacgcatcgccctgcccgcgagggtcctggtccttggccaggcgcgaacgactgacgccggcgctggcatccagggttggcatgcgcgcagcgttggcggcataggcagcggcttcggcctgatgggcacgggcgtcggccacttgcatgtcggggctgttttgcagggcttcggcgatcaagctgtcgagctgtgggtcgccaaggcttttccaccagtcggcagccggccaggcagcgttcgacaacgtcatgccgccgagggatttaccggcttgcagggtattggcgtcgaggcgctggccttgtgtgtcgagaccgctgtaattggcgcaaccggccaacgtcatcgccgccagcaccaggctgaatgcgcgtgtgttcatgatttacctacccgctggatagtgatggggtcacccgcagcgatgagcattttcttcaggatccgctccagggtttccagctcgcccggttcaagtacgccggccaactggttaagggcctgggcgccgatctgcggcagcatgtccgccaggtgctggccgccggcggtcagcaccaactgcacctggcggcggtccagttcggagcgcttgcggctgagcaggtctttttgctccaggcggtcgagcatgcgcgtcatcgagccgctgtccagggacaggttgcggcacagctcggccggggtgtcgacgccgaactgggccatgatgatcaacaccttgaactgcgcggcggtgatgccgtggggttccatatgggtgtcgatgatgcggtccttgagaatcgcggcgcggcccagcaacaggccgaggtggcagttgtggaagttgtcaggggtgaagtgaggcatcgaaagtcaccttattactgcctaggcagtgaatgtgtgacgagatgttactgcttaggcagcgaatgtcaaatggaattattaggttgcttggtagttggctgaaggctggagtgaaatgaaaaccaatgtgggaggggcggtgcgacgattcgacttgctcccgatagcggtatgtcagtcaacttgtttgtagctgaccgatcgctatcgggagcaagccccctcccacattttttaccgcgtaccgatcagaaatcgcgtttgtaaaagatatccagggaactggctacgcccgtagcgacttccaggtacaccttcttgctcagcaggtagcgcaacgcaatggtgttagccggttcaaacaccccgaccccataacgcaggctgagcttctcgttgatcttgccgctggctaccacggcggtgctgttgccggtgccctgggtgtcgaggtcgaagtcctgtataccgagcttgttggcaatatccgtggtcacgccggcgctgcccatcaagcccaggcccagggcagcttcggcgagcatgttgttgtcttcgccggtgttggtgcgcgagcgccccagtaccaggtacgacagtgcgtcttcctgggccatggccggttcggagaagatctgcgtggtcggttgttcggcgctgccactgagacgaatacctgcggtgaccgtgcggctggattcggtgacaatgcgtaccgcctcgatatccaggaacggttggtccagcggcccggcgaacagcagccgcgcacggcgcacgttgaggcgctggccgtaggcgcggtagcgaccgtcgttgagccacagttcgccacgggtgtccatgttgtcgccgatatgcacatggccctggaccttggcggtgaggccgaagccggcgaagttgagctggtcttcacccacctccacgtcgatatccatggccatggccatcggcggcttgccctcttcggtctggctgccgatgatcacggtgtcatcggagaccttgaccgtcgacggcggcagttcccgcacggtgatatcgccacgggggatatggaccttgccggcaatcgccagcttgtcgtccttgaggctgatcttcaggtcgggcgccacttccagcttggcatagggctccaccgtcaccggcagttgcgagcccttgaggttgagatcaaccaccagcgcgcggccccagtcgatctggcccttgagactgccctgcccggccttgccgctgtgccagccaccgttgagctgcacgctttcgccggcgatctgcgcctgcaggttcaggccctcgaggctgatgggcagttctggcccggagacttcgccgtccaccaggttgaggttgccgttgaccaggggtgcgagcaaaccgccagaaatgcgaccactgccgttgagcttgccgttgagcgtttccaccatcggcacaaagggccgcgccacggcgaggtccaggcccgtgaggctgaaattgccggtaatcggcttgttgctcggcagcgggttgatctgcgcctgcaacagcaactcgccgagcttgccgccatggaagttgagctgggtgtcgatgcgcttggggttgagggtggtttccagcttcagggtgttgtagggaaagtccagccactggcccttgtcgcgcacgcgcagggtgccgccgctggcatccaccgacaccacgcccttggggccgctctgtggcaaatcgagttgtacgtcagcgttgagcttgccctgccaggcgaagtctttgggcaagaatgccgcgaggctgtcgatggggaattgcttgaggtggtagcgcagcttcggctcgggcatcaggcgctggtcttcgccacacaggctggcggggccggagacccagcagtgcgcgccgaaggtcagcttgccatcggccaggcgctcgatcttcgccggggcttgcaggcgccagtcctggccgccggcttgtacatcaccgctggccagacgcccgcgccagttgcctttgtcgaggttgccatccaacgccagggccagcttgagcagtgggccggcgaggtccaactggaccttctggttcttgatatcgccctgggcgctggcaatgaggttgccgacctgggtttcgccggcctgaatgccactggccttgaggtcgagcctggcacgctgggtgttatcgaggttggcgtcgaggttgagggtttgcaggcggttgtcggcaaatgccaactgctggcccttgaggtcgagcttgccttggggggctttcaaggtgccggccacatcgacgcggccattgatttgcccgcgcagttgcggccagagctgggccaggcgcgtcagcttgatgtcgatctgcccggccaggcgttgttgcaggctgccgctgccgttgatgcggttgtcaccgaggcggatatccaggttggccagggtccattgttcgccggcgccttcggccttggccgccagcaccgccgtctgcccacgcaggcgacccttgaggtcgaggtcggcgttgagcttgagctgttcattcttgaactcgcccttgctgcgcagcggcccggcgagggtgccgggtaactcggcgacccagtacgccgggttcagggccgacaggtccagcgccatatcccaggcaataccgtcggcaaattgcagattcaggtggccttcggccttgccttggccggcggtcagcttcaactcgggcaagaagacttgcttgagatcgccactgaaaggcgtgaccagattgaatttacccgccgggccgtcgagatcggccttgaggttgccaaggtaattgccgtccttataagagatttcaccgttgaaggtgcgcaatacaacctgcggctcgtcgattaccggatacaggcgatgccaggggaagtccagccagtcgatttttgcgtcagcactgaagccttgttgccagtcgaggttggcactgagcttgaggctttgcttgtcgccggcattcaagtccaggccggcgatctgcgcgcccttggcgtcgaccttaccttgcagcagcaagtccaccgggcctttttccgccggcagtacagctttgcccactaactggtagccgcttttcaggtcacccttggcactcaggtccagttggttgagttgcagggtgtcaggcagatccgcgtcgggcttgaacgcctcggaggtgatgtgcaactgcgccggcaggttttccaccaggggttgcaattcgccgctgagcttggccggcaggtagccgctgctgtcagcgtcgagcttgagggtcttgagcaggtcgccgtcgatcttgagcgctaccgtccagggtgcaccgcctggggcgtagggcaggctcaggttgccgctggccttcagcggccaatcgccactgggttgcagcaggccggcaaggtccagcaccaggtcgtcgcgctgcaagtgcaccgagtcgatacgcaggcccatggcagtccagtgcgccgccagttgcaggcccttgagttcttcactgccgttgaaaaccaggctgccgatgcgaacgtcgcctaactgtacggcaaccggtaatgttagttcgggcagttgaatcggcccgctgctgctctcttcggcactggatgcaaattccaggctgacttgctccacgtccagcctgttgatgcacagggtcatgcgtagcaggcagccgggcgaccagtcaaaggtcggcgccttcaactcgacgcggctgccgtcctgctgccacaacacatgatcggcgctccactgcccgcccaggcggccctggaaatgctccacactcaagcccggcacctggcccatggcccagcgactgcccgcctgggtacccagtaccgaccagagcgccaacaacagcaaagcgaggatggcgaccagcgccagcccggctattttcaaaccacgcatcaaagctcaggccccatggaaaagtgcaatcgaacgccgcccggatcttcgagggcatgggcaaggtcaaggcgaatcggcccgaccggcgagacccagcgcacgccaacgcccacaccggttttcaggctggggaagtccaggttattgaaggagttgccctggtcgacaaaggtcgcgatgcgccatttgtcggtgatggaatattgatactcggcgctcaaggccaccatatagcggccgccgatgcggtcgccgcggtcgttctcgggcgacagggtctggtactcgtagccgcgcacgctctggtcgccaccggcaaagaagcgcaacgacggcggcacggacttgtagccgttggtggcactgccacccaattgcgcacgccccagaaaacgatggttgtcccacaaggtggtcaggcccttgatcgtggccgtgccgtaaagcaggttggtgtcggaccccaggccctccttcgcgaccttggtgtcaaacatcagccggtagccatggtgcgggtcgatgcggttgtcgctgcgcaggtaagaataactgacccccggcatcaccaggttactcaaacccgagtcgttgcccaggcggtattcttcgcgctggtacttgagggaaatcacccgcgtccaaccgctgggcaatttgctgtgccattccgggccgatggtgagcagcttgctcaaagtgtcggtgttggcgatctcttcattctgatagccgccggcaaagcgcaatttgtcggtgagcggtgggtccagggggatgtcgtaccacaggccgacgttctgccggggcgccgacaactcggcttcccaaccataactatggccctgggggttgacccaatgccgtgtccagttggctttgccccgtgggccgacgtcggtggagtaacccaggcccaggcccatggtgcgcggcttgcgggtttccagctgcacggcgaccgggattacatcattggtcgcggcggtggggctggcatccaccctcacgccttcgaagaagccgctggcttgcaggttctggttaagttcggcgatcagttcagagtcgtacggcgtgccgctgttgaacggcaccatgcgttgcagcagttcttcatcaaaaggcgtgtcgccgctgaagctgaccttgcccatgctgtagcgcgggccgctgtcgtaaatgagttcgatatcggccacgccggcctgggggtccaccgccagcttctggctggtaaagcgcccgctgaaaaaaccgtagcgcgaagcctggttctggatcaggcgcttggcgtcttcgtaatggccgtggttgagcaccgcgccggatttgaggtcgtcgctggcaggcacgcgaaaagccttgaggctcgcggcctggccatcgacccgaatggtcacgtcgcgcagatgcaccggttcgccggagtcgatggtgagcgtcaggcgcgggttcttcccgccccttacatcactggcgatccgtggctgatagtagcccagggcctgggccgctttacgcgcctgctcctcggcgccgcggctgaaccgcagcaaggcttcttcatcacgatcgcccaccccgccgatatagccttcgatgttggctttcaacgcgtcgtttgagggtttgacccgcacgtccaattcgctttgcgcgaatgcgccgcagcttgtgaacagcagaatcaagccgctggtaaatcttcctggaaacttcataggcgcggatgctacacgagctggggagagtctttgaacccggatttgtctgaataattctgtctaagccgttgcagcatgtaacgcctggggattgggatggaaaaacacatgttccagcaccgggcctacggcgacttcgccgatctcttcatagccttggcgcttgtagaaatccaggtagcgggagttgccagtgtcgagcaccacccctgaggaatgcgggtcatcggcgcaccaattgtgtacggcttccaatagttgctcaccgaagtgcttgccctggaactgtgggtgaatacccaacagcggcaatacatgcaccgactcgctgggcaggcatgccaggaccgcctgatggtattccaggtaacgccgcgtgccgcgcacgccggtactcagccacatgcggatctgccacgcccaactctcggtaatgccaaggcgccgctggggcggtgcaatcagggcgatgccgatcagccggtcgttgacgaacaggccgatggcgggaagcttctggaagaagtgctgcttgaccagttcgcgcacggtggcgcgtacccgttgctcataacccggccgctcggcttcgaagatgtaggcgaaggtcggctcgtggcgatacgcctggtaaagcagggatcgcgcctcgcgggagtaaccgctattgagcaggcggatgtcggcaatggccgtcgaagtgtctggcataacagtcaatctcctgggcgccactcaaacatggcgttcttatgggtacgaacctgtacagctccagtcgttcccagacattagcagcgcattcacccgaccgccacgctggcccccgccggacttgtcggctagcatcgcccttttgccagactggactgccgaccatgaaaatcgtctccttcaatatcaacgggctgcgtgctcgccctcatcagctggcggcgctgattgaaaagcatcaaccggacgtgatcggcctgcaggaaaccaaggtccacgatgaccagttccccctggccgaagtgcaggccctggggtatcacgtgtattaccacgggcagaaaggccactacggtgtggccctgctctcgcgcaaagaagccctgagcgtgcacaaaggttttgccagcgatgaagaggacgcccagcggcgttttatctggggcaccttcgccgatgaaaacggccacccggtgaccatcatgaacggctacttcccccagggtgaaagccgcgaccatccgaccaagttcccagccaagcagcgcttctacgcagacttgcagcacctgctggaaagccagttcagcaatgatcaggcgctagtggtgatgggcgacgtgaacatttccccggaggactgtgacatcggcatcggcgccgacaacgccaagcgctggctgaaaaccggcaagtgcagcttcctgccggaagaacgcgagtggatggcacgcctgaagaactggggcctggtggacagcttccgccacctcaacccggacgtggccgaccgcttcagctggttcgactaccgcagccgtgggtttgaagacgagcccaagcgtgggctgcgcattgacgtgatcatggcgtccaccggcttggtaccgcgggtcaaggatgccggggtggattacgatttgcgtggcttggagaagccgtcggaccatgcgccgatctggttggaactgagctgactccccgattgtactcggtcaaatatgggaggggcggtgcgacgattcgacttgcccccgatgacagtgtgtcagccagctcatctgtcgctgatacaccgctatcgggggcaagccccctcccacattttgaccggctgagtgtcagtcacattgctgcaatccaactgacttaatctcgcggcactccctttggcttgagaaggtgccggcatgaggctgcgcgttctgttcctgtgctttgcgatctccctgcccgccgtggccgcaccccttgccgtccccgaccaaggcccagcgctgcgcatccagggttccaataccatcggggcggcactcggcccggcgttggtcaagggtctgatggagcatcaaggcctgcagggtgtacacagcgaaccgggtgacggggcaaacgaacaacgggtggttggcaagacgcgccaaggcaagaccgtgaccatcgcagtggctgcccatggttccagcaccggttttgccgcgctgaaaaacaaccgcgccgacctcgccgcggcgtcccgcccgatcaaggacagcgaactggtagacctcgaatccctgggtgacctgaaaagccccgaagccgaacaggtgatcgccatcgatggcctggcaatcatcctcaacccgcgcaacccactcaatacgctgaacaccgagcaactggcgcagatcttcaacggcgaggtcagcacctgggaagcgctgggcggcattggcggggcgattcatgtctacgcccgggatgatcagtccggcacctacgacaccttcaaggaattggtgttgagccgacgcggcaaaccgcttgccgggaccgcacagcgtttcgagtccagcgaggcgctgtccgatgcggtcagtcatgacccccagggcatcggttttatcggcttgccctatgtacgccaggccaaggcagtggcgattgtcgacggcgactcacaaccgatgttgcccttgaccagcttgattgccaccgaggattacccgctgtcacggcgactgttcttttacctgccgccctcctcccacaacccctgggccagggcgctggtggacttcacccaaggcagcaagggccaggcaatagtcgccgccaatggctttatcgcccaacaagtgcaggcgattggcgtggcgccacgcccgtcaatgcccgacgactaccaggccctcgcccgtgacgcccagcgcttgactgtgaattttcgtttcgaggaaggtagcgccagcctcgacaacaaggcgcgccaggatttgcagcgggtggtggcttatataagaagtcacggcaagctcgataaacaggtaaccctggtggggtttggcgatgccaagaatgatccgcaacgtgcggcgttgctgtcgaagctgcgggctatggcagtacgccgggagctggtcaagagcggcgtggtgcccagggatatccgtgggtttggcgcgcagatgccggtagcggcgaatacggcggatgaggggcggatcaagaatcgacgggtggaggtttgggtgtactgagccttggagtttgaggtgtttggactggcctcatcgggggcaagccccctcccacacttggattcgtgaatacagtcaaaatgtgggagggggcttgcccccgattgcaggcgacgcggtgctactgcccgccgcgcatcaattcccgaggcacatacttgccaatctcaaacttgccaatcgccgcacgatgcacctcgtccgggccgtcggccaggcgcagggtgcgttgcatggcgtacatataggccagcgggaaatcattggaaaccccggcgccgccatggatctggatcgcacggtcgatcaccttcaaggctacattcggcgccaccaccttgatctgggcgatttcgcttttcgccactttattgcccacggtgtccatcatgtacgccgctttcaaggtcagcaggcgcgccatgtcgatctccatgcgcgagtcggcgatcttgtcgatattgccccccagacgcgccaaaggcttgccgaacgcggtgcggctgaccgaacgtttgcacatcaattccaaggcgcgttcggccatgccgacggagcgcatgcagtggtggatacggcccgggccaaggcggccctgggcaatctcgaagccacgcccctccccaagcagcacgttttcgtagggcacgcgcacgttgtcgaacagcacttcggcgtggccgtggggcgcgtcgtcgtagccgaacaccggcagcggacgcaggattttcaccccgggggtgtccacagggacgaggatcatcgagtgctgctggtggcgcggtgcatccgggttgctcagacccatgaagatcaggattttgcagcgcgggtcgcaagcacctgaagtccaccatttcttgccgttgattacccactcgtcgccctggcgttcggcgcgggcagccatgttggtggcgtccgaggaagccacgtccggttcggtcatggcgaaggcagagcgaatctcaccgcgcagcagcggttcgagccagcgctgtttctgctcttcgttggcgtagcgcaccagcacttccatattgccggtgtcgggcgcggagcagttgaacggctccgggccgagcaaggacctgcccatgatttccgccagcggtgcgtattcaagattggtgagccctgcgcccagttcggattcgggcaggaacaggttccacaagccctcggccttagccttggccttgagttcttccatgatggcggtgggctgccagcgatcaccttcgctgacctggcgctcgaacaccggctcggccgggtagacgtaagcgtccatgaacgcggtgacacgttcacgcagttcctgaaccttgggcgaataggcgaaatccatgggcagctcccttctctgagaggttgtttaggtcatgcaatcgatgctagaacagcgttgataatttacctagcctattctcggcgtgtattaacattcatcaccgatatatgatcggcgtatggacacctaacaataagagcgcaacgaaatgaatctgagcaaggtcgacctcaaccttttcatcgtctttgatgcgatctacaccgaagccaacctgacccgcgccgggcaaatcgtcggcatcacccaaccggcggtgtcgaacgccctggcacgcctgcgcgagaccttcaacgacccgttgttcgtgcgcaccgcccaaggcatggtgcccacgcccatggcgcagaacatcatcggcccggtgcgcaatgcgctgtcgttgctacgggtgtcggtgcaggaaagccgcatcttcaacccgcagcaggcggccaagacctaccgtatcagcatgaccgacctcaccgaggcggtgatcctgccgcagctgttccagcgcctgcgccgcctggcgccgaccgtggtgatcgagagtttcctgtccaagcgccgcgaaaccaccaaggaactggcggccgggcgcctggattttgccgtggacgcgccgctcaacaccgacccgcaggtgcgccacgtcaagttgatggaagaccgctacgtgtgcgcaatgcgcaagggccacccgatggcgggcaaggacaaattcagcctggatgactacctgtcgctgacccatatccatatctccagccgccgtaacggtttgggccacgtggacctggccctgggcaagatgggcatccagcgcaagatcgccctgcgctcccagcattacctgatggcctcccaggtgttgcagcagaccgacatggtgatgaccgtgcccgaacgcttcgcccgccgccatgaactgcactggttcaatttgccggtcaacgacgtaccgctggtagaaacccacctgtattggcatgaaagcactgaccaggacccggcgaaccgctggatgcgcgagcagatgatcgagctatgccagcaggtgacggcccatgaaaagaaactcgataaacaacaagcctaaagttgcagaagtccccctgtgggagggggcttgcccccgatggggcgcgcagcgccccttgacgtttacgtcaacctccaattagcttagtgccaagaccttcttgagcaccgccatgagcaccacctacagcatctccgacctcgcccgcgagctcgacatcaccacccgcgccattcgcttctatgaagaacaaggcctgctggccccggaacgccgtggccaggagcgcatctactcggcgcgggacaaagtcagcctcaagctgatcctgcgcggcaagcgcatcggcttttccctggccgaatgccgcgagctgatcgaactctacgaccccaccggcggcaaccagatccaactcaacagcatgctggccaagatcgccgaacgccgtgaacagcttgagcaacagttgctggatatcgaacaaatgaaactcgagctggacaccgccgaggagcgatgcacccaagccctcgcgcataccatcagccaagccggccattgaccagaaggtaactgccatgtccctcccctcacacgtacgcctggtggaagtcggcccgcgcgacggtttgcagaatgaagcccagcccatcagcgtggcggataaggtccaactggtgaacgccttgagcgaagccgggttgagctatatcgaagtcggcagttttgtctcgcccaaatgggtgccgcagatggccggctcagccgaggtgtttgcacagatccagcgcaagcccggcgtaacctatggcgcgctggcgccgaacctgcgcgggtttgaggatgcgctggcggccggggtcaaggaagttgcggtatttgccgcagcatccgaagcgttttcccagcgcaatatcaactgctccatcagcgagagcctggcgcggttcgcgccgatcatggccgcggccaggcagcatggcatcagcgtgcgggggtatgtgtcgtgcgtgttgggttgcccgtacgaaggcgctatcgccccagagcaagtggcagccgtcgcgcgtgaactgtatgccatgggctgttatgaagtgtccctgggcgacaccatcggcaccggcacggcgggggcaacccggcggctgttcgaagtggtcggcgcccaggtaccgcgggacaaactggccgggcatttccatgacacctacggccaagccatcgccaatgtctacgccggtctgctggaaggcatccaggtgttcgacagctctatcgctggtctcggtggttgcccttatgccaagggcgccagcggtaacgtcgctaccgaggacgtgctgtacctgctcaacggcctgggtatcgacacgggtatcgacctggagcgcttgattggcgcgggccagcagatcagcagagtgctggggcggccgagcggttcgcgtgtggccaaggcccgtagcgccggatgaagtagcacagctgtgacaatgtgttaccgcgcgcctgttcggcgggtaacgcgggaacagaatttagcgcacatacgtaaagacatttcccacgaaaaaactaaccttttgattttaaaggcttttaaaaagttggcacgcctcctgctatctctatggcataacaagaataaaaagcaccaaacctaataaaaataagacgaaacgactctgacataacaaaaacaacacggcagagacgcagctaacagatttttttggagaagatggcttcccagggtacggcatgccgcaacccgcaaccggatagagaaaaataaaactacctcaggtagctacccactggttggatcgtttacgaagaagcaggtcagcgttcaaaaaaatacgtttgctcttgaccccggatgggggtcgccaaaaacagcggtacgggccacggctaccaaaaacaacaacaggccgcccctcaataataagaaaagagcaggcaacgacaaattaaaaggggaccttcgggtcccctttgtgctgtctgcacgtgcggtttgttacccgtaccctcaaagcggcgcgacgggattgccctgtagattgactcgatccgggtgctgtatggcatagccgggcaaggtcgtgatcccattcgtacgcagatcgatccaggccaggttgccaggcacctcgacacctgccgggaataccctggtgccggtattttccagatagagccgctgcagatcacgcaggttgctcaggtcggcggcccagcccaactgccggttatgggagaggttgagggtcttgaggccctgcatattctgcaggcgttcacgactcggcgcggtcagacgaatgtcattgctgctcaggtcgagccaggtgatttgcgcgcccccatcgacgaactccggcaagcgcgtgaggttactgtggctgatatccagccaacgcaagccgctgaatgactgcaagaaaggtaaagaggcgtccgaaagtgacattctcgctaaatccagacattccacatggctcatgttcgcggtgatcggcggcaaatcaccgacttgctcgtcggccaagcgcacgacatacagcccaccctcctcttctcgtagctcagagcgcatttgctcaggactcatgggcaagtgtggaggtgaacgctgccaggcattcttgagagtattgacgacccggccccttgatcggcgataagtcgtgtcttcgtcatgccaggcgtccagtgtcgccttcagttgcgtgaactcctcttcgagttggtccatgcgggccaaaaacacatcatcgctggcgtcttgcagcttcagcgtccactccacctcttcgatggattgtgacggatagagcgctgaggctgcctgttcgcagggagcggatcgaatgcccacaggactcaacggatagccgatacgtccctccgcaaggcgcatgggcggtttatacccaggcttgatcggctgcatgcgcaacaacctgcgcaattgttcacgaggcatcaaaggcatctgctccagcgcctgtttcaggctcgcgcctccatccagcgcggtcagtttcattgcagtccagtcctcaggcgggaccgctgactgtaccgcctcatagatatccgcctgggcattgaataccgccagcttgttatcctgtacttcataaaggttcatgggaccaaacttgataagacgccgcttgatcgccgcgtcctccggccccgatgagtccagcaggcgctcccccgcaggcaaccgttcgatgacgtcgatgcgcaagcccgatggccagccgggcagcttgtccaggctgtgcagcaccaagcgttgcgtgtcgtcattgcccagggtattgcggtacaagccctcatacgcccgcgccaggcgcacctgctgttgataatggcgggcctcttcagccaggcgcagtggcacgcgatcctgctcggtgagcacctgcatttcggcggcgctggtttcgtccaacagctcttcgacaatcgccttgggtaatgacgggaataagcgcctgatcggccatgcggccgcgctttctgcgcgctcggcagcggcatagcgctgggtaaagcgttcgagttgatccgcagctcgcaatgaggggcgtacgctggagccttcttcagccaccacacggtcaatctcgaaccgcttcaaggtatcggccaatagccccggcagtgctgcctgatgcacatgtatccggcgcagcgcatccacctcaacgccagacatttgcatgatgcgtttgagcttgagcggctgatctgaaaagccctctgccatcggccccaagcggcgcatcaactgtgactcggtcagggtcagcgggatctcgtgctcatgagcccaggccccggtgcgcgtgcggcttacccttggggtgaaggccaaaggatcatgcggatgcaggatcttgtagtcattgcccgccccaacttgctccacccggtaataggcattgtcttcgcgcaggtacaggcccccttcatgttcaatcagcccgtcaccattcaccgtaagctgcgcgggcatcgacacggattgctggtatggcctcaggtcaggagcatgcaggcgtatgttgccatcggggcaacgcacatgggccaggctctcgacaaaggcgctcttgaccaagggcaataacctggcgcctacaacggccgtcgccgcattgaaagcaacggctgaaacgtgagcccacaccgcttgcttatcccccgcctcccacgcctcaatacccgatgcgacctccttcagtatttgcgccgcgccgatcatcagcatgaccggcgccagctctggaaagaccagcacagccgcattcaggacattcagcgccgtgctgcccagcttgaccagccaggcgttacgcgcacgtgcatccgccgcgtcggtggagacggccatggcccgggcgttgctgcgcatcaggtcgatgttttgccgggtatggtcctgccacaacaaggcgtagcgcgttccgtaacttgcggtgagggtcctgatatttttcttgcttgagtcaaagtcttgagactctgtcgactgctcagcggggtcgagatgctgcttgagcctggaaaaaaacgccccttgccgctcataggggatgaactggctgaaaaactgccggtagctggccacgcacagtcgctcgaccaaatcaaacttgagcgcctccaggttggcgtattccttcaacatgcaaacagggtcgccgggtataaacgccaggcagggctcgctcaagaacaccacattgccacgtatggggtagtgaatactcacatgcccgatgacgataatttgtttaagcgactgcccaaggacgttcaaactcgaaaaggtaactgttttatcgcgccattccagatcctgctgattgctcatcagctgttgtatcagttgatacgcatccggctggatatccccacgcgccaccgcgacttcggcggcgaattgcagctgatgccgggtcgcactgaccataagattacgcacggccctggccctgctccccctgggggttcgaggggggtccagtggactgatgaacgactcgacatgggccaggtactgcgcacccaggtccaactcccgacacaggctggcgaatgcatgaggcgctatggtgactttacggctaagcacttgcgactgattgaatgggctgccaggcggctgctggtggaaatcgtagcgcgtgacgaggctggcgttctggtcgtcggtctcaatcgtgtcttccaaggcaaagttacccagcgccgcttcgagcaggctctctccctggtagtagcaatacccggaagcttccaagccctcgacctttgaacgatcggcgggcatgaacgcctcacgggcataaaacagccgttttacgtcatagtctgcggcaaacttcgccttcatcgccgccaccaggagcggctcggcaaacgcgaccacgccttgtaacccgttgaaaatcacatcgagcctgttcagcgaattaaagctgcgtgcataagcggcactcagtgccggttgtctgtccggcgaaagcgctgcgtaccatggcggcatttcgaactgcgtctgtgaaaaggccttcttgcgtttcagggcggcggcgtcataccaggagggctgccggtcctgtataacccgcgcatgcacgctctgcggcgctactgattgttggctgggaggttgatcaagctcactcatttaccgcatccatttgatagaacaaaagatcaatctgcgatcatttgcccttcaaacagcggtattcacctaccccaggtcgtcgcgggcagcctccaactcctggatactgatctcgcgcatgcgaaatttctggatcttgcccgtcaccgtcatcggaaactcgtccacaaacttgaagtgcctgggcgtcttgaaatgggcgatacggtccttgcaccagctcaacagttcaagctcgttggcgacatgacccggatggaacttgatccacgcgacgatttcttcgccataacgctcatcggggatgccgatgatctgcacgtcggcgaccgccggatgggtgaagaagaactcttccaactcccgtgggtacacgttttcgccaccgcggatgatcatgtccttattacgcccggcgatgcacacatagccgtgctcatccatggtcgccaggtcgccggtgtgcatccagccggcgtcatcgatggcctcgcgggtgccttcggggttgttccagtaaccgagcattacactgtagccacgggtgcacagttcgcctatcacgccgcgcgcgacggtgttgccggcctcatcgataatcttggtttccagttgcggttgggtgcggcccaccgtggtgacgcgccgctctatatcgtcatccgcgccagtttgcagtgagaccgggctggtttccgtcatgccgtaggcaatctgcacttcactcatgtgcatttcgttgatgactcggcgcatcacttcgatagggcatgtcgccccggccatgatcccggtacgcaggctggacaagtcgaactcggcgcggcgtgggtgatcgagcatggcgatgaacatggtcggcacaccatataagccggtggctttttcttcggcgacggcactcaacgtcagcagtgggtcgaagccatcattgggatagatcagggtggtgccgtgggtgatgcagccgaggttgcccatcaccatgccaaagcagtgatacagcggcaccgggaccaccaggcggtcctgcgcagtcaggcccaggctttcgccgaccatgtagccgttattgaggatgttgtggtgactgagggtggcgcccttggggaagccggtggtgccggaggtgtactggatattcacgggctggtcaaagtgcaggctggcctggtggtggtgcagttgctcgggcgggacaccggcgcccaggcccgacagctgcgaccagggcatgaagcccggcggcgggctgggatccaggctgatgaggccatgcaaatcgggcttcagcgcctggagcatggcgtggtaatcggaggtcttgaacgctccggcgcacaccagccactggcagccggattgcttgagcacatagtccaactcactgctgcggtacgccgggttgatattgaccaggatcaccccgagcttcgcgctagccacctgacagatcagccactcggcgcaattgggtgcccagatgcccaggcggtcgccggtttgcatgcccaaggccaggaatgcccgcgcatgcagatcaaccgtctcggccagttgccgccaggtgaagcgctgctgttggtggcggaccaccaaggcttcgccatcgggatattgcgcggcggtgcgatcaaaggcctggccaatggtcatggccagcaaggccttgtcctgggagccacggctgtagctctgattcggttgatccataacgacccctgttgtcttttttgtaggttgacgtatacgtaaactacgattgacagcgccgtaacgcaagcttacgttaacgtaaaggtgagcgccctcccctggcgcccaacctacacaacaacaaagctcacattaaggtgcctgtccatgaattacccgtccctgaacttcgccctcggcgagaccatcgacatgctgcgcgaccaggtgcaggccttcgtggccaaggagatcgcaccgcgcgcggcccagatcgacatcgacaacctgttccccgccgacctgtggcgcaagttcggggacatgggcctgctgggcatcaccgtgccagaagaatacggcggtgccggcctgggttacctggcccacgtggtgagcatggaagaaatcagtcgcggttcggcttcagtggcgctgtcctacggcgcgcactccaacctgtgcgtgaaccagatcaaccgcaacggtaaccacgagcaaaaactcaagtacctgcccaagctgatcagcggcgagcacgtcggcgccctggccatgagcgagccgaatgccggctctgacgtggtctcgatgaaactgcgcgccgataaacgcggcgactgctacgtcctcaatggcagcaagacctggatcaccaacggccccgacgccaacacctacgtgatctatgccaagaccgacctggagaaaggcgcccacggcatcaccgccttcatcgtcgagcgcgactggaaaggcttcagccgcagcaacaagttcgacaagctgggcatgcgtggctccaacacctgcgagttgtttttcgatgacgtagaagtgcccgaagagaacattctcggcgtgctcaatggcggcgtgaaagtgctgatgagcggcctggactacgaacgcgtggtgctgtccggcggccccaccgggatcatgcaggcgtgcatggatctgatcgtgccctacatccacgaccgcaagcagttcggccagagcatcggtgaattccagctgatccagggcaaggtcgccgacatgtacacccagctcaacgccagccgcgcctatctctacgcggtggcccaggcttgcgagcgcggcgagaccacgcgcaaggacgccgccggggtgatcctctacagcgccgagcgcgccacgcagatggccctcgatgcgatccagattctcggcggcaatggctatatcaacgaattccccgccggccgcctgctgcgcgacgccaagctgtatgaaatcggcgccggtaccagtgagattcggcggatgttgattggccgcgaactcttcaacgaaacccgctgaaggagcgcgtcatggccaccctgcatacccagctcaacccacgctcggcggagttcgccgccaacagtatggcgatgcgcgaacaggtcgacgccctgcacagcctgctcgcccatgtgcaacaaggcggcggcaccaaggcccaggagcgccacacctcgcggggcaagttgctgccccgtgagcgtatcaatcgcctgctcgacccgggctcgccgtttctcgaactcagccagttggcggcttatcaggtgtatggcgaagacgtgccggcggccggagtcattgccggcatcggtcgcgtggaaggcgtcgaatgcatgatcgtcgccaacgatgctacggtcaaaggcggctcctactacccgctgaccgtgaaaaaacacctgcgcgcccagaccatcgccgagcagaaccgcctgccgtgcatctacctggtggactccggcggcgccaacctgccgcgccaggacgaggtgttcccggaccgcgagcacttcgggcggatcttcttcaaccaggccaacatgagcgcccagggcatcccgcagatcgccgtggtgatgggttcatgcaccgccggcggcgcctacgtgccggccatggccgacgaagcgatcatggtgcgccagcaagccacgatcttcctggccgggccaccgctggtgaaggccgccaccggtgaagtggtcagcgccgaagacctcggcggcgccgatgtgcactgcaagatctccggcgtggccgaccactatgccgacagcgatgaacatgccctggccctggctcggcgcagcgtggccaacctcaattggcgcaagcaaggccaattggtgcaacggccgccagtggcgccgctgtacagcagcgaagagctgtacggtgtgatcccggcggatgccaagcagcccttcgatgtacgtgaagtgatcgcacggctggtggacggctcggtgttcgatgagttcaaggcgttgttcggtaccaccctggtctgcggcttcgcgcatttgcatggttacccgattgcgatcctggccaacaacggcatcctgttcgccgaagccgcgcagaaaggcgcgcactttatcgaactggcctgccagcgcgggattcccctgctgttcctgcaaaacatcaccggcttcatggtcggccagaagtacgaagccggcggcattgccaagcatggcgccaagctggtgaccgccgtagcgtgcgcgaaggtgccgaagtttaccgtgatcatcggtggcagctttggtgccggtaactatggcatgtgcggccgcgcctacgacccacgcttcttgtggatgtggcccaacgcacgcatcggcgtgatgggtgccgaacaggccgccggggtgctggtgcaggtcaagcgggagcaggccgagcgcgcaggcgacgcgttcagcgccgatgaggaagcggcaatcaagcaaccgatactcgaccagtatgaaacccagggccacccctactactccagcgcgcgcttgtgggatgacggcgtcattgacccgttgcagacccgcgacgtgctggccctggccttgtccgcttcgctgaacgcccccatcgagccgagccgcttcggcgtgttccgcatgtaacctgcaggagcgagcttgctcgcgaagaacgtcagggcaacgcgaacctccagaatacccgcgttatcgttgacgagcttcgcgagcaagctcgctcctacaggaggcctctcattatcatggagctccttgcatgaacgacttcaacaccctcgaactgatcactgacagccgtggctttgccacgctgtggctcagtcgtgaagccaagaacaacgcgttcaacgccgagatgatccgcgaactgatcattgccctggaccgggtgcaaggcgacccttccgtgcgttttttgatattgcgcgggcgcggcaagcatttcagcgccggcgccgacctggcctggatgcagcaatcggccgagctggactaccacaccaacctggacgacgcccgtgaactggcggagctgatgtacaacctgtccaagctgaaaatccccacgctggccgtggtgcaaggcgcggcctacggtggcgcgttgggcctgatcagttgctgtgacatggccattggcaccgacgacgcgcagttctgtttgtcggaagtgcgcatcggcctggcgccagcggtgatcagccccttcgtggtgcaggccatcggccaacgcgctgcccgtcgttatgccctcacggccgagcggttcggcggccagcgagcacgggaaatcggcttgctggccgagagttatccggccgaaaccctggatcagcaggtagaccaatgggtcgaaaacctgctgcaaaacagcccggcggcgatgcgcgccagtaaagatttactgcgcgaagtgggcaacggtgccctcacgcctgcgctgcgacgttattgtgaaaacgccatcgcgcgcattcgggtgagcgccgagggccaggaaggtttacgtgcgttcctgcaaaaacgtgcaccgagctggcaagcccaggagccgcgttcatgagcacactcaccaccgtattggtggccaaccgtggcgagatcgcctgccgggtcatgcgcaccgccaaggccatgggcctgaccaccgtggccgtgcacagcgccatcgaccgcgatgcacgccatagtcgcgaggcagacatccgcgtcgacctgggtggcagcaaagccaccgacagctacctgcaaatcgacaaactgatcgccgccgcccacgccagcggcgcccaggcgattcacccaggctacggtttcctctcggaaaacgctggcttcgcccgcgccatcgaagacgccgggttgatcttcctcggcccgcccgcctcggccatcgacgccatgggcagcaaatcggcggccaaggccctgatggaaaccgctggcgtaccgctggtgccgggttaccacggcgaggcccaggacctggaaaccttccgcgccgcctgtgagcggatcggctacccggtgctgctcaaggccacggccggcggcggcggcaagggcatgaaggtggtcgaggatgtcagccaattggccgaagccctggcctctgcccagcgtgaagcgctgtcatccttcggcaatgggcagatgctggtggagaaatacctgctcaagccgcggcatgtcgagatccaggtgtttgccgaccagcatggccactgcctgtacctcaatgagcgcgactgctcgatccagcgtcgccatcaaaaagtcgtcgaagaagccccggcgccgggcttaagtgtcgagcaacgcaaggccatgggcgaagcagccgtgcgtgcggcccaggccatcggttatgtcggcgcaggtacggtggaatttctgctggatgcccgtggcgagtttttcttcatggagatgaacacgcgactgcaagtggaacacccggtgaccgaggcaatcaccggtctggacctggtggcctggcagatccgggtggcccagggcgaggcgctgcccatcactcaagaccaagtgccgttgatcggccatgcgattgaagtacggctgtatgccgaagacccggccaatgacttcctgccggccaccgggcacctggcgctttaccgcgagtcccgcccaggcccgggccgccgagtggacagcggcgtcgagcaaggcgacgacgtgtcgcccttctacgatccgatgctgggcaagttaattgcctggggcgaagaccgtgaacaggcgcgtttgcggttactgagcatgctcgacgagtttgcagtcggcgggctcaagaccaacctgggctttctgcgacgcataatcggtcatcccgcgtttgcggccgccgaactggataccggctttatccctcgttatcaggatgagctgttaccggcgcccggtgcattaagcgatgcgttctggcaggcggcgggctcggcgtttatgcagagcctgccgatgggcgatggcccgtgggccaataaccagggctttcgtgcgggcctgccggccgaggtttcgctgcacctgagctgcaatgggcaggatcggctggtgacattagcggggcacacgccacagctgtgcggcgagcagttgctgatcgagcaccaaggggtgtgccgtgctcacctggcggtccgcagtgcaagcagcctgtacctgcgttgggacggtgagatgcatgcggtcagcctgttcgatccgattgcggcggtggaggcagggcaatcccatcagggcggccttagcgctccgatgaacggcagcatcgtgcgcgtattggtagaggtaggccaaaccgtcgaggctggcactcaactggtggtgctggaagccatgaagatggaacacagcatccgtgcgcctcaggccggggtggtcaaggcgctgttctgccaggaaggtgaaatggtggctgaaggcagcgcgctggtggagcttgaaacggccggctagaacttcgccgtggcttgcaccaccacgcccaggatgcggcaatcctcggtgagcagcgccttggggtaagtgggattgagcggcaccagataacgctggccgctttcttcctgcaattggcgaaaggtcgcctggggactgccagcccattgggcaaccaccagtttcccggggtcgggctcgatggccgggtccaccagaatcatcatcccggcaccgatgctcaggcccgtgggcgcggtcatggcgtcgctcgtcaccggtagccagaacgccttgccttgagcgtggtaatcggtcaattcgtagcgactcgttccataggccgcacgctcctcgcgcaactcgcacgcctgcttccagtcgctgaccgggtagcgaaaatacgggttgtagcgtcgttccaacgccgcctctgttgcggcccgctcgcgaatctcgagcgccacttccaggtcccccaaccccagctccgcgagcacccggttcatgtccgccaggctcggtacacggcgcttgttgagccagtggccgacaccgccctgggacatgcccaggcgctccgccaattcgccttgcgtgaccttgcggtctttcatgttggctttgaccaacgctatccatttgtccatggcgcctgacgatacgacgtgtatttttcagggcaataaacagtttgtagtaatccataaaacgacataaatacgatacgtactatcatcaagcctaaggatttcgacacccaccggagtactgccgcttatgacgaacagcccgtatcccttgcccgaaacacctgaacacattgaattacacgacatgcacaacagcggtgcggcccagcgcgcgctggattattacttgaaagaagaaatgtcggcgccgacccagggtgacgccatgttcgtgatcaaaccgggcatcagccaggaggaagcgctggtgcatgcctcggacctgttgcgcagtgcagcggccaccgcctatgaatcagcgtgcagccatcaaggcaatcaacgcgacctggcgttttccgtggtttatttgattgatatggccaaggcgatggtggagcggtcgttgcaagggccagcggctcgggcaaacgcgtaacaggcggcaaggaaaaatatttctatcccacggataaaaacatttgacttgcaaatgataatgattattattggacccagctgatcgcgagatcagtcgatagaccaagagaccttaggtcggactcttggaatatctcctcatcaggctaatcacggtttttgacccggctctttggccgggtcttttttttgccagtttccctggcgtggcttcaggctaatgaagactgtgtgttgcttgatggcgcgcatggtagcaaaagactatcgcctaaagaaagccactcgactgctctagcccggatctttgcgatttagcgcttgagaatcaatctcatagactctaagctgcggcggcgtcagggatgacgccccctcccccgtgcaacaattttgcatccaggttttgcctgacgcctgtgtaatatagccgcgacatcactcatattcaggcaaccagactatgaccgtggccttgacctccatcaagatcagcaccgacttcgacagcggcaacatccaggtcctggatgccagcgatgcctatcagttgttgctggcaatcaaacccgatacccgcagcgatcacttccaatggttccacttcaaggccgaaggcatgcacgtggggcatacccacacctttcgcctgagcaacgcgggtcgctcgtcctataggcatgcctggagcgggtacaacgccgtggcgtcctacgaccatatcaactggttccgggtaccgacgcgtttcgatggcgagatcctgcatatcaccctccagacccgggaaaaacacgtctggtttgcctatttcgaaccctacagccgtgaacgccacgactggctgatcgaccaagcccttaagtacgccggagtcaccctgctcgctaccggcaagagcgccgaaggccgcgatatccaactgctacgacggggcaaagggggcgaaggtcgccgcaacgtgtggatcatcgcccagcagcaccctggcgagcacatggccgaatggtttatggaaggcgtgatcgaacgcctgcaacaggacggcgacgacgagctgaaaaagctgctggccacggctgacctttacctggtcccgaacatgaaccccgatggcgccttccatggccacctgcgcaccaatgccatgggccaggacctcaatcgcgcctggcaaagcgccagccaggaactcagcccggaagtcctgttcgttcaggaacagatggaaaaatacggcgtggacctgttcctcgatatccacggcgacgaagagatcccctacgtcttcaccgccggctgcgaaggcaaccccggctacacaccgcgcatcgaagccctggaaaaacacttccgccgccatctgagccacctgacccgggacttccagaccacccacggctacacccgcgacctgccgggcgaagccaacatgaccttggcctgcaacgcggttggtgaaaagtatgactgcctgtccctgaccctggagatgcccttcaaggacaacgacgacgcccccaacctgcgcaccggctggtcaggcgatcgctcgaaacagctgggcaaggacgtcttgagcagcgtcgctgatatcgtcggccttttgcgctgattacctgtggcgagcgggccgttccgctcgccacaaaaaaccatcagtccttggtgccggtcatgctttgcaagacaccatcgcggcggatcaaaccgtggaacaacgccgccgccaagtgcaccagtaccgtgagaaacaacaggtaggcgagatagccgtgagccttgcgcaacagcgcaaacaacggcgcattcgccccgaccagcgcgggcagttgcacgttactgctgagcatcaccggatcaccggcggccgaaatcatcgcccagcccagcagcggcaataccagcatcaacgcatacagcagcacatgggaagccttggccgccaacacttgccacgcgggcaaatccgctggcaacggcggctgtcgtgtgcaaaagcgcactaccaaccgcacgatcaccagggccaggatcgcgatccccagcggcttgtgcaggtggatcaaccactcatggcgctcagacaccgacgcggccaacccagcgccgacaaacagcatggcaatgatcatcagcgccatcagccagtgcagcagacgtgccaggggggcaaaaaagcggggctgggcattcatggctgcaactcctgaggggcgctgtacaacgggctgacttcaccggcgcggcgcaggtatgaactggcatacgcggcggagcgggcagccagcaacgggtcattggaggcctcgatgccgctgggcaaaatcagcgggtcaaagttgatatcgcggcaatcaccgtctgcctgtggctggctgctttgcagcacgagggtgccggcgttcagcaccctgtgctcgccggcccaggtcttgctcgcgtcatccagcgggtcgccggggttggccagggtcatgttcaattgccaacgcaacggcccggcgacgaggcgttgcaccagatctttctcgaggaaatcggcgccatccgccgcagtatcgcccggtgcgtcctggctgagcggcaccacgccccaccgcacggcctggcgtttgccatcagcgctcaccaggtaaaacgcattgatgccgttataggtttcagtcgcataactggccgatggcttggcggttttgacccacgccaggaacggcgctgtctccgggtgcgcggcaaaaaatgccggcatattggccgggttcggcttgccagtggccggatccggcgcgcccgccttgagcaactggtagaacgcctcgggggtgcccaccgggaacaccggcatgctgttcatgccggtgcgccactgctggccgttggcttggctgaactgcacggcaaaactgcggatcggcacactgctgtccggtgcataagggttgccgctgggcaaggcaaaccggccgatgaccggggtcttggccgcgctgaacacttgggcactggaatacgcacgcgcctcggcactgctctcgaagtaaccggccacgcacacgcccttggcgtggttacggcgaaagccggggtgcacgccgttattggtttccagggcattgaccaaggttttggccgcaggcgttgcgggtcaagggtgccattgacgtaggcaaatgccccagcgacaacggcaaccaccgcgccgatgcccgccagacgtgcgatcaggctcgcagtgctcaacggcagacgggggggtgatgagtgatctaccatgcaggaactccagggccagtggccttagggtgaaacataaggtcggagcattaagacgaacgccgatttgctctattccctgaccttcgaattattttacgggccgtggaataacctttaacgccggacgtctttctagtcccagcgtagtgaccagccagacacccatgcatgaactcgacgaacagttacgtgaactcatccccaggttgcggcgttttgcggtgtcgctgacgcgcaacaccagcagcgccgacgacctggtgcaggcaaccctggaacgcgcgatcatcgcctgggccgataaacggatcgaaggtgacctgcgcgcatggctgttctcgatcctctaccggcagttcctcgacgcccaccgccgcagccgacgctatgcacgcatgctcgaattcttcaccggtcgcgatgatgcgcacccttcggtggagcgcacggtgatggcccaatccaccctgcaagccttcgaccagctcaccgccgaacagcgtgccctgctgctgtgggtatccgtcgaaggcttgagctacaaggccgtggccgacatcctcgacgtgcccatcggcaccgtgatgtcgcgcctgtcccgtgcgcgccaagcgttgcgtcaactcagcgatggcgaaattgccggccctgccctgcggagactcaaatgatcagcctgccccccagcgaacgcgacttgcatgcctacgtcgatcaccaattactggagagtgatcgccgtgtgcttgaaacctggctggccagccaccccgaggtggccgcgcaggtgcatgcctggcaacaggatgcgcaattattgcgtgcatctttaagcggcgccctgcaacagccgaacaacccggcactggacccggcactggttcgccagcgtatcaagcgtcagtcccgccgccacttcgccaccgcggcgctgctgctgattgccgtgagccttggcggaataggcggctggcaagcccgcgtagccacccagccgccgctattgccaatggccgatgccatgcaggcctaccgcctgtttgcccaggacggcatcatgcccgccgacttcagtgccgagggcagcggcactatgcaggcctggctcgaccgctatttcaatcaggcccaccgcctgcccgacctgagccaggcggggttcaagccggtcagcgggcgcctgctcaccaccgaccagggcgcggcagccatggtgctgtacgaagacccgcaaggccggcgtatcagcttctatatccgcccgccgggcccgaacaacggtttcctgccccggggcagccgcagcgccgatggcttgcaggccgaatactggtcaggcggcggctataactacgcaatggttagcccggtggaccagccgaccacggggttgatgaagttctagaagccatgtccagcattaggttttcgagccagttggccacccccttccctattggtcaaatcgcggtgggcgctctaaagtaagcgaccaccgcagcacagagtgactccattggccgtgttttccctgctccagcgcctgttcgcgaaacaatccagcgtttcggacgcctcgactatcccggcgtatttccaaagaaaggccgagcaacagggctacaccctcagtgatgggcaaatgcgggcgattaccgccctgaatcgccaggcacagcgtctgctcaatggccaagccacccgcggcctgtacttgcacggcccggtggggcgcggcaaaagctggctgctggacgggttcttcaaggccctgcccatcgccgaaaagcaacgcgtgcactttcacgatttcttcgcccgcctgcaccaaggcatgttcctgcaccgcgggcatgacgatgccctgaccatcaccctcgatcagttgctggccggctgccgcgtgctgtgcttcgacgaattccacgtccacgatatcggcgatgcgatgctcatcagccgtttgttcagggcgcttttccaacgcgacgtgctggtgatagcgacctccaactatccgcccgaggggttgctgcccaacccgctgtaccacgaacgattcaagtcggtgatcgacctgatcgccgcgcgcatggatgtgctggaagtcagttcgccccaggactttcgcagcctgccccaggcccacgcacaacagcgtttcaccagcggccagtatgtgtggcccggtacaccgacccagcgtgaaagccttaagctgcccaccacggattgcccggcgcagcacctgacggtcggcactcggcagctgctgtgccgtggccatcaggcgcgcaccatcgtgttcaccttcaacgacctgtgcgaacagctcacggcggtcatggactacctgctgctgtgcgaggatttcgaccactggataatcgacggcctgccgcacctggccgaatgcccaattgccgtgcagcagcggttcatcaacctggtggacgtgctctacgaccaggacaaacgtctgacgctcatcggccaccagccgctggataaatgcctggaaggtcaggccatcgacctcgcccgcactgccagccgcctgcgccagttgcaaacaccctgcgcgcaaaccgcccccgacccggtatcatgagcgccttttacgcccccatccgagtgccgcgctgttcatgactaccctcgcccaactcaaggccggccaattggccggcgccacgcgcctggacctcgcctgcgggctgaccgagttcccccgggaaatcttcgaactggccgactccctggaaatcctcaatctcacgggcaacgccctgaccagcttgcccgacgacctgcatcgcctgacgcacttgcgcgtgctgttctgctcggacaacgcctttaccgagttaccgcagtgcctgggccaatgcgcgaagctgagcatgatcggcttcaaggccaaccagatcagccacgtgcccgccgccgccctgccgccccagctgcgctggctgatcctcaccgataacagcatcagccaattgcccgacgaattgggccagcgcccgttgctgcaaaagttgatgctggccggtaaccaactgacgcagttaccgccaagtctggccaattgcgccaacctggagctgatccgcattgcctccaatcgccttacacacctgccggattggctgctgacgctgcccagcctgacgtggctggcctacgccggtaacccggtggaaatggcggtgacagtgacgggcgatgatgggacgccgaacattccctggtctgaactggaactgggagaagtattgggcgaaggcgcttccgggatcattcacaaagcaatctggaaaccccaggcgctgtcggtcgcggtcaagctatacaaaggcactatcaccagcgacgggtcaccgctgcatgaaatgcacgcctgcattgccgccgggctgcatcccaacctgatcaaggtgcaaggtcgtgtcatcgagcacccgcagggtcaggcggcattggtcatgagcctgattgacccgagctaccgcaacctcgcggccctgcctagcctggcgtcttgcacccgggacatctacgaacccgatacccgtttcagcctcgatgtggtgctgcgcatggcacgaggcatcgcttcggcagcggcgcacttgcaccttcaggggattacccacggtgacctgtatggccacaacattctgtggaatgcgacgggtgattgtttgctcgcagacttcggcgcggcgtcattccatgccacggccgacaccttggaaaccagggcgttgcagcgtattgaagtgcgcgcattcggggtgttgctgggggagttgttggagcggggtgaaggggtagtcagtgaggatctgattgaactgcaaaaaagctgctgccaacccgatgtgttggcgcggccgagctttgaagaaattgaaggcgtactgagctctatctaacaccgctggaacaatgtgggagggggcttgctcccgatagcggtgtatcagccacagtatctgtgtctgaaccactgcaatcgggagcaaaccccctcccacatttttgaccgtatttgtccagtgactagccagccaggccgacaaacatatcctgcacatcatcatggttgtccaggccttccaggaacgcctcgacttcagccatctgctcatccgtcaagccactgaccgggttcttcgagaggtagcccaatttggccgacagcacggtgaaaccctgttccggcaaggctttctgcacggcatccaggtcggtggtttcggtgatgaacagggtagtgccctcttcttcaccgtcttcgaagtcctgggcgccggcttcaatggcggccatttccggatccgcgtccggggtatccggcgaagcttcgatcaggccgacatggttgaagtcccaggccaccgagccagaagcgcccagttggcccttgcggaatgccacgcggatttccgccacggtgcggttgatgttgtcggtcacgcactcgacgatcaacggcacctggtgcggggcaaacccttcgtaggtcacgcggtggtactgcacggtttcaccgagcagaccggcgcccttcttgatcgcgcggtccagggtttccttgggcatcgaggctttcttggcttgctccaccaccaggcgcaggtgcgcgttggtcgcggtatcggcaccgttacgggcggcgatggtgatttctttcaccagcttgccgaagatcttgcccttggcattggctgccgcttctttatgtttgactttccactgtgcgcccatgactcactctctactatccatggcgccgaaacgtctactggccggcgctttgggggcagagtttatagggcaaaaacactctaatccaccaaaaaaccggccaggtgcctcaggtgcgcaggggtttgcctgtgacgttgcgatcagggacgaagtccccgacctgggccagtaccgcaggcctggcgttccagtagggcatcagcaccagcgacgaaaacagcgccgcgccggcaaagacgataaataccgtgacggtatcgaagtagcccggcagcaagccgccaaggatcgcccccaccgaaccgcaaccattgacaaaacctgccgccgtggcgccggccttggcggtgccgaagtcgatggccgccgtgctgctgatcatcgaatcagggccgtacagagtcaggcccatcacaaacaacagggccatcaccagcaccacgctgccggtgtgcagcgcgcccatgaataacgccaaggctacggtcagcgccagcaggctaagcacacaggcgggcatgcgccgggcgccgaacagtttgtcggaggccaagccgatcagcaccggcccgagcaagccggccagttcaaacgcggtaggcacgatggcggcgccaaccttgcccaccgatggcatctgctcgtagacgatcaccgggccccacaacaggatcgcgtagcgcgccggtttgagcaggaagtacgccagccccaaggtcaacaccgtgcggttgcgcaggattgcgcgcaatggttcgagcacgctgatgtgcttttcagcagcagcctcttcggcgctcaagaccggctcgggctccaccgccggcaagcctacgtcctgcggggtattgcgctggaacataaagaacagcacggccaccaccgccaccactgcggcgctggagataaacgccgcgtgccaactgccgatcagcgtatacgcccaccagccggcaaacggcgaggcgaccaagcccccaaaggcatagcacgaactccacagccccaacacccgcccgcgctgctgggccgcgaagaaactgccaaggttcttgcacaaccccgaccaaccggtggattgcgccaagccctggatcaacatgcaggtgacgaagaccggcaaggtggcgaacgtgcccatcaccagcgccgcggcagcggaaatcagcaagccgccgagcaccaccacccgtggcccgaagcggtcggcgagcatgccccaggtgaattggcccacggcgtatgcggcgaggtagaggccatccaggttggccatcatcattttgtcgagggggaaacccgggtcgtcaccgatccccagcttcgccacggaaaatgctttgcgggtgaaatagaaagcggcgtacgccagccaggtgatggcgaaaatctgcacgcgccaacgcttgatgctacccatagggatattcatggtggttctgacctcaggtgtgagtgtgccggcagaatcgaaagaaaacgcctgttgtttttatggttgagcactgcaatgccgggccgtggggccgcaacattggtcagatgggtgcggtatgcctgcgcccatggccaccgaggttgtaggactcaacctacggcgactgaggtgcatcaaagcaatggctgactaataggtaaaatcgatttatcgtatttcaaatataagcccagcttgtaagaggacctgccatgtcggtttcccatgcccagctcaaggccttccacgcggtggccgtccatggcagttttaccggggctgccgagcggctgttcctgacccagccggcgatttccgaccaggtacgcaaactcgaagagcgcttcggcgtattgctgtttcaccgcaacaagcgctcggtacgcctgaccgacctcggtgaacgcctgctgggcattactcaacggctgtttgtgatcgaggccgaagccgaggaattgctgcaggactcccgcgccctgcttaccggcaccctcaccctggcggtggatgccccggtgcatgtactgccgcagattgcgcgcttctgccagctgtaccccggaatcagcgtgaagatcgaaaccggcaacaccgatgaatcattgtttcgcctgtacaactatcaggctgacctggcgttgctggggcgcgatgtcgacgatgcgcgcctgttgtcgctgcccttgcccgacgaccagctcctggcgtttgtcgcacgcaaccacccttgggccggacgcgagtcgatctgcctggccgacctcgacgacacacccttggtattgcgcgaaatcggctcggtcacccgtcagaccctggagcaggaaatgagccaggccggcctgcgcattcgcccggcgatacaggtggaaggccgcgaagccgcccgcgaggcggtggtggtgggcattggcgtgggcgtggtgtcggcagccgagttcggcgccgacgcacgggtgtacgccatgccgatccgcgattgcacccagcgcatgaaggaaaccctggtgtgcctgaaggaacagagctcacgccgggtggtggcgagctttttggagatcgtgcgtgagagccttcacgccaattcgaaaaatgcctgaatcaagcgcagcgagcggcgccgctccatgcagccgagcatatgccggttgagcagcccatcgcccaggatcggtaccgcttgcacacgcgggtccgggctgacctccatcgacgacacaactcccacgcccagctcagccgcaacggcttcggtcacggcttcacggctgtccaactccagtagcaccttgggctgcacattcgcggccaggcaggcgtcgtcaaaagtgcgccgagtgatggagctgggctctcgcagcaccatgatcacctcgtgcaattgcgtcagttgaatgccttcgggctggtttgcccacggatgcgcagccggcaccagcgcgcaaatccgtgactcgtccaaaggctgcaagtgcaggccattgcgtggctccacctcggtgagcaccgccacgtccgcatgttcggacagcagcgccgccagggcttcttgggcattgcccaagcgcaggttcacggtaatgcccgggtagcgcgagcgcaggctggcgatcatcggcatcaccaagtgcgggccgtcggccgccacttccaggcgcccagtgagcaactggcggttggcctccagcatggtctgcgcctcgtccaccaaaccgaagattgcccgggtaatggctgcaaggcgcgcgccctcctcggttaactccacgcgccgggcggtacggcgcaacaacgggatctggtagtgctcctccaacgccttgatatgcccggtgacagccggctggctgataaacagccgagccgctgcccgggtaaaactgccctcgcgggccaccgcatcgaatgcacgcagttggaacaggttcatagctatcggcctcactgatagctcgcataacaacaaacaatttgattgataacaagccaaactgcaatttaggcgccgtagcttcaaccccgacaccttgcgaggatttgagatgaccactgccgcgccgatcctgttgacccctggtcccctgaccacatcgaaccgcacccgccaggcaatgatggtggattggggctcatgggatgaccgcttcaaccagctcaccgccagcgtttgcacgcagctgctggcgatcctcaacggtgctgacagccatcattgcgtgccgttgcaaggcagcggcaccttcgccgtcgaagccgccatcggcaccctggtgccccgcgagggcaaggtgctggtgctgatcaacggcgcctatggcaagcgcctggcgaagatctgcgaggtgcttggccgcgcgttcagcacctttgaaaccgccgaagacgagcccaccaccgctgccgatgtggatcgcctgctgcgcgccgacagcgccatcacccacgtcgcgctgattcattgtgaaaccagcaccggcattctcaacccgctgccggagatcgcccaggtgatcaaacaccacggcaagcgcctgatcatcgacgccatgagttcattcggcgcgctgccgatcgatgcccgcgaagtcccgttcgaagcgttgatcgcagcctccggcaaatgcctggaaggcgtgccgggcatggggtttgtcttcgcggaaaaacatgcgctggccgccgcccagggcaactgtcattccctggcgatggacctgttcgaccagcacagctacatggtcaagaccggccaatggcgcttcaccccgccgacccacgtggtcgccgccctgcatgaagccttgctgcaatacgctgaggaaggcggcctgcccgcccgccatcaacgctacgcggacaactgccaggcactgctggatggcatggccgcgctgggcctgcgcagctttctgccggcgtcgatccaggcgccgatcatcgtcaccttccatgcaccaacagacccgcgctaccagttcaaggacttctacgaacgggtcaaggccaagggcttcatcctgtacccgggcaagctgacccaggtggaaacctttcgcgtgggctgcatcggccatgtcgacgcggccggcatgcgcgcagcggtcaaggccatcgccgaggtgctgcaagaaatgtgtaggagcgagcttgctcgcgatgaccgttaacgatgacgcgggcattctgactcaacgcgatgcccgggagtttttcgcgagcacgctcgctcctacatgagtttcattacccacaggatctgaaccatgaactatcaaacccccaacaccctccaggccgttatcctcgactgggccggcaccgtggtcgacttcggctccttcgcgcccacgcagatctttgtcgaggcctttgccgagttcgacgtgcaagtctctatcgaggaagcccgtggcccgatgggcatgggcaagtgggaccatatccgcaccctctgcgaccagccgcaagttgccgagcgctaccgcaaggccttcggccgcacgccgaccgatgatgatgtgactgccatctaccagcgctttatgccgctgcagatcgagaagatcgccgagcactcggcgctgatccccggcgccctcgacaccattgcagcgctacgggcgcaaggcatcaagatcggctcctgctccggctaccccaagcaagtgatggacaaggtcgtggccctggccgccaccaacggctatgtcgccgaccatgtggtcgccaccgacgaagtccctaacggtcgcccgtggccggcccaggccctggccaatgtgatcgccctgggcattgatgacgtggccgcgtgcgtgaaggtcgacgacaccgtgccgggcatcctcgaaggccgtcgcgccggcatgtggacggtggcgctgacctgctcgggcaatgccctgggcctgacctttgatcaattccgtgccttggacagcgccacgttgaccagcgagcgccagcgtatcgaagcgatgttcgaaagttcgcgcccgcattatctgatcgacaccatcaccgatctgccgactgtcatcgccgagatcaatgctcgcctggcacgcggggaaatgccgcaaagttactgaccaggatcaaggcaacggcattggcaacgagcgaagcgctcaaaacgggcatacagttaacgtactccgtcgctaaagagcggaggtatgccctgatgagtgaggaaaaaagcgatgccgtggaaaaactccgatacgcgctacagcaccatgtcgattgcgttgcactggttgatggtggtgctgctggcggtggtctacgcctgcattgagttacgcggccagttccccaaaggcagcggtgcgcgcacgctgattgtggaaatgcactttatgttcggacttaccgtgtttgtgctggtgtggctgcgcctgttcgcacgcagcctgggggtggcgccgaagatcgtgccggcaccgccgccatggcagagcctgctggcgaagctgatgcatggggcgctgtatgcgttgatgatcgggttgccgattgccggttggttgatcgtcagtgccaaggggcattcggtgatgttctatgggatggagttaccgccgctgattgcagaaaacaaggcgttggccgaggagattgaaggctggcacgtgctgttcgcccagatcggttactggctgatcggtctgcatgcgctggcggggatctttcaccattatgtgatgcgcgataacactgccttgcgaatgatgccgggcgggcacaatcccacccgttgacacctacaggaaacctcggcggccttgcaggccgccagtgtggatgaagatcaggcgcgtgccgggggcaaagcgtccggcctcgatctgttgcttcaatgccagcagcgccttgccggtgtagagcggctccagtggcacaccgcaggcccgttcggtgcgctcgataaagtcgagcagcagcggatcgaccttggcaaaggcgccacggcaggcgtccagcaactcataaccggtctgcacaatcgcactcacattctgcgccacgccatgatcatccggcacagccattgcgccgtacaccggatgcgcgccggcctccgccagcaccaacccggccagagtagtaccggtgcccgccgccagccaccatgcgtcgtaatccgtccagccgaggtggctcaactgcgcccgcgcctgctccaccaacaccccacagcccagcgcaccgtccagaccgccaccgccttcgggtatcggataaaggtcgggatactgctcgcgccagggcagccagaaacccggctcatgccgcacccgataaccgccgtagcccaaccaatgcagttgcatcccgaaggtcttgaggtcgagcaccgtgggagtgtcttggggatggccgcgcaacaggccgaccgtgggaaaatcaaagcgcttgcccgccgccgccaatgcgtgcagatggttggagtaggccccgccgaggctgataacccctttggcgccgatagcgcgagcctgagccaggtgctcagtaagcttgaaccatttgttgccgctgatcagcggatcgatacggtccaggcgcagcacagccagctcaatgccgttcagccaatccagttgcaaaggttcaaggggcgcgtggggcagccagtcgaaaggacccatgtgggcgcatctgcatgaaaaaaggggcggtagtctaacaccgcccccgttgtcgccttacaactcggcagccaggcgcgagccctggttgatggcgcgcttggcgtccaactcggcggccacgtcggcaccgccgatcaggtgcacgttctggccggcggcgaccaggccgtcgtgcaattcgcgcagcgggtcctggccggcgcagataacgatattatccaccgccagcacctgcggttcgccctcggcgccgatgcggatatgcaagccttgatcatcgatcttcaagtactcgacactgttgagcatctgcacctgtttgttcttcaagccggtacggtgaatccagccggtggtcttgcccaggccgtcaccgaccttggaggccttgcgttgcagcaggaacacttcacgggccggtgcatggcgctcgggcttgatccctgccacaccgccacgcgcttgcaactgggtgtcgataccccattctttccagaacgcctcgcgatccaggctggtggacacgccttggtgtacgaggaattccgacacgtcaaagccgatcccgcctgcgccaatcaccgctacgcgcttgcccaccggcttgcgctcaaggatcacgtccaggtaactcaagaccttggcgttttcgacgcccgggatcgccggggtgcgtggcgcgataccggtggccaggatcagctcgtcataaccacccgccaccagttgctcgacatccacccgagtattcaggcacagctcgacgtgggtggtctgcaatttgcgcttgaagtaacgcagggtttcgaagaactcttccttgcccggcacgcgcttggcgatattgaactggccgccgatctcgctggcggaatcgaacaaggtcacttggtgcccgcgctcggcggccacggtggcagcggccaggcccgcagggccagcaccgacgaccgcgattttcttgatttgctggaccggtaaataattgagctcggtttcatagcaggcccgcgggttgaccagacaggtggtcagcttgccgccgaaggtgtggtccaggcatgcctggttgcagccgatgcaggtattgatttcatcggcgcgcccggctgcggccttgttgacgaactccgggtcggcgagaaacggtcgcgccatcgagaccatgtcggcatcgccttcggccaggatccgctcggcgacttccggggtattgatgcggttggtggtgatcagcgggatctgcaccgcgccgcgcaatttggccgtgactttgctgaacgcgccacggggcaccttggtggcgatcgtcgggatacgcgcttcgtgccaaccgataccggtgttgataatggtcgcgccggcctgctcgatagccttggccaactgcacgacttcttcccagacgctgccaccttccaccaggtcgagcatcgacaggcggaagataataatgaagttggggcctaccgcttcgcgcacacggcgcacgatttccaccgccaggcgcatgcgattttcaaagctgccgccccagcggtcggtgcggtggttggtgtgggcagcgaggaactggttaatgaaataaccctccgagcccatgatttccacgccgtcgtattcggcgacctgagccagcaacgagcaggtgacgaaatcctggatctgcttctcgatgccctcttcatccagctccctgggcttgaacgggttgatcggcgcctggatcgcgctgggtgctacctgcttggggctgtaggcgtagcgcccggcatggaggatctgcatgcagatcttgccacccgcctcgtgcacggcctgggtgacaatcttgtgtttctgcgcttcttcgtcagtggtcagcttggcggcaccggcatacacaccgccctcatcattcggaccaatgccaccagtgaccatcaggcccaccccgccacgtgcgcgctcggcaaagtaggccgccatgcgctcgaaaccaccgggtttttcttccaggccagtgtgcatcgagcccatcagggtacggttgcgcaaggtggtgaaacccaggtccaacggggccagcaggtgcgggtaggcagcagcggtcatggtacagctccacaacggatcatcacgggacgtggcgcactcgaacggcgtgccatcggtttatgtcccacagactaagaggcagcggaccacggctcaatgactgaaactgacaagttattgatccaaatgcacagcgccccttggcaagcggtgccatgggccctaccctagtcgcgaaccctgcacccggtctgttgtctgttgccccatgcgtaaacttctagcgttcaccgtcatcatggccctggttgcctctctcgccgcgtatctggtctggacccaggagcgccccgtggcgcattacctgtcggacctgcgcatcaccctcgccgtcaatgagggccagccggccgagcgtggcaacctgctgggcatccagccggagctgttccccgccgactaccagagcctggaacgcctgcacctgaaactggcggcctacctgcaaaacgcgcgtgacctgggcctgatcaaccccaagaccatcgtggtgctgcccgaacatatcggcacctggctgatgctcagtggcgaaaaaaacgagctgtaccaggccgcgcatctgaaggacgccatgcactggctgtcgatcagcaacccgctgcccttcatgcgcgcctggatcagcgccaccggtgacaaccgcatggacgacgcgtatttgcgcatgaaagccccggccatggcgcaagactaccaagtgctgttcggcggcctggccaaggagttcggcgtgaccctggtggccggttccatcgccctgcccaacccgactgtcagccagggggtgctgcaggtaggccacggcgcgctgtacaacgccagcctggtgtttgccgccgatggcttgccattgggccagccgcagcgccagctctacccgatctacgatgaacgcgggtttatcgcgccaggagatgaaaacaccctcagcgtggtcgacacgcccgccgggcgcctgggcattctggtaggcagcgacagctggtacccggacaactaccgcaagctcaacgaacagggtgcgcaactggtcgcggtgccagcctttgttaccgggcgcgacacctgggaccgcccatggcgtggcttcaagagcgtgtcgacgcctgctgaagtcagcctcaagcccgaagaaaccagcgagggcgccgcctggcgccgcctgaccctgatcagccagcaacccgtcagccaagccacggcgggcatgagcgtatttttacgtgggcagttctgggacctgggcagcgccggccagagctttctcagcagcaacgggcaagtgttcgccgacagcgacgcccgcggtgcgcgcctgctgaacatctggttgtagcccttgaagccggtgcgcctgggggatctgtcggtgggcttcgtgcacaccctggccgacgccatccacagccacggcctggacccgcaaccgctgctgctgcaatacggcctcgatccggcgcgcctggccgaggccggcgcacgcttatcaatcccgcgctacatgcgcctgggtcacgcggccatccaactgaccggcgacccgggcctgggcctgcgcatgggccagctcagtcgcttgagccaggctggccttgccggcgtcaccgccgcccaggcgcccaatgtgcgcgaagcagcgcgcgcactgacacgctttgaagcgctgtacggctccaactatcgcgggcaatccagttttagcgaggatgccaagggcgcttggctgcggttctattccatcagtccctacaacgcctataaccgctttgtcgtcgattcgatcatcgccggttggctgcagcaactgtctggcctggcgcaacagccggtgcaggcgcaacggatcgaaatcgaattccaagcgccggactaccacgaacaatacagcgtgctgggagacggcctggtgcacttcggcgccgacgccaatcaactgcgcctcagccaaccgaccctggccctgcgcaacccacagcattgccccagcacctggcacctgttgttgcagttgtgtgagagagagttggagcagttgacccgcacccgcagcctgcgcgaacgcattacccggttgctcgggccaatgctcaatgggggccgggagcccgatctggaagaagtggcggcacgcttgaagctgccgacctggacgctgcggcgtaaactggccgaggaaggcacgcagtttcgcgccattctcaacgacacccgccgcgacctggccatgacctacattcgcgataccgagctggcattcggcgaaatcgcctacttgctcggttttgcttcggcccaagccttccagcgggccttcaggcgctggaacaaccagaccccaggggaatttcgccgcagtcagcggcattccacctgaagtcggtttacagctcggtggcatcgtcggcgggatccagtggatccagctcgaatgcctggtactccagcaattcttcctggtattcgtccatggtgaactccttcttgaattgaaagcggttgcagataaatgacctgcgaacccagcctaaagtgccgtcatgacgaaaaaatgtcgacgtgatgacattccggtatttcaagattaaacgcgccagggtcgggatgatttaaccgcgaggcttttcaagtgcaattgcaatcattgcaaatgcaaccacatttccattagggtacgagcatccgttgaaaggagcttcgccccatgcctgcctccaccgcgcattctgcgctgcgctgcatcgacgcactcgacaccgccgccagcccgggcagctcgccgttgtatacggtcatgaccatggccaataccctggaatccagccgacaagcctgggtgatccgcggccagtcacgcagccgccgcgtgggcaactggcccacatggtttgcacgcaatcgcggcgaaaaacctttgctctacctgcacagcgcgacatcgtcggcacagctgtgtgcactgtcggaccagaccgcccagcgcggtatcttgtgcaatgacatcgaaaaccagccctccccatggcccaagggcgcgcacccatcgctgccgttgtggctggcgacccatccgcgctgcaccccttacgatcccgcctcgggtgacgaagccagggcgattgtgctggcagggctgcgcacgctgtacgtcgacgggcagccgggcttttattacctggcgctgcatgatcaggacgctagcaccacgctggatagtcaggaccgtgcagacgcccacaaaggcatgtatccgatccaacgtggccaagtgggagatgtgcgcctgctcggcgctggccgggcgcttgaagaagtcatgctcgcggctcggttgctggcacaggactggaatatcacggcgcaggtatggagctgccccagctacacacggctggcccgtgaggcggcggccgccgagcgctggaatcgcttgcaccccctggcccccaggcgcagttgccatttgcgtgagtgcctggcgggaaatacagcgccggtgattgcagtgaccggctatccgcaggcgattgtcgatcagttgagggcgcacgtggatacgcggtttatagcgttgggcgcggggtcggtgcaggcgacagcaccgagtcggtattgggtggtggtatcggcgctcagggcgttggcggaacaaggacggatcgatgcattagacgtgaagaaggcaatggcccgctacccacttggatgagctggaatgttcgggcttgcgttggcttttcattgttgctcagcgcttgccgcggctgggggtcggcacgcccgccgccatcgccagccccgcagtgcgctgcagggcatcggcaaacgcctggcgttgcccaggttcgatctgcgacaggaacagctcgtccacggtgctttcgtagatcttccacatttttttgcgcaacacccggccggcgtccgtgatcgaggcaaacgccgcacgaccgtcgccgtcggaacgcgagcgcaccaccaggccgtccttttccaggcgatctaccagacgcgtgaggttgtagcgctcgatggccagcacatcggccaattcgtgcatgcgacgggtaccatcgggcccgctctccaggccccacaaggcgtcataccaggcgtacggcggcagatccgccgcggccagccgccgctcgatttcacggatgaccgtcctgtgggccctgacaaaacggaaccagacatccggttctttcgacgacatgcaacaccatccgggggatttcaagaaggttgcaatagtagctcatcccgcgctagattccgccatgtcgttgcaattgcaactacatttgcgtcactcccacaaggagctcgccgcttgaatcgcctaccctggagcctcacatgacctcgaataacacagcaagactcgacgatgatccacaggaaacccgcgaatggctggagtccatcgaatcggtgttgtccaccgaaggccgcccccgcgcccattacctgatcgaccagttgctggatttcgacgtcgcgcgccatggcgacttctacgggcgggtcaccaccccctacgtcaacagcatccctgtcgaacgccaactgccctaccccggcaatctggacatcgagcgtcgcaccaatgcgtttatccgctggaacgccatggcgatggtcctgcgcgcaggcaaacactcaggtgtaggtgggcatatcgccacctacgcatcagcagcggtgttgtatgacgtcggcttcgatcattttttccgtggccgaaccgacaccttcgacggtgacctggtatacatccagggccactcttccccaggcatctacggccgcgcctacctggaaggccgcatcagtgaagcccagctcgacaacttccgccgcgagaccggcggtgagggactgtcgtcctaccctcacccacggctgatgcccgatttctggcaatttcccaccgtgtccatgggccttggcccgattaccgccgcctaccaggcgcggttcatgcgttacctggagtttcgcgacctaaagcaacaccagggccgcaaggtctgggcctttctcggcgatggcgaaatggaccagccggaatccctggccgccatctccctggcaggccgcgaaaaactcgacaacctgatcttcgtcgtcaactgcaacctgcaacgcctggacggcccggtgcgcggcaatgccaaggtgatccaggagttcgagagcctgtatcgcgccgccggttggaatgtgatcaaggtgatctggggtggcggctgggacgcgctgctggaaaaagaccagagcggcctgctgcgccaacgcatgatggagtgcgtggacggcgactatcagaactacaaatcccagaatggcgcttatgtgcgtgaacacttctttggcaaatacccggagttgctggcgctggttgcggacatgtccgacgacgatatctggaaactctcacggggcgggcatgacccggacaaggtttacaacgcctacgccgccgccgtgcgccacaagggccagcccacggtgatcctggccaagaccgtgaagggttttggcatgggtgaagccggcgaaggccagaacatcaaccatcagctcaagaagatgggtgccgatgcggtaaaagcctttcgcgaccgcttcggcctggaagtcgccgatgaccggctcgacgaaatcccttacctcaaacccgccgccgacagcgaagaagctcgctacttcgccgcaagacgccaagccctgggcggctatgtaccggcgcgccacacggctgtcgcccctttgcagatccccgagctaagcgcgtttgccacccaactcaaagacaccggcgaacgcgccatctccaccaccatggcctttgtgcgcatcctcggcaccctgctcaaggacccgcacctgggcaagctgatcgtgcccatcgtgccggatgagtcgcgtaccttcggtatggaaagcctgtttcgccagatcggcatccactccgccgtcgggcagctttatacgccacaggacgcagggcaattgagctactacaaggagagcaaggacggacagatcatgcaggaagggctgaatgaatccggcgccatttcttcgtggatcgcggcgagtacgtcctacagcaatcatggcctgatgactgtgccgttctacattttctattcgatgttcggcttccagcgcgttggcgacctggcctgggccgcgggtgatgcacgtgcgcgcggcttcctgctgggtgccacggccgggcgcaccacgctgatgggcgaaggcttgcagcacgacgacgggcacagtcatatcctcgcgtcggtgattccgtgctgcgtggcctatgacccaacgtttgcctacgagctggcggtgattattcgcgagggcatgcggcgcatgtatgttgagcaagaggacatctattactacatcaccctgctcaacgaaaattacccgcacccagcgatgcccgaaggcgttgaagaaggaatcctcaagggcatgtatccgctgagcacccacccgcaagcgcaggtgcagctgatgggcagcggctcgatcttgcgcgaagtgatcgccgcagccgagctgctcgccaaggatttcgccgtgcacagcgatgtctggagcgtcaccagcctgaccgagctgcgccgtgacggacacgccgccgagcgctggaacctgctgcacccgcaaagcgagccgcgccagagttatgtcgaaacctgcctcgacgggaaaaccggagcagtggtggtagcgaccgactacatgaagttattcgccgaccagattcgcccctttgtgcacggtcgccgtttcgtcgcactgggcaccgacgggttcgggcagtcggatacccgcgaggcattgcgcgagtttttcgaggtcgaccgccacttcattgttctggcggccttgaaagcgttggcggatgacggtgtgattggccgggacaaaatcgccctggccatcagccgctacgggatcaacgtcgacaaggtagatcccgtagccgtctgagtcactgcgcaggcgctggcaggggcggaatcgcctctgtcggtgccggcaagctggggttggtcggcgccggcgcaggctcggttaccggtgttggggccggcgcaggttccgggttcggctctggtgtcggcgcgatcggcgcggcctcaggtggcggcgcaagaggttgcgcggcggcaggctgcggtgtgtcctgcggcgcctcgaccttctcggcagccggcgcagccttgggttcgggcatgcccaggtcagccttgggcttttcgggaatatgctcggcctgcttcacctcctggggcaggaacacatccaccagggcgaagtagcgctcgtagaacttcggcgccgagacggtctcgctcgccacctttaccatcgagtcatcggtggagccaatcggcatcgacaccgaacccagtacacccacgcccaggctggcggagttgttgaccttcttcaacgcatagcgatcctgcaaggcattggcaaacatcgtcgagtgattgctgcccttgccatctgcggcacacaccacattgaagctgatctgcaggtgggtctcgccagtctgctggaagctcttgttgccggccaccaacttgggatcgctgctggtgatgatgtagccctggctcagcaacgcacggcgcgccgcctcacaggcggccacgtcgctgaccgggtaatcacgggaaaacgtaccggagtcatcgaaattctcgtgctcatagatagcggtcttgggtgacgagcaacccgcagcgcccgccagcaccagcgccaacccgaggctgcgcaagtgaaatgatgtcgacattgaaaatcctgaggaaaacggtccggacggtattgtgcaacagaacagggcctggaggcgcgcattcctgtcggtaaaacgtcacaggctcagggaaccgcaccggtaggaaaaagcccggcacacatatggtcgatgaatacccgtagtttggccgaggcatggcgactggccggccacaacaaccagaaactgccgcggtgctcgaggtgctcgtccagtactcgctgcaattgccctttgcttaccgcctggttgaccatgtagtccggcaggcatgcaataccgagaccttcctgcaccacatgatagagcgactcgatggtggtactgaccaatggcgtgcgcaggctcggctccgttgagcccggaacatgacgcaggggccagggctccagcttgccggtggcgcagaatttatgccgcaggcaggcgtggtgattcaggtgttgcggctgacttggaatgccgtgctgctcaaagtagccgggcgtgccgacgaggaccaattggtagtgccccagatggcgcgccatcaagcgcgaatcttccggcttgccggtgcgaatcaccgcatcgaagccctcttcgatcacgtccaccatgcggtcggaaaaatccacgtccaactcgatttccgggtaggcacgcataaagtcgctgatcaccggcatcaacaaaccacgcacctggggcacgctgatacgcaacttaccccgaggcgcggcactggcctgggtcaactcctgttcggccgcctccacttccgccaggatgcgtcgcgagcgctccaggaacagcgcgccctcactggtcagggtgatactgcgggtgctgcgatgaaacagcctgacacccaagcgctcttccatccgcgcgatgcttttgcctaccgccgaagatgacacacccaatatccgacccgccgcggtaaagctgcgggtgtccgcgacctgtacgaatactgagagactgccaaggttgtccatggtgatgccttggatgattgcggacaacaacgtccgataagttcggaaccttagcctgtttttccgcacgccgcagccccctaccctgtctccttgcccctttaaggagaaccccatgaacgacagccctttattggccggtactgccccccaacatgaggccctacccctggcaggcttgctggccctggcctcggctggctttatcaccattctcaccgaggcgatgcccgccggattgctgccgcaaatgagtgcagggctgggcgtgtcccaggccctggtcgggcagttggtgacgctctacgccctcggctcgttactcgcggccatccccctgacgctactgacccgaggctggcgcagacgtcccctgctattgattgccattggcggctttgccttggtcaacagtgttaccgcgttttccagccactatggcctgaccttgatcgcacgctttttcgcgggtgtgttcgctgggctgctgtgggcactgctggcgggttatgccagcggcatggttgcgcctcacctgcagggccgggcgattgccgtggccatgttgggcgcgccgctggccttgtccctcggcgtacctgccggcacgttgctgggtacgctggtcggttggcgcaccagtttcgccatcatgaccggcctgaccctgttactgctggtatgggcgcgctggcaactgccggacttcgccggtgaaccggcaagcaagcgcctgggcttgcataaggtactgaccttaccgggcatacgtccggtactgtgggtgacccttacctacgtgctggcccacaacatcctctacacctacatcgcgccgctcctggtaccggccgggattggtggcgacatcgacagggtattgcttgtgttcggcttgatggccctgttgagcatctggctggtaggcatctggattgaccggcatctacggctactgaccctcatcagttgtgcgatgttcgccgtggccgccttgctgcttggcctctggatcagctcgccaatcagcctctacatcagcgtggcgttgtggggcctggcgttcggtggcctcgcggccctgttgcaaaccgccctggccaagtcggcgggccactcggccgatgccgcgcaatcaatgctggtcacggtgtggaacctgggcatagccgggggaggattggcaggtggcttattgctgcaaagcttcggcgtcgaggtattcccatgggcggttttaggcctgatggcgctggcggtgggcgcaatactgggtaagacaaagcacgcacgatgacaagtttgtttacaacttattcatcagcttcctatcatccccctgggtgcgtcgctgcataaagtacggcgcaggttaaaagccaagcattggtcgggccgccaatggagatttgtcgtgcctgataaacaccctgcgatccctcgccctcaacgtctggctgagggcgcgttgtctgcccttgagcgcttttcccgtatcgaagccgtcagcggtatcgtcctgctgctggcggccattgcggcgctgatctgggccaacagccccgccgcggcgacctacgagcacttctggaacacgcccatcaccctggggctgggcgactacagcgtctcacgctccctgcactttctgatcaatgatgggctgatgaccatcttcttcctggtggtcggtgccgagatccgccaggaaatcaaggacgctgccctcgccaacctcaagctcgccacgctgccgctgggcgcggcgttgggcggcgtgctgatgccagcgctcatctacaccctgctcaaccacggcactgccgccgcgagtggctgggccgtgcccaccgcgaccgacatcgcctttgccgtgggcgtgctggcgttgctgggcaaatcgattcccagtggcgtgcgtattctgctgctggccctggcgatcatcgatgacatcgtggcgatcctgatcatcgcgatcttcttcaccgccagcctcgactacatgggtttggtgattgctgcaggcgggctggccctggtgctggtgtttcagcgcatgggcatcggcaaggccgcgatctatcttctgccaggcgcgattgtctggtttggcctgctcaagaccggcgtgcaccctaccctcgccggggtcatccttggcttgatgacgccggtccattccaagcccaccactgagcgcccgctggagaccatcgaacgcacattcaacgagctgatggagcgcttctcgcaatcggcgcaaggcccccagcaggtcgcccagcccctcaagcaactgcgcgaagcccagcgggaaatgttgccgccggtacaacgggtgcaatcggcactgcacccgtgggtagcgttcggcgtgatgccgctgttcgcgctggccaatgccggagtgagcctggacggtttcaacctggatgatccgttggcccacggtgtgttcatgggcgtcatcttcgccctggtactcggcaagccgttgggcgtgatgctggcgagcctggcgctggtcaagctcaatatctgcaagctgcccgatggggtgacctggacgggggtgggcctggtcggcctgttggcggggatcggtttcaccatgtcgatctttatctcttccctggccttctccgacccggccctgctgtcggctgccaagctgagtgtattggccgcttcgaccctggcggcgctgatcggcctgacctggggcaagctcaagttcgccggcaagcctacttaaggcgagttcagcagcgctttatcgagggcaaaaaaagaccccggccttttcaggacggggtctttttattcaggccggcatcagtatttcttgatgtctgcctgggtttccagctgcttgcggtacgccgcgaagtcctgctggccgatacgggaagcgaggaagcgacggtattgcgccttttcttcgtccgtaggcgctgccgcttcgttgacgccgttcaaacgcacgatcaccaggctgccatcgcgcagggtcacggtggtgaaggtcggcttgtccttggccgcaggcttgggcatgcggaacagggcttgcagcacggccgggtcgatggattcctgaccacgggtcgccgcttcagtgaccttccaggcttggccgtcaatcggctggtccaacgcggtcttgccatcgcgcaggctggcgatcaactcgtcggcatgagccttggcagcagcgctcgcgcgctccttggtcatctgtgtgcgaatggccgcctcgaccttctcgagcggcagttgagccggcttgagatgctccttggcacgcagcacgatgatggtttccgggtccagctcgatggcgctgctgttggcaccttcatccagcacttccgggctgaacgcggcggtgaccacggcacggttggccgcgacgccttcgccaccttcgcggccaaatggcgcggaggtatggacggtcagtttcaggtcagatgccggctgggccaggtcggacgcttcaaatgccgcatcttccaattgcttggtcgcttcgacaaaccgctgttccacttgctgggtcttgagctcgcgggtcagcttgtctttcaggctggcgaacgatggtacctcaggtgcttcaacgcccagcaacttgatcaagtgccaaccgaaagcactgcgcacaggcgccgatacctggtcttgcttcaagccgtacaaggcagtttcgaagtccggatcgtagacgcccggaccggcaaagcccaggtcgccaccattgttggccgaacctggatcctgggagaattccttggccagggcctcgaacttctcacccttggccaggcgcgcctggatctcttcgatcttggccttggcttgtgcctcggtgaccttgtcgttgacttcgatcaggatgtgcgcggcacgacgctgttcagcgaggttggcggtttccttctcgtaggcagcctgcaattcatcgtccttgacggtgacctggtcgaagaaagacgacttcttcagttccaggtagtcgatgaccacctggtccggggtcatgaattccttggcgtgctggtcgtagtaggccttgacctcgtcatcggtgagtttcaccgccgcagggtcagccttgatattgacggtggcgaaatcgcgggtctgcttttccagacgggcaaatgccagcacctcggcgtcggtcacgaaaccgctgccggcgatacctgcgcgaacctggccgatcagcatttcctgggtcagcatctgacggaattgcatacggctatagcccagctgacgaatcacctggtcaaagcgttcggcgctgaacttgccgtccacctggaattccggcgtctgcaggatcacctggtccagtgccgcttccgagaagccgaacttggaatcagcagcgccttgcaacagcagcttgcgatcgatcaggcccttgagggccgcgtcgcgcagcagtttttcgtccagcagggaagcgtcgaaatccttgcccagctgttgcatcagctggcgccgttgcatgtcgacggcctggctcaattcggtctgggtgatttcgtcaccgttgaccttggccacgtcctgcttgttgttacccgaagcctggaaaatagcctcgataccggtgaacgccatcaatgcgacgatgatcccgataatggtcttggcaatccagccttgtgaattgtccctgatattttgcagcatgcgtcccccagaaacggttgaacttcaaatttaggcaaccgtggagcgtgggtagagtccggatagaagaaaggcgcatccgaggatgcgccttctcgtaactggcggagcggacgggggttagaacccacacccccggcatggcgacccaatggatatgtgggtcagctgccgctccgctgccaggccagacctgcgtctaacccgggtaggtaaggcaagaacgaagcttagttaaccgcttctttcagggctttaccggctttgaaacctggtttcttggcagcagcgatttgcagtgctttaccggtctgtgggttacggccagtgcgagctgggcgatcggtcacagagaaagtaccgaagcctaccagtaccacggagtcgccggccttcagagcgccagtgacggattcgattactgcgtccagcgcacggccagcagcagctttcgggatatcagcggatgcggcgatagcatcaatcagttccgacttgttcactctaagtccccttatatatctattgagtatgattctaagttttttggtaaaagcaaaaaccagtgctgaatggcctacagacacttaagagccgctttataacaagggctctaaaaagctgtcaaggaagcccccaggctttaacacattaatgcgtgctaattctttccttggaatcggactcgcgtttttcgtccttcgcgactatctccggagccacatccggcaagggctccggcgcgtattgcagcgcaatttgcaggacctcgtcaatccatttaaccggtttaatctgaagatcctgcttgatattgtcaggaatttccttcaaatcgcgaacattctcttcaggaatgatcaccgtcttgattccaccccggtgtgcagcaagcaatttctctttcagaccaccgatagccaatacttggccacgcagggtaatttccccggtcattgccacatcggcgcgcacaggaatcccggtcaatgccgacaccagggccgtgcacatgcctacgcccgcgctggggccgtccttcggggtcgccccttccggcatgtggatatgggtgtcgtgcttctcgtggaagtccagggggatgcccaggctgcgggcgcggctgcgcaccacggtctgcgcggccgtaatggattcgaccatcacgtcacccagggagccggtcttgatcaattggcctttgcccggaattaccgcggcttcgatggtcagcaattcgccacccacctgggtccacgccaggccagttacctgcccgacctgatcctgttgttcggccaggccgtagcggaatttcttcacgccgaggaagtgttccagggagtcggcaaccaccttcacggagaagcgtttttccagggcgtgttccttgaccgccttacggcagatcttcgcaatctggcgctcaaggccccgtacaccggcctcgcgggtgtagtaacgcacgatgtcgcggatcgcctcgacgtcaaattcgatctcgcctttcttcaggccgttggccgaaatctgcttgggcgcgaggtatttgacggcgatgttgatcttttcgtcttcggtgtagcccggcagacgaatcacctccatccggtccagcaaagctggtggaatgttcatggagttggaggtgcacaggaacattacgtcggacaggtcgtagtcgacttccaggtaatggtcgttgaaattgtgattctgctctggatcgaggacttcaagcagcgccgatgcaggatcgccacgcatgtcgctgcccattttgtcgatttcatcgagcaggaacagcgggttgcgcacacccacttttgtcatcttttgaatcaatcttccgggcatcgaaccgatgtaggtacggcgatgaccacggatttccgcctcgtcacgcacgccgcccagggccatgcgcacaaacttgcggttggtggcgctggcaatcgactccgccagggaggttttacctacacctggagggccgaccaggcacaacaccgggccgcggattttcttcacgcgcttttgtacggcgaggtactcgaggatgcgttccttgacctcttcgagaccgtagtggtcggcatcgaggatctcttcggcacgggccaggtccaggcgtaccttggtctgagccttccacggcacctgtaccagccaatcgatgtaggagcgcaccacggtggcttcggccgacatcggcgacatctgcttgagcttgttcagctcagcagtggccttggtcaaggcgtctttcggcaggccagcggcgtcgatacgctttttcagctcttcgatttcgttgtggccttcctcaccgtcaccgagctctttctgaatggccttcatctgctcattcaggtagtactcgcgctggctgcgctccatttgtttcttcacgcggccgcggatgcgcttctcgacctgcaacaggtcgatttcgccatcgagcagcgccagcacgtgttcgacacgtgccggcaggtcgatgatttcgaggatgtcttgcttctgttcgattttcagcgccatgtgcgccgccatggtgtcgaccagacggcttggctcatcaatgctgttgagggaagacaggacttcagccgggactttcttgcccaactgcacatactgctcgaactgcgagagcaggctgcgtacaaacacctcggactcacgctccggggcctcgatttcttcgatcagcgccacttcggcgcgcaggtggccgtctacctccatgaaacgctctaccgcgccgcgctgctcgccttctaccagtaccttgacggtaccatcgggcaacttgagcaattgcaatacagtcgcaacggtgccgacgcgatacagggcgtcttcgcctggatcatcatcagctggattcttctgggccaacagcaggatttgcttgtcgcccgtcatcgcggcctcgagggcttcgatagacttctcgcgccccacgaacagcgggataaccatgtgcggatagacgacgacatcacgcaacggcaggagaggcaattcgatggttgtcttcatgatttcgcctctatgacagttgaaaagtaagcttgaaaccaagatgggggttcgatgcaaaaaaaacaagctcaatgccagcagttaaacgcatgaataaccgcgaatttaaccactgccctgagaaaccaccccaaaaaacaaggggcccctgaaggccccttgcttgtaccgctaccgctggacgcttacgcgtctggcgctgccttggcagccggctcactgttttcgtagatatacagtggcttggacttgccttctataacgctttcgtcgatcaccactttactcacctcggactgcgaggggatttcgtacatggtgtcgagcagcacgccttcaagaatcgaacgcaggccacgtgcaccggtcttgcgctccagtgcccgcttggccaccgatttgagtgcgtcggtacggaactcgaggtctacaccttccatctcgaacagcttggcgtattgcttggtcaatgcgtttttcggctcggtgaggatctgaatcagagcagcctcatccagctcgtccaacgtggccaggaccggcagacggccaacgaattccgggatcagaccgaacttgaccagatcgtcaggttcgacttcacgcagggactcgcccaccttcttgccttcttccttgctgcgcacttccgcaccgaaaccaatgccgccacgggtggagcgctgctggataaccttctccaggccagagaacgcaccgccacagatgaacaggatgttacgcgtgtcaacctgaaggaattcctgctgcgggtgcttgcgcccgccctggggcggtacggaagcaaccgtgccttcgatcagtttcaacagggcctgctgcacgccttcaccggaaacatcccgggtaatcgacgggttatcggacttgcgcgaaatcttgtcgatttcgtcgatatagacaatacccatttgggccttttctacgtcgtagtcacacttctgcagcagtttctgaatgatgttctcgacatcttcacccacgtagccagcctcggtaagggtggtggcgtcggcaatggtgaacggaacgttcaacaggcgagcaagggtttcagcaagcagggttttacccgagcctgtaggaccgatcagcaagatgttgctcttgccgagttcgacttcgtcgcctttcttgtcacgctggttcaagcgcttgtagtggttgtacaccgctacggccagaaccttctttgcacgctcttgaccaatcacatactggtcaaggatgccgctgatttctttcggcgaaggtaatttatgcgcgctgctctcggcctgggcttcctgcacctcctcgcggatgatgtcattgcacaggtcgacgcattcgtcgcagataaacaccgaggggccggcaatcaatttgcgcacttcatgctggcttttgccacagaaggagcaatagagcagcttgccgttgtcctcgccgttgcgggtgtcagtcattcgttcgatccaaatccgataggcttgcaacacaagatgaaggcttatgcgggctttttcaagcccgccagtggtcggacatgccgaccagccctattttgagcggcttatattaagcggggcgcttgtcgatcactgcgtcgatcaacccgtattctttcgcggcttcagcgctcatgaaattatcacggttggtatcacgctcgatttcttccagggtgcgcccgctgtggtgggccatcagtttattgaggcgttcgcggatgaagaggatttccttggcatggatttcgatatccgacgcctggccctggaaaccgcccagtggctggtgaatcatcacacgcgagttaggcaggcagtaacgcttgccctcggcacccgcggtcagcaggaacgcgcccatgctgcaggcctggccgatacaggtggtcgacacgtttggcttgatgaactgcatggtgtcgtaaatcgacatgcccgctgtcaccgaaccgcccggcgagttgatgtagagatggatgtccttgtccgggttttccgcttcaaggaacagcagttgcgcacagatcaggttggccatgtagtcctctaccgggcccaccagaaagatcactcgctccttgagcaggcgcgagtagatgtcgtaggcgcgttcgccacgagcggactgctcgacaaccatcgggaccaggccgcctgcggcctggatatcagagttctgctgaatataggaattacggaacatgctctgcagttactcccaaatagtcatgtcttgaaaacgcataagccagcgcgaggctggcttatggttgaatttccaacgagttggacaatcagtcggcttgtgctgcttccgccggtttgactgcttcttcgtaagagaccgctttatcggtcaccttagccttctgcagaacagtatccacaacttgttcttccagcacaaccgaacgtacctcgttcagctgctggtcattcttgtagtaccacgccacgacctgctcaggctcctggtaggccgaagccatttcctggatcatttcgcgaacacggtcttcatctggcttgaggtcaaactgcttgaccacttcagccacgatcaggcccagcacaacgcggcgcttggcttgctcttcgaacagctcggccggcagttggtcaggcttgatgttgccaccaaactgctgcacagcttgtacgcgcaggcgatccacttcgttggacaacagggccttaggcacttcgatcgggttggcggccagcagaccgtccatgacctggttcttgaccttggatttgatcgcctggcgcagctcacgctccatgttcttgcgaacctcggtgcggaagccttcgatgccggtttccttgataccgaactgagcgaagaattcttcgttcagttctggcagcttaggctcggaaacgctgttgacggtcacggtgaactcggcggctttgccggccaggtccaggttctggtagtcagcagggaaagtcaggctcagcacgcgctcttcgccggccttggcgccaaccaggccgtcttcgaaacccgggatcatgcggttggaacccagcaccagctgggtgcccttggcggagccgccagcgaagacttcgccgtcaaccttgccaacgaaatcgatgttcaactggtcttcgttctgggcagcacggtcggccacttcaaaacgggtgttctgcttgcgcaggatttccagcatgttgtccaggtccgaatcagccacttcggcgctcaggcgctcgatggcgataccgtcgaaaccggccacttcgaactctgggaacacttcgaatacagcaacgtattccaggtccttgcccgcttccagggacttgggctcgatcgaaggcgagccagccgggttcagcttctgctcgacaacggcttcgtagaaggaagcctggatcacgtcacctacagcttcctggcgcgcatcggcaccaaaacgacgcttgatttcgctcatcggcactttgcctggacggaaaccagcgatcttggccttctgggcagtctgctgcagacgcttgttgaccgcagtctcgatacgctctgccggcacggtgatgctcaggcggcgctcgagagcagtagtattttcaacagaaacttgcatggatattcctcgttgcacagacgttagccggccatttccgaccccaatcaagggcatgcattctagtgggtcaaactcaagaagtcaccctactgaaaatacaccggaaaaccgccggcaatttatcggtacgaaagcactgatgtacctcgccccggtgacaaatacagccaattgcgccagggccctgcgccgcctctatatatagaaggcgaagccgttcatctccctgacggcccgccctgcgaacagagtgggcaggcagcgcggcatcatcgagatacacaaatacgatgaaacgccctgccgatgcggcccagtatctgcaaccgccgaatattcaaacccctgaaaccaaaaaaggcgccagactgttaaatctggcgcctttcgaatatggggtggacgaaggggatcgaaccctcgacaacgggagtcacaatcccgtgctctaccaactgagctacgcccaccatattgcgttaacaaagaaaccaaaccacttcttctttgtccagccctactggcctgacggccgagcaaagcttaattggtgcggatgaagagactcgaactcttacgcctcgcggcgctggaacctaaatccagtgtgtctaccaattccaccacatccgcgcttgaagctcttaaagcaaaggcgccagatgattaatctggcgcctttcaaaatatggggtggacgaaggggatcgaaccctcgacaacgggagtcacaatcccgtgctctaccaactgagctacgcccaccatatagcgctacttgtgccaaagctgcctaatggcgcacccggcaggactcgaacctgcgaccatccgcttagaaggcggatgctctatccagctgagctacgggcgccttattaatctgtactcttggaggattacaaactaagtgcttccagccttgcaggacaactattctgctcgaccttcttaaccagtgctaggctgtgcccgacaagtgcgacgaatagtatagatgccccggaaacccgtcaaatcttttttgaaaaaaactgattttatttaaggggttagggcaatttgcagaccaagcgcctttgccctcgcgccttggcgtgcgagaatgcgcgcacttttcttccccctcttgatggttaatcacgcgtaatgactgcacaacttatcgatggcaaatcaatcgccgccagcctgcgccagcagatcgccaaacgagtcaccgagcgcagccagcaaggcctgcgtacgccggggctcgcggtgatcctggtcggcagcgatcctgcctctcaggtttatgtctcgcacaagcgtaaagactgtgaagaggtcggctttatttccaaggcctatgacttgccttccgagaccacccagcaggcccttaccgacctgatcgacggcctcaacgaagacccggcgattgatggcatcctgctccaactgccgttacccgagcatctggacgcttccaagctgctggagcgtatccgcccggacaaagacgtcgacggtttccacccttataacgtcggccgactggcacaacgcatcccgctgctgcgcccgtgcacacccaaaggcatcatgaccctgctggaaagcaccggtgtcgacctgtacggcctcgatgccgttatcgtcggcgcatccaatatcgtcggtcgcccaatggccatggagctgctgctggccggttgcaccgtgaccgtcacccaccgcttcaccaaggacctggccggccacgtcggccgtgctgacctggtggtggtcgccgccggcaagccgggcttggtgaaaggcgaatggatcaaagaaggcgccatcgtcattgatgtgggcatcaaccgccaggacgacggcaagttggtcggcgatgtagtctacgaaaccgccctgccccgcgcaggctggatcactccagtgccaggcggcgtcggcccaatgacccgtgcttgcctgctggaaaataccttgtacgcagcggaaaccctgcacggttaataaccaggcgtaatgaaaaagccctgccttagcgcagggctttttattacccgaaaaaactgtttttgttagttttaagcactttcgtctgtctctagaagaacattggaaatgtaccagcaccagtgcgcacttctcgtagacgagctggtggagaccgagcgcatgttgcgcagggctcgagcgaatatcgccggcctgatgcagatgaacgacctgccggttaccggcaagatggcagcagaagaaaagcttcgatctgttgaggccgagctcagcctcaaaaacgtcgaatactcggaaagaggcaaagagatcatgggcctgaagaagatttcataccagaacgagcatttgcgcgtggaaaaccagcgtcttctgctcgaactggtggcacttatctatgagcgcgcgtcgagctataaacgagcgagttcagacagtgcgtttgctttggtggatatctcgaagtgcgagccatgccaagtagaagacacccgtgcgtccgcagaacaggccgaccgtaaaccctgatgcggcaccagcaaggacgagcatttccacagtggccgagaattctcgatgtacggcagcttgataaccgatgaagtatttcacggcaaaaaagagaagcgagataccaagaactttccatgtcccaggaacgatcaggtgcttgccctcctcgtccaaagtcagtccgcgtcgaggaaatagtgcaaatgcgactaggccacctaaaagcattcccgtggcccagctgcccacggtcaattcaacgcggtccgcgtagctgagagaaaggagtgaccaggccaccaaaacaaccggtgtgatgatcagcgaccgctgactctcacgactggttttcctggcactaaaaccgtagtagcagactaagagaaatgcgccgtaaacccacagtggcgtgccttccagagcatcgaacattgttcagcttccttgccaaagtttgtggccggatgctggcacagcctcgtaaatgttgccacttatttcaaacaacacgagcgccctcaggaggctgcatcggaatgtcggcgggtcatgaaaaaagctgagctggattggcgagcaagcgagcggtggtctcttggaactctctgggatgttcgccattactcgcggtatgtcttaaaatatccggttgccgaagaaccgccatgaccatatccatgaagggcttcaatcctttacaaataagtgtggttaagatgaacaagcctttcatttcgctgtgccctgaaattactcgggcgcatgcgctgacattaatgaattggttagaggatgagcgcgtcacctgctatctgagcgattcgcgccatgtctcccgcgccattgagcaagccattgatcggactcagttgccgatcctgacccatctattcaaccggggcggcagattctttatggcctatgaccggcatgacgccccggtgggctttgtccgtctggtcaagaccgactcaaattgcgagatagtcctagtcatcggagacagcgacaaatggggccgaaacctaggcgcccgcacgatccgcgaaggcatgaaactggccttcctcgacatgcgggccgagaagctcatcgccaagattcacccggacaactcgcgctcgctgaaagcctttctgcgcagcggctttatgcttgagagcgaaacgccgacattgaagtcgttttccatgacggcggcgcgctatttccagttcttgcgcgaaggagctggtggcgactccaccaggatctacatcactgaaatcgacaaggccaggctcgagaatctaatcgcgctcgagcaaggcccggcggttgttgaactcgaacatgagcttgagcgagccattgtcgttaaaccgcagcaggtggcgtgcaatgtcatcacgatgaactctagggcattgctgcaactgggcgacgaagagttcgaagtggccttggtctaccctgaagacgcggacagcaacgcagggaagcattccgtgtattccgacataggcgccgccatccttggctatcaggagggagacgccatcgactggcgaatttctgatcggacccgccggattgagatcaagagagtgctttaccagccggaggctgcgggcgacttccacctataattgcgccttgtgctcagtattcgcccatcagacgcgaggactccccaaaggacggcgcctcgccttccgtgcctgagcgatccgttgtagggtcaagggtaggagcagagccagttgcgagaggcaggaggcggtagaacagacctggccggctcctgcgacagttttaattctctaaatccaagccttcccgtaataccccaccccaaaacaaattgccaccaccggccaccggagggcggcgcctgactggagataatccatggacgaacagttctaccttcaagacggccgcagtcacgcctatgtcggcgacgggttgtcgttctgaggcctcgagggttccggatacgtaaccgacccggccaaggcccaggtgttcacctgtgtcgtccacgaccgactggtcggaagctgggaagctggagcaatccatgattggttcaaaatcggtacaaccctaaccaatcatcggcttagagcctttatttaaaggctctctaccactttatgatccatactcctagaatgtaacgtcatttgtcataaaacccgttcccggacggtatttctttactttttagcgagttcatccgcgtgaaaattcgtctttcaattatcagcctgtttttcgctttcacaggcaccttcgcccacgctgccgaatccactctggccccgcgtgatgcgtccaaactgcagattgcttccggcagtgccatgctggtggacttgcaaaccaataaagtcatttattccagtaatcctgacgtggtagtacccatcgcttcggtgagcaagttgatgaccggcctgattgtgctggaagccaagcagaacatggacgaatacatcgacatcaacatcaccgacacgccggaaatgaaaggtgtgttctcgcgggtaaagatcggcagccagatgccgcgcaaggaaatgctactgatcgcgctgatgtcctcggaaaaccgcgccgcggcgagcctggcccatcactatccgggtggttatgcagccttcattgcggcgatgaacgccaaggccaaggccctgggcatgaccagcacccactatgttgagcccactggcctgtcgattcataacgtgtcgactgcccgcgacctgagcaagctactggcttatgcgcgcaaatttccgatgctgagccaactgagcaccaccaaggaaaaaaccgtggcgttccgcaagcccaactacaccctgggtttctccaatactgatcacctgatcaaccgcgccaactgggacatcaagctgaccaagacaggctttaccaaccaggctggtcattgcctggtattggtgaccagcatgggtaaccgcccggtgtcgctggtgatcctggatgcctttggcaaattcacccattttgccgacgccagccggattcgcagctgggtcgagaccggcaaaggcggcgcagtgccggacgtggcgttgcgctacaaggctgacaagaatctgaagaaccgggggaatgcggtagaagttcgccgctaacctcaccagcattactgaagcaccgcaaaccaatgtgggagggggcttgcccccgatagcagtgtgccaggctataaaacttatcctgatagaccgctatcgggagcaagccccctcccacatttttatttgcgctctgccagaaccttgagcgcctgcgctgccgcttgctcctgccccgcctggcccgttgcattcgccgcattacgccagcgctgcgcatccacattcgccggcagctggctcggccgctgagtcaggatggcccagtgccccgcgctcttccacgccgattcgaagtcgctgaaccccatggtcaatcggcgctcgttcccggaacgcaacaacaccgtactcttctgctggttgaaccccaccaccacgacatagcgcgccccggaccagaagctggagttgattcgcgccattaccgggtaacctgccgccacctgcgcaagcagcgcagtcagcttggcatccagcgggtagaccatcagcccgtattcacgggccagtacctgcatgttgcgttcaagatccgcctcagcgcccggaagacgcagcggcttatccaaaagcccgggcgtcatgacaatgccttgttgcgacagcatgctggccaatgccgtaggaccgctctgataagcctcgctgcggaaggtcggcacgccgttgagttcgacgcgctctggcaggccaggcagtttcgagggctggctggaacaggccacgagccccagggtaacggccagcagcagtgaggttctaatgttcgaccgtgtacacaattttttgactctcttgatcaactgccggtgaaggccccgatcatagggcgctctgcgacgtgggtatagcccactgagctagtaaagccttgctgatagagcaaagaagttggacagactcgaccattggtcaatagcaggcaaccgccgtgtagctagactgtccattgagaagactgtgtgtgccccaaggggcgaaaggaggcccgaatgagccttgctacgacgattttcctgttgatctgcggttggctggcggtcgccgccgccatgctgtggggcgtcatgcgcgtgacccgccggcatcatcacccccacgtcaaacccgcagcccccgccaagccgcccaaggcgacggcgcatcatgcctagccaggcatgcaattgaagtcctgagtcgccgcgatttccttgccgtgcccatcctcgagggttgcacgcacggtggtacccaggctcgactccaccagggtgtagtgttcgcccgccttgaaatgcttgtactcgatccggccctggcaatcctgctggttgtcgtcgcctggctcctcttcaaataacgttacgtccaggcgatggtcccccggggtcacttcaaaatagcggccgtcatccacgcgctggccgtcaacgcgctcagccatcaggtcgttcggtgcttcttccttcaagccgatccaggcttcgctggggtcagccttggggatggggccggcgcaggccgagagcaacaatacaacgccaagtgcgggaatcaacaacaggggtctatgtgacatggcagggctccaaaggcatcaaaaaaagggggtatccgatggctgacaagcttgatcagcccgcctttgtagaacaaatgaatacatatgaaacgatcttcagccgttaactaaatcttccttcacctggctgaaaggtgcgtgttaggtgggtcgggcaagactgccggggtttgcaaccctgcttttctcggagactcacgcatgctcgggctggtaaagaccgcactgcaaaagccgtacacgttcatcgtgttggccatattcatctgcatcatcgggcccatggcggccctgcgcacgcctactgacgtgttccccgatatcggtatcccggtggtcgccgtggtctggcaatacaacggcctgtccccggacgccatggccgggcgggtgatctacacctacgaacgctccttgagcaccaccgtcaacgacatcgaacatatcgaatcgcaatcgctgcccggcatgggcatcgtcaagatcttcttccagccgggggtcgatatccgcaccgccaacgcccaggtcacggcggtgtcacaaaccgtgctcaagcagatgccaccgggcattaccccaccgctgatcctcaactacagcgcctccacggtgccgatcctgcaaatggcgttctccagccccagcctctcggaagccaggatccgcgacctggtgcagaacaatatccgcctgcccctgagcgccctgcccggcttggctatgcctacgccgatgggcggcaagcaacggcagatcaccctcgaccttgacccgcaagccctcgccgccaaaggcttgtcggcccaggacgtgggcaatgccctggcgttgcagaaccagatcatcccggtgggcaccgccaagctcggccccaacgaatacacgattttgctcaacaacagccccaaggcgatcgatgagctcaacgacctgccgatcaagaccgtcgatggtgcgctgatcaccatcggccaagtggcccacgtgcgcgacggctcgccaccacagaccaacatcgtgcgcgtcgacggtcatcgcgccgtactgatgccggcgttgaaaaacggcagcatctcgaccctgtcgatcatcgacggcatccgccagatgctgccgcgcatcaatgaaaccctgccgccttcactgaaaacctcgctgctgggtgacgcttcggtgttcgtcaagcaatcggtgggcagtgtggcccaggaaggcatcatcgccgcgttgctgaccagcgcgatgatcctgctgttcctcggcagctggcgctcgaccctgatcattgccgcgtcgattcccctggcggtactgtcggccattgcgctgctggcggtcagcgggcaaaccctcaacgtgatgaccctcggcgggctggcgttggcggtggggatcctggtagacgacgccacggtgaccatcgaaaacatcaactggcacctggaacaaggcaaggcggtgaagactgcgatcctcgacggtgccgcacaaatcgtcggcccggcattcgtctcgctgctgtgcatctgcatcgtgttcgtgccgatgttcttgctgcaaggcatcgccggttatctgttccggccgatggccctggcggtgatctttgccatggccagttcgttcatcctgtcgcgcaccctggtgccgacactggcgatgtttctgctcaagccgcacacaccggagccaggcgttgggcatcatcctgaagacgcgttcatcaaccaccatgaaggcgagcagcacaagcagccgcgcaatgccgcgctgcaagccgtattgaatttccagcaaggtttcgagcgccacttctcgaatatccgcgacacctactatggcttgctgacgttggccctgggtcatcgcaagcgctttatcgtgggttttctggcctgtgtactcgcgtcattcctgctgctgccaagcctgggccaggactttttcccggccaccgatgcaggagccctggcgctgcacgtgcgtttgccgctgggcacgcgcatcgaggaaagcgccgcggccttcgaccgcatcgaagcgcggatccgtgaagtgatccccgccgaagaactggacaccatcgtcgacaatatcggcatcccgctaagcggcatcgacatggcctacagcagcagcggcaccattggcccgcaggatggcgacatccaggtcaccctgaaaaaagaccatgcgcccactgccgactacgtgaaaaaactgcgtgaagccctgccgcagagtttccccggcagccacttcgccttcctgccggccgacatcagcagccagatcctcaacttcggcgcgccggccccgctggatgtaaaaatctccgggcgcagcgatgaagaaaaccgcgcctacgccgtggaactggagcgacgcctgcaacatgtgccgggcatcgccgacctgcgtatccagcagtccaccggctatccatcattgcaggtgaatgtcgaccgcatgcgtgccaatggcctgggcatcaccgagcgcgacgtcaccaacagcatggtcgcctccctcgctggcagctcgcaaaccgcaccgaccttctggcttaacccggccaatggcgtgtcctattccattgttgctgccaccccgcaataccgcctcgacagcttgccgtccctggaagcgctacccgtgaccggcgccgatggccagtcgcagatccttggcggcgtggccaccatttcccgtgtgcaaagcccggcggtggtcacccactacaacatcgaaccgaccctggacctgtatgccaacgtacaaggccgcgacctcggcggcgtcgcccgcgacgtgcaaaaagtcctggatgacaccgccgccatgcgccccaagggcgcgacgatcagcctgcatgggcagatcgatgcgctgcatgaggcgttcagtggcttgagtttcggtttgctcggcgcggtggtgctgatctatctgctgatcgtggtcaatttccaatcctgggccgacccctttgtgatcatcacggccttgccggctgcactggcgggcatcgtgtggatgctgttcctcagtggtacctcattgtcggtgccggcccttaccggagccatcttatgcatgggcgtggccaccgccaactcgatcctggtggtgagcttctgccgtgaacgcctggccgaacatggcgatgcattgaaggcggcgcttgaggcgggctacacacgcttccgcccggtgtgcatgaccgccctggcgatgatcatcggcatgctgcccctggcgatttccgaggagcaaaacgccccgctcggccgtgcggtcatcggcggactgatcttcgccaccctcgccaccctgttgtttgttcccgtggtcttcagcctggtccacggtcgtcaccctactcgcgctgcagctggagaaaccgcacatgtcgtctgatcaaaaaccctcgcgcaagcgtctgatgctcatgggtgccggcggcctgacgttggccgccctgttggtcgccagcggcctgcacgctcgcacgctgcacgaacaatcggtcactgcctggaccgaggccgccgccatcccccaagtgatggtgtttcaacccaagcagaacgccgccggcgataccctgcgcctgcccgcgcacctcgaggcctggagcaaggcaccgatccatgcgcgggtcagcggctacttgaaggactggaaagtcgacatcggcagccaggtccaggccgggcagatcctcgccgaaatcgacagccccgaccttgatcaacaactggcccaggcccatgcgcggctgatccaacaacaagcgaatgcgcgcctggccgccaccagcgcgacccgttggcaaaacctgctggccagccactcggtatcgcgccaggaggccgatgaaaaaacctccaacgccgcggcggccaaggccaacgcccaggccgccgctgccgactatgcgcgactgtcggcgctggaaagctacaagaccattcgggcgccattcgccggcaccatcactgcgcgcaacaccgatatcggccagttgatcaaggccgataccgacagcgaccctgagctgttcaacattgccgacactcaccagttgcgcctgtatgtgccggtgccgcagaactatgcagcggtgatccatcctggcctggaagccgagctgaccgtgcccgaacaccctggcgagcacttcaaggcgcgcctgatcggtgactccaccgccatcgaccgccgctccggcaccctgcttgcccagttcgtcgccgacaaccccaacggcgaactgctgcccggcgattacgccgaagccaccctgccgatcccggccgatacccatggcgtgagcatcccggccagcgccttgatcttccgcgcccagggcacccaggttgcggtgctggacaagcacaatcatgtgcacttgcaagccattcatatcggcctcgacctgggcgaacgcctggtgatcgaccaaggcctgaagcccgccgaccgcatcatcgacaacccgcctgacgccctgcgcgaaggcgactcggtgcaactggctgacgcctccggaggtgcccatgcgcccaaggcttaaacccctcgccgcactgatgctgctggcattgcaggggtgctcgatggcgcccacctacacaatgccgagggtggacctgccgactcattaccgcgaacagaccagcgacggaccgtggcacagcgcacaaccgtccgaccaattggcgcccgaatggtggaagctctacaacgacccaacgctggataacctgcaacagcgcctactccaggccaaccccgacctggcggcagcgctggcgcatttcgatgcgtcccaagcgtatgccagccagttgcatgccggcctgttcccgcaactcaccgccagtgcacaaccgctgcgccagcgacaatcggattcgcgaccgttgcgggggagcacgcagccgtcggtgtacaacagcaacaccgccggcttttccctgagctatgacctcgacctgtggggcaaaatccgcaaccaggtggctgccgggaatgcccaggcgcaagcgtccgcggatgacctggcggtggcgcgattgagccttcaacaccacttggcgagcttgtatgtgcagctcaatgggttggatgcacagggccggatactcgacagctcactggaggatttccgccaggcgctacagctgacccgcaaccgttatgaaggccagattgcttcggagctggacctgacccgcgcacaaaaccaactggcgcaagccaaggccgaacgcgatgaagtgcgtgggcaacgcaacctgaccgagcatgccattggtgaattggtgggggtggcggccagcgatttttcattgccgcccagcccccagttgcttgcgttgccaggggttccgtcgcagttgccgagccacctgctgcaacgccgcccggacatcgccgcggcggaacgacgggtgtttgcggccaacgcgaatatcggcgtggccaaggccgcgtggtatccggatttcagcctgaccgggttgattggcgggcaaacccaaggcgtgggtaacctgctgtctgcaggcaatcgctattgggcgctggggccgctggtgaatctgccaatctttgatggagggcggttgagtgccaacgaacgccaggccaaggccgagtttgaagaggcatcggcgcagtaccgtagtcaggtgttgaaagccgtgagagaggtcgaagataacctggggcagctaagggatttgcagcagcaagcgcaggatgaacaggcagcggcggatgcggcacggcatacccaagccctggcgatgaacagctatcaggccggggccgtgagttacctggatgtggtcaccgcccagacagcggcgttgcaggcgcagcggacattgcaggcggtgcagacgcggcagttgcaggcgagtgtgggactcgtgaccgcactcggcggcggctggcagcctggggcctgacatcaccctacacccgatggcggtgagtcagtcaatgatgctgtgattcaaatactgcaatcgggagcaagccccctcccacactggttctgcgccagacacacaatgtatgaacactgcgcaactcatgtgggagggggcttgctcccgatagcgcccttccagacacatcctgccaaaagcctacccgccagcttcttgctctgcggtctagcctccctagacacatctgagagggccagcgaatggcagatttacccgcttcacaccgcctgcgcatcggtcgactcagcgagccgaatcgcatctacctcatcaccaccaacacccataaacgcctaccgatattcgacaacttccatctcggtcgcctggttgtctggcagtttcgaatagcccagtaccaagggctggcgaactctctggcatgggtgatcatgcccgaccactttcattggatcgtcgagctgcgaaaaggctcgctggcggatttgatatgtcaggtgaaatcgaaaagcacgcgcaccgtgaatggtgcaagcggccgtaaggggcggttgtggcaggagagcttccatgaccgtgccctgcgcaaggaagatgacctggtgaaaatggcacggtatgtggtggccaatccattgcgagcggggttggtcgagcggattggcgactacccactgtgggatgccatctggttgtagcgccgcaattcaaatgtgggagggggcttgctcccgatagcggtgggtcagttaatacacatgtacctgacacaccgctatcgggagcaagccccctcccacatttttttgcatttcaagcggctaacttgccgctggcgattgccgccgaggccgccaccatcgcccttaacaacaccgcacatcccgccgccaaatcatccggcgcggcgttctcgatttcgttatggctgatgccaccttcacacggcacgaagatcatccccgccgggcccagctcggcgacgaagatcgcgtcgtgccctgccccgctgacgatatccatgttcgacaggcccaggctattggccgcatcgcgcacggcatcgacacagcctttgtcaaagtacagcggcgggaaatcggcggtgggttccatctcgtaagtcagcccatgtttggcacaggtgtcatcgatcacctggcgtacctgggcaatcatcgaatccaaccgcgcaggttccaggtgacggaagtcgagggtcatgcgcacttcaccgggaatcacgttgcgcgagcccggatacgcctgcaggcaacccacggtgccgcatgcatgaggctggtgcccaagcgcggccgcattcaccgctgccaccaccgctgccgcacccaccagggcatccttgcgcaggtgcatgggcgtcggccccgcatgggcttccacgccacgcagtttcaggtcgaaccacttttgccccagggcgccgagcaccacgccgatggttttcttttcatcttccaggatcggcccctgttcgatatgggcttcaaaatacgcgccgaccttatgcccgctctcagggcgtgtgcccgcgtagccaatcgcgttcaatgcctcgccgacactgacgccatctacatcgaccttggccaaggtatcggccaggctgaatttcttggcgaacaccccggagcccatcatgcacggcgggaagcgcgagccttcttcgttggtccacaccaccacttccagcggcgcctcggtttcgatctttaaatcgttgagcgtgcgcaacacttccacgccggccaacacaccaaagcatccgtcgaacttgccgccggtgggctgggtgtcgatgtggctgccggtcatcaccgggggcaggtctgggttgcggcccgggcgacgggcgaagatattgccgatgccgtcgacggtcactgtgcaaccggccgcttcgcaccactgcacgaagaggtcgcgggccttgcggtcgaggtcggtaagggccaggcgacacaccccgcccttgggggtggcgccgagtttggccaggtccatcagcgactgccacaggcggtcgcggttgatgtgctgatgggtcgattgcagaacgtcgagggcagcgttcatggggatctcctcaggctgtatttcttatgattgcatttcatattcactacaacggtgatttggcagccactgggttggtcgcacgcttggcattcaaaccgtaatacaacactccacccaaggccgagccggtaaaccagccatagctgtagaaccagctgaacgcatcactgcccagggacagcagcgtcagcaccaccggcacaccaaaggcgataaaaccgctcaagttccaggcggggtacacgtcatcgcggtacaagcccgccaggtccagctgctgtctgcgggtgatgaagtagtccaccaccatgatcccggcaatcggccccagcaggctcgaatagcccagcagccagttggaatacaccgtctccaggctcacatcggaaacgatcaagccgagttttttcagcagctcatgggccatcagtgccagcccgaccagaccggtcaggatcaccgccgtggtgcggttgatcagcttgggcgcaatgttttggaagtcgttggtgggcgagacaatgttcgccgctgtgttggtggacaaagtggcgacaatgatcagcgccatcgccacggccacccataccgggctctggatatggcctatcagggtcaccgggtcggagacactgacgcccaccagttttaccgaggcggcggtcatgatcacgccgagggcggcgaacaggaacatggtcagcggcaagccgaaaatctgcccgaggatctggtctttctggctcttggcgtagcggctgaagtcgggaatgttcagcgacaaggtagcccagaaccccaccatcgccgtcagccccgccatgaaataaccggtgaggctcgcgccttcggggcgcttgggtgggatcgccatcaattcgctgagggacacattcggcatcgcccacaccagcaggccaacccccaccgccaccagcagcggtgccgacaaggtttccaggcgcttgatcgactctgcgccacgcagcaccacccacaggttcaggcaccagaagatcatgaaaccgatcacctcaccggtaccaccaagggccttccagccgtcgaaaatcgaacccaggaacaggtgaatcgccaacccgccaaacatcgtctggataccaaaccagccacaggccaccaacgcgcgaatcaggcacggcacgttggaaccgagaatgccgaatgacgagcgcagcagcactggaaacggaatgccgtacttggtgcctggaaaagcgttgagggtcagcgggatcagcaccacgatattggccagcaggatcgccatcagcgcctcgcccaccgacagcccgaaatacgcggtgagcacaccgcccagggtgtaggtgggcacgcagatcgacatgccgacccacaacgcggtgatgtgccatttgttccaggtgcgctcgtgcaccttggtgggtgccatgtcgtggttgtagcgagggctgtcgaggacgtcggggccggcgtcgagttcatacaggccgttgcgctcgatgacttgcgatctgttctgttgcatggccgctccacggtttttttaaaattattgttgctcacctgcacgttgtgtccaggtggccggagtaccgcgtaaacaacatgacatcacgggctcctgccagccgccactgcactcaattaccgtgccgacaacccaacttgaacccgcaccgcttatataacgtgctgatgttattcaactttcagattgtattccggcgtccgtcgacgttatgcagactacataacgcgaacgttatccgaaccgtccggactcaatctggtgcaacacaattatttttatttgccgacgccgtcaagaggcatatctcaagcgtctgatttgcaataagaaatgttgctcaaaagcagaacctgtcaagtgcgtcaaaacggtgaggtgttgctacattttggtgactcagtaatttttactctataaatcagtagcttaatgtcagaaaaagctgaagaaaaatcttcttgctcaatctaaaaactcgggctagtttctattcctgtcaccgatgacaggaattaaccgaccatcggcgtgcagcattacaacacttagaactggcacaagccggtcaagcctgtgaggaactcgacatgtcgctgttgatccgtggcgccaccgttattacccatgatgaaagttaccgcgccgatgttttatgcgcaggcggtctaattcgcgccgttggcacggatctggatatacccgccggcactgaaatactcgatggcagcggccaatacctgatgccgggcggcatcgacccccatacccatatgcagctacccttcatgggcaccgtggccagtgaagactttttcagtggtacggcggcgggtctggccggtggcaccacatcgatcatcgacttcgtgattcccaacccgcagcaatcgctgatggaagcgtttcaccagtggcgcggctgggcagagaagtccgcctccgactacggctttcatgtggcaatcacctggtggagcgaacaggtacgcgaagaaatggccgagctggtcagccatcacggcatcaacagcttcaagcatttcatggcctacaagaacgcgatcatggctgccgacgacaccctggtggccagcttcgagcgctgcctggaactgggcgcggtgcccaccgtacatgccgaaaacggcgagctggtgtaccacctgcaacgcaagctgatggcccagggcatcaccgggccggaagcgcatccgctgtcgcgcccgtcccaggtggaaggcgaagcggccagccgggcgattcgtattgccgagaccatcggcacgccactatacctggtgcatgtgtcgaccaaggaagcgctggatgagatcacctacgcccggggcaagggccaggcggtctacggcgaggtgctcgccggccacttgttgctggatgacagcgtctaccagcaccccgactggcagacagccgccggctatgtgatgagcccgcctttccgcccgcgcgggcaccaggaggctctatggcacggcctgcaatcgggcaacctgcacaccaccgccaccgaccactgctgcttttgcgccgaacaaaaagccgctgggcgtgacgacttcagcaagatccccaacggcaccgccggcatcgaagaccgcatggcgctgctgtggcacgaaggcgtcaacacagggcgcttgtcgatgcaggagttcgttgcgctgacctccaccaacaccgcgaagatcttcaacctctacccacgcaaaggcgcagtgcgcgtaggtgccgacgccgacctggtgctgtgggatccgcaaggcacgcgaaccatttcggccaagactcaccatcagcaggtcgacttcaacatcttcgaaggcaagaccgtacgcggcgtgccgagccacaccatcagccagggcaagctggtctgggccgatggcgacctgcgcgccgaacgtggcgccgggcgctatgtggagcggcccgcgtacccgtcggtgtttgagcagttgagcaagcgggcggagcattccaggccggttgctgtgaagcgctgaaaccgccatcgggggcaagtcgaatcgtcgcaccgcccctcccacatttgatcgggttcacatagatccagtgtgggagggggcttgcccccgatgaggccagtacagccaacaaaaatgcccacatagaggcaatccaaaaaaaaccgtgaggccaccaccgtgatccagaccctgacccacctcccccacccccgagaagacggggccaccctcgccagccaattcaccgacctggcaccgcccctcaacgcccgccaagcccaactggaagcctcgcgctgcctgtactgctacgatgcgccatgcgtgaatgcgtgccccagcgagatcgatatcccgtcgttcatccgcaatatccacaccgacaacgtccagggtgctgcgcagaaaatcctctcggccaacatcctcggcggcagctgcgcccgggtctgccccacggagatcctctgccagcaagcctgtgtacgtaacaacgccgaagaatgcgccccggtgctgatcggcctgttgcaacgctacgccatcgataacgcgcacttcaacgaacaccctttccaacgcgccgcgcccaccggcaaacgcatcgccgtggtcggcgccgggccggcgggcctggcctgcgcccaccgcgctgcattgcacggccatgacgtggtgattttcgaagcccgggaaaaagccggtggcctgaacgagtacgggatcgccaaatacaaactggtggatgactttgcccagaaggaactggatttcctcctgcagatcggcggcatcgaaatccgccacggccagcgcctgggcgacaacctgagcttgagcgagctgcaccagcagttcgattcggtgttccttggcctaggcctggccgccagcaaacagctcggcttaccccacgaagaggccccgggcctactcgccgccaccgactacatccgcgaactgcgccaggccgatgacctcagccaattgcccctggccgaccgctgcatcgtactcggcgccggcaataccgccatcgacatggccgtgcagatggcccgcctcggtgcacgggatgtgaacctcgtgtaccgccgcggcctcgcggacatgggcgcgacccaccacgaacaggacattgccaaggccaatcaggtgcggttgttgacctgggcccaacccgaagaagtgttactcgacgatcagggacgagtccgcggcatgcgcttcgcccgtactcacctggataacggtcgcctgctgcccactggcgaaaccttcgagctggccgccgatgcgatcttcaaggcgatcggccaagggtttgacggcgacgcgctgcacgacccgctggcccagcaactgcaccgcgtgggcgagcgcatctttgtcgacgaacagctgcgcaccagcatccctggcgtgtatgccggcggtgattgcgtcagcctcggccaggacctcaccgtccaggccgtgcaacatggcaagctggccgccgaggccatgcacgctcaactcatgctgaatgtggaggctgcgtaatggccgatctctcgattgtattcgccggtatcaaggcacccaatccattctggctggcctccgcgccgcccaccgacaaagcctataacgtggtccgcgctttcgaagccggctggggcggcgtggtgtggaaaacccttggggaagaccccgcggcggtcaacgtgtcgtcgcgttactcagcgcattacggggccaatcgcgaagtgctgggcatcaacaatatcgaactgatcaccgaccgttccctggagatcaacctgcgggaaatcacccaggtcaaaaaagactggcccgaccgtgcgctgatcgtgtcgctgatggtgccgtgcgttgaagaatcctggaaaaatattctgcccctggtggaggccaccggttgcgacggcatcgaactgaacttcggctgcccccacggcatgcccgaacgtggcatgggcgcagcggtcggccaggtaccggagtatgtggaacaggtgacacgctggtgcaagacgtattgctcgctgccggtgatcgtcaagctcacgcccaacatcaccgatatccgcgtggcagcaagagcagcgtatcgcggcggtgcggacgcggtgtcgttgatcaacaccatcaattccatcaccagcgtagacctggagcgcatggtcgccctgccggtggtcggcactcagagcacccacggcggttactgcggttcggcggtcaagccgatagcactgaacatggtcgccgaaatcgcccgcgacccgcagacccagggcctgccgatttgcggcatcggcggtatcggcaactggcgcgatgccgcggaattcgtcgccctgggctgcggcgcggtacaggtgtgcactgcggcgatgctgcatggcttcaggattgtggacgagatgaaggacgggctgtcgcgttggatggacagccagggttacaccagcctgcaggcattttcggggcgggccgtgggtaacactacagactggaagtacctggatatcaactaccaggtgatcgccaggatcgaccaggcggcgtgtatcggctgtgggcgttgccacattgcttgtgaggatacttcgcaccaggcgatcgccagtttgaagcaggcggacggcacgcataagtacgaagtgattgatgatgaatgcgtgggctgcaacctgtgccagatcacctgcccggtggcggactgtattgagatggtgccgatggacaccggcaagccgtttttgaattggacgcacgatccacgtaatccttatcgcgaggctgtgtaggccttttagaccgctatcgggggcaagccccctcccacagtggatctatgtgaacctgatcaaatgtgggagggggcttgcccccgatgaggcccccagcctcaggacaagactcaaggctccaacccaatcccccgcaaaatcacactggtcacggtctggatcgccttctcgaactgcatgtccgacaacggctggtggtcgttcaggatcttcacctggtgatcaaagtcggcatagtgctgggtcgaggcccagatcatatacagcaggctcgaaggctccaccggcaggatgcgtttgtcttccacccactggcgaatcttcgcctccttcatcttggcccagtcgtacaggctttcatccaatgcctcgccgagggtcggcgcgccgtggatgatttcattggcccagaccttggagccatagggtcgcgtccgcgagcgctgcatcttggctcggatataactgctgagcaccacccgcgggtcgtcgaaggtctcgaagctcagggcgtcctgcttccacagctcgagcaggtcgaacagcaccgcgctgtacagctcgctcttggtggtgaagtagtaatgcaggttagagcgtggcagttgcacctcttcggcgatgtcggccatggcggtgctgccatagcctttttcggcgaagactttttctgcggccaacaggattttctcaacgttgactcgacgaattccactcttgtgattgcccataagggctccctgacaacaacacggcctaaagactaccaccggctctagatcggggcgacaggccaagccgaaacttcgtacactgcccgctcctacccattgattggtattgaacaatgttgatcaagaaagccctgaccaccgtcgccctgctcacctctctgctgggcgcctcggcggcatttgcccatgcccacctcgagagcgcaaaacctgcggccaacagcaatgtcgccgcaccgaaagacttgcgcctgaccttcaccgaaggcgtcgaagccaccttcaccaaggtgtccctgagcaaggacggcactgaaatcgccatcaaggacctggaaaccccggacgcggacaagaaagtcctggtcgtgacccctgctgccccgctcgcgagcggcaattacaaagtggtgtggaatgcggtgtcggtcgacacgcacaagagcagcggtgaatacagcttcaaagtcggccagtaacccatggcaactctgctggtgctgtgccgtttcctgcattttatcgtcgtgctgctgatgttcggggcttgcgtgctccggccctggctgctcggcgctcaggtacaaccggctctggaccggcaactgctatgcatcacccgtggcctggcctggctggggcttggctccggcgtggcgtggttactgctgatcaccgccagcatggcgggcagttgggacgcagcgctgcaaccggccaccgtgcgattggtgctgggcaagacctttttcggccaggtatggacctggcatctgctgctgaatgttctgctggtgatcgtgctgatcaaaccctggccggccttgcgtttgccgttgatcaccctactgctggcgactctggcaccggtgggccatggcgccatgctcgacgggctgagtggacaattgctgatcctcaaccaagtggtgcatctgctgtgcgtaggggcttggctgggtgggttgctgttactggtgctgatcctcagacacgcgcaagaccagcggatggagccgattttgcggcgcttcagcggcgtgggttacggcctggtcgcaggcttgctggtaaccggtttgatcaacgtgcgcgtgctcaccgggcaactgtggcccacgccgttgttcaatgggtttgccctgattctgttgatcaaggtgatgctggtgctgggcatgttggcgctggcgctgctgaaccggttgcgccttgatcgctgcgaacagcggctgggcagcttgaaggccagtgtgatggtggagtggctgctgggggtctgcgcagtagccgccgtttcactccttggcaccctgcctccgatggtcctggcgggataaatccacggcatttttttaaagttgaaccgtgcccgctttatatcaaggctcggcaggtcatcgtataacttctgcttgacacacccagaaaaccccgtaaatatcccgcccaatgttgtacgacgacgtataacaaataataaaaacaacaaaagaaagggagcctcactgtgagtcaattcgcccgcaattcctgctcgtgcctcggccttataggtctcggcggcctggcgctgaccctgcccctcgataccaatgccgaaggcttcatcgaagatgccaaggccacgctcaacctgcgcaacgcctacttcaaccgcaacttcaccaacccgaccaacccccagggcaaggccgaagagtggacgcagaacttcattctcgacgccaagtccggctttacccaaggcaccgtgggcttcgggatcgatgtgctgggcctgtattcgcaaaaactcgatggcggcaaaggcaccgccggtacccagttgctgccggtgcatgacgatggccgccccgccgataacttcggccgcctgggcgtggcgctgaagaccaagctgtcgaagaccgaattgaaggtgggcgaatggatgccggtgctgccgatcctgcgttccgatgatggccgttccctgccccagaccttccggggcggccaggtcacgtccaatgagattgccggcctgaccctttacggcggccaatttcgcggcaacagcccgcgcaacgacgcgagcatggaagacatgttcatgaacggcaaagccgccttcacctcggaccgtttcaacttcggtggcggcgaatacaccttcaatgacaaacgcacccaggttggcctgtggtacgccgaactcaccgatatctaccagcagcaatacctcaacctcacccacagccaacctgtgggcgactggaccctgggcgccaacctcggcttcttcaacggcaaggaagacggcagcgccctggccggcgacctggataacaagaccgtgtccgccctgctctcagccagatacaacggccacaccttctacgtcggcctgcagaagctcaccggcgacagcgtgtggatgcgcgtcaacggcaccagtggcggcaccttggccaacgacagctacaacgccagctacgacaacgccaaggaaaaatcctggcagttgcgccatgacttcaacttcgtggtgctcggcgtccccgggctgaccctgatgaaccgctatatcagtggcagtaacgtgcacaccggggcgatcaccgatggcaaggaatggggacgcgaatcggagctggcctacacggtgcaaagtggtgcgttgaaaaacctaaacgtgcggtggcgcaactccaccatgcgccgggatttcagcaataacgagtttgatgagaaccgggtatttgtcagctacccgatatcactgctttaaatgtgccagagcttttgtaggagcgagcttgctcgcgagaaacctatgggcaccgcgtttattcagtaaccacgcgttatcgttaacgtttttcgcgagcaagctcgctcctactggaagggcgttgacaacacagggaatccctaacactatttcctcatagtcatacgacaacctacaacaaaaattggaatgctcatgaccaccaccacgcccgcccccttcaaccgcctgctactcaccggtgccgccggcggcctcggcaaagtcctgcgcgaacgcatgcgcccttacgccaaggtcctgcgcctgtcggacatcgccgacatggcccccgctgtcggcgctcacgaagaagtacagccttgcgaccttgccgataaacaagctgtgcaccagttggtggaaggcgtcgacgccatcctgcactttggcggcgtatcggtggagcgttccttcgaagaagtcctcggcgccaatatcagcggcattttccatatatacgaagccgcccgtcgccatggggtcaagcgtgtgatcttcgccagctccaaccatgtgatcggcttctacaagcagggcgaacaactcgacgcccactcccctcgccgtcctgacagctactacggcctgtccaagtcctacggcgaggacatggccagtttctacttcgatcgctacggcatccagaccgtgagcatccgcatcggctcctcgttcccgcaaccgcagaaccgccggatgatgcacacctggctgagcttcgatgacctgacccagttgctcgagcgcgcgctgtatacgcccaacgtcggccacaccgtggtctacggcatgtcggcgaacctcgacacctggtgggacaaccgctacgccgcgcacctgggctttgctcccaaggacagctccgaagtgttccgcgcccaggttgaagcccagccaccggtcgccgccgatgacccggccgcggtctaccagggcggggctttttgcgcagcagggccgttcggtgactgagtgcacagcaacccaagggaatgagtggccatgagcgctgaattgattgtcgacgtccgcaacgccgtgggcgaatgcccggtgtgggtgcccgaagaaaacgccttgtattgggtggatatccccaacggcagcctgcaacgctgggacgccgccaccggctacctcagcgcgtggaaggcaccacagatgctcgcctgcatcgcacgcactcaagcgggcaactgggtggcaggcatggaaaccggcttctttgaactgaccacccacaatgacggtagcctcgacactacgctcctggctggtgtcgaacacccgcgtccggacatgcgcttgaacgatggtcgctgtgatcgccagggccgtttctgggcaggaagcatggtgctggacatgggcttgaacgcggccgagggcattctttaccgctatgcgtccgggcgcgcgccccatgcgcaactggatggcttcatcaccctcaacggcctggccttcagtcccgatggccgcacgatgtacgcctcggattcgcatccgcaggtgcagcaggtgtgggccttcgactacgacaccaacacaggcacgccgtccaatcgccgcctgtttatcgatatgaaccacttccccggccgccccgacggcgctgccgtggacgccgacggctgctattggatctgtgccaatgacgccgggctgatccaccgtttcacccctgagggccgcctggatcgttccctcagcgtaccggtgaaaaaacccaccatgtgcgcctttggcggcagccgcctggacaccctgtacgtcacctcgatccgtgacgatgcgagcgaacagtcgctgtccggcggcgtattcgcgctcaacccaggcgtcaagggtctggccgaaccgcacttcatcctctagctgtactgtgtgccttgaatacaacaataacaagacaggagtgacaccccatggacttcaaacgcaccttgctcgccgccgcactcatcaccctcagcagcgccgcccacgcgctggaaatcaaattcgccgacatccaccccgccggctaccccaccgtggtcgccgaagaaaacatgggcaaggcccttaccaaagcgagcaacggcgaactgaccttcaagtactttcccggcggcgtgctcggctccgagaaagaagtggtcgaacaggcccaggtcggcgcagtccagatgacccgcgtcagcctcggcatcgtcggcccggtggtgccggatgtgaacgtgttcaacctgccgttcgtgttccgtgaccaggcgcatatgcgcaaggtcatcgatggcgagatcggcgacgaaatcctcgccaagatcaccaactccgagttcggcctggtggccctggcctggatggatggcggcacgcgcaacctctacaccaagaagccggtgcgtaagatcgaagacctcaagggcatgaagatccgtgtgcaaggcaacccgctgtttatcgacgccttcaacgccatgggcgccaacggcatcgcaatggacaccggcgaaatcttcagcgccttgcagaccggggtcatcgacggtgcggaaaacaacccgccgaccttgctggaacataaccactaccagaacgccaagtactacaccctcaccgagcatctgatcctgccggaacccatcgtgatgtcgaagatcacctggaacaagctcagccccgcgcagcaggacatggtcaagcaagccgccaaggccgcccaggccgacgagcgcgtgctgtgggacaagaaatccgccagcagcgaggaaaaactcaaggctgccggtgtcgagttcatcacggtcgacaaaaagcccttctacgacgccaccgcccaggtgcgcgccaagtacggcgcaccgtatgcagacatgatcaagcgcatcgacgccgttcaataacctccctgctccctgcataaggcccggcgcggtcggcatcgacgcgcccggtcacggtgaacgccatgaagaatctactgctgcgcatcaatgaccgtatctacatgacctgcatctgggtcgccggcctctcggtcctgggggtggcgctgatcattccctggggcatcttcgcccgctacgtcctcggcaccggttccagctggccggagcccactgcgatcctgctgatgctggtgttcacctttatcggcgccgccgccagttaccgagccggcgcgcatatgtcggtggcgatggtcaccgaccgcctgccccccgcccaacgccgcatcgtcggcatcttctcgcaactgttgatgggcaccatctgcctgttcatgaccctctggggcaccaagctgtgcctgtcgacctggaaccagttcatgagcgcgatccccaccctgcgcgtgggcatcacctacatgccgatccccattggcggcctgctgaccctgatctttgtggtggaaaaactcctgctcggggaccagagcaaccggcgcgttgtgcgcttcgacctggtggaagaaagcgaaggggctgcctgactatggacgcattgattctgttgggcagctttatcgccttgatcctgattggcatgccggtggcctacgccctcgggctgtcggcgctgatcggcgcgtggtggatcgacattcccttccaggccttgatgatccaggtggcgggcggggtgaacaagttttcgctgatggcgattccgttcttcgtgttggccggcgcaatcatggccgagggcggcatgtcgcggcgcctggtggcgtttgccggggtgctggtgggctttgtgcgtggcggcctgtccctggtcaacatcatggcctcgacgtttttcggcgcgatttccggctcgtcggtggccgataccgcctcggtcggttcggtgctgatcccggaaatggaacgccgtggctacccgcgagagttcgccacggcggtaaccgtgagtggctcggtacaggcgctgctgacgccgcccagtcacaactcggtgctctactccctggctgccggcggcacggtgtcgatcgcctcattgttcatggccggcgtggtgccgggccttttaatgagcgcgtgcctgatggtgctgtgcctgatcttcgcaaaaaagcgcaactaccccaaaggcgaagtcatcccgctcaagcaggcgctgaaaatctgcgctgatgcgctctggggcctgatggccatggtgatcatccttggcggcatcttgtcgggcatcttcaccgccaccgagtccgcggccatcgcggtgctgtgggcgttcttcgtcaccatgttcatctaccgcgactacaagtggagcgagctgcccaagctgatgcaccgcacggtgcgcaccatttccatcgtgatgatcctcatcgccttcgccgccagcttcggctacatcatgaccctgatgcagatcccggcgaagatcaccacgctgttcctgaccctgtcggacaaccgctacgtgatcctgatgtgcatcaacgtcatgctgctgttgcttggcacggtaatggacatggcgccgctgatcctgatcctcacgccgatcctgatgccggtgatcctcggcatcggcgtcgacccggtgcacttcggcatgatcatgctggtcaacctcggcatcggcttgatcacgcctccggtgggcgcggtgttgttcgtcggcgcggcggtgggcaaggtcagcatcgagaaaaccgtgaccgcgctgctgccgttctatgcggtgttgtttctggtgctgatggccgtcacctacatcccggcgttgtcgttgtggttgccgagcgtggtgctgtaacccaatcgtcagaacagaggtgagcaaatgtgggagggggcaagccccctcccacattttgttccgcattgtgtcagggtcagggtggtgaatttttcaggcgccccgcagtatcgatactcaccaccaccgacaaccccggccgcaaccgctcactctcggcctgatccgggtctacggtaatcctcaccggcacgcgctgggcgatcttgacgaagttgccggtagcgttgtcggcctgcaacaggctgaactcggacccggttgccggtgagatgtgctgcaccgtgccatggaatttgcggtggttcagcgcgtccacggtgaaggtcaccggctggcccacctgcacattgtccatctgggtttccttcatattggcgatcacccacagctgcttgggcaccagggccatcaattgcgcgccggagttgacgtaggcgcccaggcgcacgccgatctgcccgagctggccgtcgcggggggcggtgatgcgggtgttggacaaatcgatgcgcgccagttccaccgccgcctcggcactcgccaccgccgcttccagggagccgcggttgacgatgacggtctgcaggtcctggcgggcaatttccaggctggcctgggcctgggccacggcggcgatggtctgggcattggcggcgcgggtcacgtccagctcgcgcttggacaccgagccgtcgctgatcagctcttcattacggcgcagatccgccgtactcttgcgcgcctgggcctggctgtccaccaatgcggcctgacgcagctttatggtcgcttcggcgctgttgcgttgctgaaccacattggccagcgacgccttctgcaccgccagttgcgccagcgcctggtccaggcgctgcttatggatacggtcgtccaggcgcaccagcaggtcgccggctttcacatactggaaatcctgcaccggcacttcaaacacatagccgctgagctgcgggccgataatcgtcacctgtccgcgcaccagggcgttctcggtggtctccaccgcgctgctgaacggtggcaactgccaggcatacagcacgatcaacacaccgatgatggcaatcgcggcaaagcccagggacgagaggatacgcacccgcagggaacgcggctcggtcaccgtggcgccgggcggcgtggtgccttccggggtcgcggcgatggcgttggtggtcgtggtggtagaagtcggttcggtcatgaagaagcgccgctgggttgaacgggaggggttgctgccttggtggtgctcatcagccacaagctgcgggtaaagatccaaagcatggtcagcatcgcgataatcgcgatcagcatgaagacatcgttgtaggccatgacgttcgcctcacgggtggccgccgtggccaggctgcgaatacccatgaggttgcgcagctcagggtcggcggcgatcccaccgtaggccgaaccgccgctttgcacccgcgccgctacacgtggatcgatcaaggtcaggtgctcgacgatcatgctcgagtgatacttctcgcgcacgatctggaaggtgccgagcaaggccgcgccgatcaggccgccgaggttctggcaaatcccgaacatcaccgagaagctcaccaggttgcgtgggttggtcagcacgtttttcgtgcccagcaccatggtcggcccgaggaagaacgtgccgccaaagcctagcaggaactggctgatgtagaggttttgcggacgggtcaggttgctggagaaactgtccatcaccgagcctgtggccatcagcgccagggaaatcaccaggggcatcagcaggtgcgccgggttgatcgtcaatgcgctgaccaccagcccggcgatcgcgccggccagcatcaccacatacagggtatgcatctgctggtagctcatgttgagcatctgcatgaaccccaccgcaccggtggattgctcggacagcaccatacggatcagcaccaccgccaaggccaggcgaatcatcgcgccgctgcccagccagcgcgtcatcagcatcgggttgctgcggttatgctcgatggccagccccgtcatgatcagcaccagggaacaggccgaggccacgccgatccagggtgcttccagccaccagtcgatacgccccaacgacagcaccgcgcagagcaaggccacgccgctggcgaggatggcgaaggtgagaaaatcgagtttttcaaaggtcttgaagcggtcgccgggtggcagcttgagcaggaacacacagcccaggcagatcaaggccaggcccaattcgaacaggtatagcccgcgccattcggcgatctgcagcaagtcttcggaaaacaaccgcgccaacggtaacgcaagctgcgcggtgcccaagccgagcaccagggctttcaaacgccacttcgccgggaacgcctggatcatgtagtacaggcccagtgaactcagtgccgcgccgaccatgccgtgagcggcgcgcacggcgatggccgagttgaggtcgttgacaaacaaatgcccgaaggtcaccagcgcatagagcaccaggaacacctcggtaaacgcgcgcaggccgaactgctggcgaaacttcaccagcagcaggttcatgcacacgttggtcattacataggcggccggcagccaggccatttcagcagtagtcgcgcccagggcgccttgcaggtattgcaggttggcgatgaccagggcattgcccaggccaccagtgatcgccaccagcactccgaccatcgcgtacagccagcgtttgtgggtggggtgcagcggcgtcgacggcgaaccgggcaggctcgggcgctcgtggggctgccaggtgtggggggtgtatttatccattcggtgaccttgatgacccgacgggttaagtcggtaaaaccattactcaggcacagtaaacctgagcggcgttcatcttgccattcggacgtatcggtaagcgcccattcagccagtcacacgctgctttctttgctcgaagacagtgccgccatgatctcggtgcgacaagacactatgatgtcgatcataatcaaaacagttgacagctttgattatgatcgacatcataaattcaccagcgcatgtctctgtggctgttcggcgcagatcgccgtctccgatcaacgtgtatggaatcgaaatgaacgccaatcctttgtttgaaccctacacactgggcgcactgacgctttccaacagagtggtaatggcaccactgacgcggaaccgcgcaggggcgggctttgttccgagtgagtacgctgcaacctattacagccagagagcgtcggcaggcctgctgatttctgaggcgacccagatctcgcagcaaggtcagggctatcaggatacgcccggtatctataccaaggcgcagattgaaggctggcgcccagtcaccgacgccgttcatgccaaaggcgggcgcattttcttgcagctgtggcatgtcgggcgcgtatcccacgtcgaccttcaggcaaacggtgctgcgccggtggcgccttccgccctgcaagccgcgacaaaagtcttcgtcaacaaccgcttcgaagatgcctcggcccccagggcgcttgatatagaggagttgccggggattgttaatgactttcgccaagcggcgataaacgccatcgccgcggggttcgatggcgtagaaatccacggcgctaacggctatctactcgatcagttcctcaaggacggcgccaacattcgcaccgatgcctacggtggctcggttgaaaaccgtgcgcgcttgctgctcgaagtcacggctgcagtagtggatgagatcggtgctgatcgaaccggcatccgtatttcgccggtgtcaccagccaatggggtttcaagcagtgatccgcagccgcaattcgactacgtcgtcgaacagctcgatgccttgggcctggtttacctgcatgtggttgaaggggccaccggcgggccgcgcgacgtctgcccttttgactttggcgcgctacgccagcgcttcaaaaatacctacatcgccaacaacggctatgacctggatctggcgacctcccgactcaacgacgacaaggctgacttgatcgcctttggacgcccgttcattggcaacccggatttggtcgatcggctcaaaaacaatgtccccttatccgcaatcgatccgacgacgctgtatggcggcggtgcagcgggctatatcgactatccggcgcttggcgaaaccagctccgcacagggctgaacagcctggaagctgacctgactcaaactcatgaaccggcattgaataagccgtgatcaaggtgcatgccagcggggcagagcgaagggcaaagtgctcatcaggatcatatgagcaagcactcaataacaggctgaatatcaaatgaaaacatcttcgcaaagaaccgcaatagtgacgggagcatcgtccggtattggtcaagcgactgcgcaggcgctggtgcgtgccggctatagggtatttggcacaagtcgcaaggcgggtgccagcgcaacgcaggtatccatgctcacctgcgacgtgacagacgatgaatctgtcagtgcgctcgtgcgcaccgtactcgaacagaccgggcggatcgatctgttggtcaacaatgccggcatcggtatgctcggtggcgctgaagagttctcgatcccgcaggtcaaggcattgttcgatgtcaatctgttcggggtgattcgcatgaccaacgcggtattgccgctgatgcgccaaggtggacaggggcgcatcatcaatatcggatcgatcctaggcgtagtgcccgcgccctactccgctcattattcggcggtcaagcacgcgctggagggctattcggaatctcttgatcacgaggtacgcgcattcgctattcgcgtttcggtcatcgagcccgcattcgtgcgaaccgtcttcgatcaaaacggcatcgagccggactcgccgttgacggagtacgatcagcctcggtccgggttccgggcactgctgggcgaggtaatgcccaaggccgacctcccagacgtcgtggcggcagtcgtagtgaaagccgcgaccgatgcccgccctcagcatcgctacacggctggcaaggcagcgcgacaaatcagcctgctgcgccgcttcgcccccgccgggttcttcgacacggccttgcgcaagcaatttcgcctgccggtttgaatcactagacgtgcggttgtgcgcattcagcatgcgcattccaaatcagacccaacccagccaactccaataagtggccgcaaacaccaacatcaacccatagccaatcaacgtcaccaggatccccaccttggcaaactgccgcgccgtaaacgtcccggtgcccaaacacaccatattctgcggcgcattgatcggcaggataaacccatagctcatcacaaaccccagcagcatcgtcatccccaaccgattgaactcagtcggcaaggtctgcaacaccgcgatcaatatcggcagcaacgccgaggtcagcgccgtcgcactggcgaaccccaggtgaatcacgatcaaaaacgccgccaggattgcaaacactcctaacggcccgacaaggcccaacccggtatgcgtcaccacctgcgagcccagccattgcccagcctgggtggtcagcagtgcggtacccaggctgatacccacgccgaacacaatcacagtgccccaggggatgcgcgactgcacatccttccaagtcatcacaccgatgcccggcagcagcaaaaagaccagacctgcataggtcgtcgaagtagtgtcaaacgcgtgcaggcggccttcggtggcccaggccagcaacagcaacaccgagaccgccaacaggcgcttctgcggtccggtcatcgggccgatgtccaccaacgattgggccaccgcttccttgccgccaggaatgctgtcggtttccggcggcagcaacttgatcaccagcaacagcaataccgccgacatgatcactgcccacggcgcgccggcgatcagccagtcgatccacgacacgcgctggccgagcatcttgtccataaagcccacggtcaacaggttctgtgcagcggcggtctgaatcccgacgttccagatgctggtgccctgggccaccacgatcatcagcccagcggcgatgttcgagcgtttgtcgacgccaaacgcggcaaccacccccatcatgatcggcaccacgcaggcactgcgcgccgtggcgctgggtacaacgaggctgagcaggatagtcaccgcaatcgcccccagcaaaataccgcgcgtactggtgccgacccgggtcagggtcaccagggcgatgcgtcggtccaggcccgtgtgggtcatggccgcagctatgaacaacgcccccgccaccaacgccagcgccgggttggagaagccggtgagcgccatgctgatggccgggctggagccgatcaggtgcgtgggatcctgcagcgacggcgcggtgcccagcagaaacgccatgagcgaggtgatcatgatcgcgctggcttcataagacaccgcctcggtgatccacaccaccacggcaaacgcgaggatcgccagcatgcggtgcccggccaccggcaggtcggcgggcagcggcaacagcaggacgccgaccatcaccagcacgccgaccaccaggcccaggggtaatttgaaggatgccgtggttattgccggggcgctcatggggggtctccgtcggcctgttaatcaggcagacaccatggacccattcgccgcagcaggtgttgacgggcatcaacgcaccacgccgccgcaccacccgaagaggttcagcgcaatgcgttagccagcattccaaccgcgaccaccacacacaggctggcaaaacccacctgcaagctgcgtgcagggatcaccgaacacaggcgtcgcccggccagcatgccgacgatgcttgcgccgataaacacccagcctacaggctcgatgctaaccccggcatgaaacgcccctaccacgccgatcagcgaaagcaggctgaccaccatcaacgaagtcgccacgatcccacgcatctgcacgtcggtcagttgcttgaacgccggcacgatcaggaagccgccgcccacgccaagcaaccccgacaccgcgccggtcaccgcgcccaatgcggccagggtggccgtgcatttggccgtccaggccaggcgcccggtctgctggttgagcatgcagttcttctggccccacgaagccgagccatggtcgcttggcccggcttcgactttctcgcgccgcaacatgcgccaagccaccagcaccatcaaggcactgaacaaacccatcagcagttgctccgacaattggtgggcgacgaacacgcccaacggcgaaaacaatgcgcccagcaatgcgatcaacagcgcagcgcgataacgcaccagcccatggcgcaagccatcaatggcgcccactgccgccgccgcgcctactgcgagcagcgacaccggggcggcctgggtcatgctcaagcccagccccagcaccagtgccggcaccccgaggatgccgccaccggcgccggtcaggcccatgaccaggcccatcaatacacccaacacactggccagcagcattcagtccaccttgctcaggcggttcagccactcgcggcccttgagcatgccgttccagtagaaccacggcagcagcgtggccttgagaaaccacatagagcggcgcgcccgggtcgggtcgaggggaaaggtcggcagcagcttgccgccgtagccgaactcggcgagtaccaccttgcccttctccaccgtcagcgggcaggagccatagccgtcgtacttgagcggcagcggcgcctgtttgcgcagggccagcaggttctcggccaccaccacgatctgcttgcgcaccgccgccgcggtcttggcgttgctggtgccgcacacatcgcccaggccgaagatgtgcgggtagcgcaggtgttgcaaactgtgggggttcacttcgcaccagccggcggcatcggccagcgggctctggcggataaagtccggggccagctgcggcggcacgacgtgcaacatatcgaaggttttctcttcgacgttcaccttgccttcggcgtctttgacttcgaaccaggccttgcgcgccgggccatcgactttcatcaggttggaattgaacgccaggcgcgccttgtatttctcgacgtatttcatcaacggcggcacaaaggtcggcacgccgaacagcgcggcgccggccaggttgaattcgacatcgatgttgttgagattgccctgcttgagccagtggtcgcacgacagatacatggctttctgcggcgcgccagcgcatttgatcggcatggccggctgggtgaacagcgccttgccgcccttgagttgctgcaccagttgccaggtgtaggcggcatgctcatagctgtagttggaggtcacgccgtggcggccgagggtgtcctgcaggccctcgattttctcccaggccaggcgcaggccggggcagacgatcaggttgttccaggtcaagcgctggccgctgtcgagcaccagggtttgttcgtcgggcagcagctcgctgacggcggcctgtacccaactgacgccgttgggcaacacgtcggccagcgggcggcgggtctttgccaggtcgtaggcgccaccgcccaccagggtccaggccggctggtaacagtggtagtcgttgggttcgatcagggtgatattcaggtgcgggtcgcgcttgagcaggctggccaccaggccgatgcctgccgaaccggcgccgataacgacgatatcgccactgatggtgggtccccagtgttgttcggtcattgtctactgcctttttgagtcaatgcacacaagggtcgctgccggatggcgtcacgcccagctttttatgaccgcgccgcaatacaggccggacagggtcttcattacttgaatcacttcgtggctggccaggccgtagaaaatgtatttaccttcacgacgggttgcgaccagcccttcatcgcgcaggatgcccaactgttgggacagggtgggctggcgcacgccggtcaaggcttccagctcaccgacgttacgctcgccctgggtcaactggcacaggatcaacagccggtcttcgttggccagggccttgagcaggcaacaggccttggacgccgacgcacgcaactgggcgacttcgccctcactcaaggtagattccatttgcttcgggtcctttatgtcacttaagctcaagacattatgtttaaacataaactgattgtaaccacttttttcttcatcggggacagccgccatgccagcgttgattcaagcttttctggatgacgcatcgtcgacctacacctatatcgtctatgaagcggatggcggcccctgcgccatcgtcgactcggtgctcaattacgacccggcgtccgggcgtaccgacaccgcccaggctgacaaggtcattgcctttgtgcgcgagcacggcttgcaggtgcagtggttgctcgaaacccacgcccatgccgaccacctgtccgccgcgccctaccttcgtcgcacgttgggcggcaagatcgcgatcggcgagtcgatcagcaaggtgcagggcgtattcaagcacctgttcaacctagagccggaatttcgcgtcgacggttcacagttcgatcacctgttcgcaccggatgaaatctttcatatcggcggtttgaaagcccaagccctgcatgtgccgggacacaccccggccgacatggcctacttgatcgacggccgcttgatcctggtgggcgacacgctgttcatgcccgacgtcggcaccgcccgctgcgatttccccggcggcgatgcgcggcagttgtacgcgtcgatgcgcaagctgctggcgttcccctcggataccaagctgtacgtgtgccatgactatccgcctgaggggcgtgaggccaagtgcctgacgacggtggcggaacaacgggcggggaatatccacgtgcatgacggggtggatgaagcgacgtttgtagagatgcgcaccacccgtgatgccgggctgggtatgccgacgctgttgttgccggcaatccaggtgaatgtgcgggcgggaaacatgccgccagcggaagagaatggcgtgacctacctgaagatccccctcaaccaactttgaaatgcggaaaaacaatgtgggagggggcttgctcccgatagcggcgtgtcagtcaacttatgtgtagctgatccactgctatcgggggcaagtcgaatcgtcgcaccgcccctcccacattttgttctgtgttgaatcaggaaccgaggctgatgccattggccggcagcggcagcgcggttttgtagcgcacttgctttaacgcaaagctggagcgaatgttcgccacccccggcaccttggtcaaaaagtccatcataaagcgctccagcgactggatcgtcggcaccagcacgcggatcaggtaatccgggtcgccggccatcaggtagcactccatcacttccggccggtcggagatcgccccttcgaattgctgcaatgccagctcattctgcttttccaggctcacatggatgaacacattcacgtgcagccccaacaggtcggcatccagcagcgtgacctgctcacgaatcaggcccagttcttccatggccttgacccggttgaaacacggcgtcggcgacaagttgaccgagcgggccaggtcggcgttggtgatccgtgcattctcctgcagggcgttgagaatgccgatatcggtacggtccagtttgcgcatgagacaaaatcacctgtttattatgtttatgcagtttttttatccgcaaatggtcccgggcgcaatgaaacacagataaatattcttctacgccacgcctatgattgttgtaggacaggatttcttctacccgaagactgactgtcagctagcgcgcccactacaagaaattcacaagatagagcgtagaaagccatgacccagccgtatgcaccgctgcgcctgcacgttcccgaaccctcgggccgcccgggctgcaagaccgattttacctacctgcgcctgaccgacgccggcctggtacgcaaacccgccatcgacgtagaacccgccgacaccgccgacctggccaagggcctgatccgcgtgctcgacgaccggggccaggcccttggcccgtgggccgaaggcgtgcctgtcgagatcatgcgccgcggtatgcgcgccatgctcaagacgcgcatcttcgacaaccgcatggtggtcgcccaacgtcagaaaaaaatgtcgttttatatgcaaagccttggcgaagaagccatcggcagcgcccaggccctggccttgaacatcgacgacatgtgcttccccacctatcgccagcaaagcattctgatggcccgcgacgtgccgctggtagacctgatctgccaactgctgtccaacgagcgcgacccgctcaagggtcgccagttgccgatcatgtactcggtcaaagaggcgggtttcttcaccatttccggcaacctcgccacccaattcgtccagggcgtgggttgggggatggcttcggcaatcaagggcgataccaagatcgcctcggcctggatcggcgacggcgccacggctgaatcagacttccacaccgccctcaccttcgcccacgtctaccgtgcgccggtgatactcaacgtggtcaacaaccaatgggccatctccactttccaggccatcgccggcggtgaagccaccaccttcgccggacgcggcgtaggctgcggtatcgcctccctgcgggtagacggcaacgactttatcgcggtgtacgccgcctcggcctgggctgccgagcgtgcgcgccgtaaccttgggccaaccctgatcgaatgggtcacctaccgcgccggtccgcattccacctccgatgacccatccaaataccgccccgccgacgactggagccacttcccgttgggcgacccgattgcccgcctcaagcagcacctgatcaagattggccagtggtctgaagaggaacacgcggcggtcagtgccgaacttgaagccgaagtgttcaaggcgcagaaggaagccgaacagtacggcaccctcgccggcggccagattccaagcgccgcgaccatgttcgaggacgtctataaagagatgccggagcacttgaagcgccagcgtcaagagttgggggtttgacatgaacgaccacaacaacagcatcgaactggaaaccgccatgaccaccaccaccatgaccatgatccaggccctgcgctcggccatggatgtgatgcttgaacgtgacgacaatgtggtggtgttcggccaggacgtcggctactttggcggcgtgttccgttgcaccgaaggcttgcaaaccaagtacggcagctcgcgggtattcgacgcaccgatctcggaaagcggcattgtcggcgtggccgtgggcatgggtgcctacggcttgcgcccggtagctgaaatccagttcgccgactacgtctacccggccaccgaccagatcatctccgaagcggcacgcctgcgttatcgttcggccggccagttcactgcgcccctgaccatgcgcatgccctgcggcggcggcatctacggcggccagacccacagccagagtatcgaagcggtgttcacccaggtctgcggcctgcgcacggtgatgccgtccaacccctatgacgccaagggcctgctgatcgcctccatcgaaaacgatgacccggtgatcttccttgagcccaagcgcctgtacaacggcccgttcgacggccaccacgaccgcccggtaacgccgtggtcgaaacacccgcaagcacaggtgccggacggttactacaccgtgccgctggacgtggccgccatcgtgcgcccaggttcggccgtgaccgtgctgacctacggcaccaccgtgtacgtctcccaagtcgccgccgaagaaaccggcattgacgccgaagtcatcgacctgcgcagcctgtggccgctggacctggaaaccatcgtcaagtcggtgaaaaagaccggccgctgcgtggtagtgcatgaagccacccgcacctgcggctttggtgccgagctagtgtcgctggtgcaagagcattgcttccaccacctggaagcgccaatcgagcgcgtcaccggttgggacaccccctacccgcacgcgcaggaatgggcgtatttcccaggcccgtcccgagtgggcgcggcgttgaaacgggtcatggaggtctgaatgggcacgcacgttatcaagatgccagacatcggcgaaggcatcgcggaagttgaattgtcgcaatggcatgtgaaggtcggcgacctggtggttgaagatcaggtactggcggatgtaatgaccgacaaggcgatggtggatattccctcgccggtccacggcaaggtgatttccctcggcggcgagccgggtgaagtcatggcggtgggcagtattttgatcagcattgaagtggaaggcgcgggcaataccaaggatgtgccagcagccgccgaaccggtaaaggccgcgcctgtggccgaagccaaaccggcaccggcacctgtagaaagcagacccgcgcctgccgtgaaagcgccgcaagcacccgtggcccgtgaagccagtgagcgccccctggcttcccctgccgtgcgcaagcacgcgctggacgcggggattcaactgcgcctggtccagggctcgggcccggcgggccgaatcctgcacgaagatctggaggcgtacctgcagcaggggccggccgctggtgcgagtgcagccaacccttacaccgagcgcaatgacgaacaccagatcccggtgatcggcatgcgtcgcaagatcgcccagcgcatgcaggacgccacacgccgcgccgcacacttcagctacgtggaagaaatcgacgtcaccgccctcgacgagttgcgcgtgcacctcaatgagaagcacggtgctacacgcggcaagctgaccctgctgccgttcattgtgcgcgccatggtggtggcgctgcgcgagttcccacagatcaacgcccgctatgacgacgaagcccaggtcatcactcgcctcggcgcggtgcatgtgggcgtcgccacccagagcgacgtgggcctgatggtgccagtggtacgccacgccgaagcccgcagcctgtggggcactgccgaggaaatcgcacgtttggccaacgccgcgcgcacgggcaaggccagccgtgaagagttgtccggttcgaccatcaccctgaccagccttggcgccttgggcggcattgtcagcacgccggtgctgaacctgccggaagtggccatcgtcggcgtcaaccgcatcgtcgaacggccgatggtgatcaagggccagatcgtggtgcgcaagatgatgaacctctccagctccttcgatcaccgcgtggtcgatggcatggacgcggcgcaattcatccaggccatccgcggcctgctcgaacaacccgccagcctgttcctggagtaaaggcatgactcagacattgcacaccacgctgctgattatcggcggcggccccggcggttatgtggcggcgattcgcgccggtcagttgggtatccccaccatcctggtggaaggccaggcactgggcggcacctgcctgaacatcggctgcataccgtccaaggccctgattcatgtggccgaacagttccagcaaaccgtacaccacagccaaggctcgcaactgggtatcgaagtggatgtgccgaccctggacatccgcaaaagcgtggaatggaaagacggtatcgtcgaccgcctgaccaccggcgtcgccgcgctgctgaaaaaacacaaggtgcaggtgatccacggttgggccaaggtggtcgacggcaagaccgtcgaggtgggcgaccagcgcatccaatgcgagcacctgctgctggctaccggttcgaaaagcgtcaacctgccgatgctgccgattggcgggccgatcatatcctccaccgaagccctggcgccaacccgcgtgcccaagcgcctgatcgtggtgggcggcggttatatcgggctggaactgggcattgcctatcgcaagctcggtgccgaagtgagtgtggtcgaggcccaggaacatatcctgcccgcctacgatgccgaactgaccttaccggtggccgagtccctgaagaaacttggggtgaagctgtacctcgggcacagtgtcaccggctttgccgacaacaaactgcaagtgcgcgcgcccgacggcgactctcttgcgctggacaccgaccaggtgctggtggccgtgggccgcaagcccaacacccagggctggaatctcgaagcgctgaacctggacatgaacggcgcagcgatcaagatcgacagccgctgccagaccagcatgcgcaatgtgtacgccatcggcgacctcagcggcgaaccgatgctggcgcaccgggccatggcccagggcgagatggtggccgagctgatcagcggtaaaacccgtgaattcaacccggcggcgattccagcagtgtgctttaccgacccggagctggtggtagtcggcaagaccccggacgaagccaaggccgccggcctggactgcatcgtgtcgagcttcccgtttgccgccaatggccgggccatgacgcttgagtccaaagccggctttgtgcgggtggtggcgcggcgtgacaatcacctgattgtcggctggcaggccgtgggggctggcgtgtccgaactgtccaccgcctttggcctgagcctggaaatgggtgcacgcctggaggatgtggccggcaccatccacgcccacccgaccctgggtgaagcggtgcaggaagccgcgctgcgggccttgggccacgcgctgcacctataaatgacacaaaacctgtaggagcgagcttgctcgcgaaaatcgtcaacgattacgcgtgcaacctgattaaacgcggcgcccttatgttcttcgcgagcaagctcgctcctacaggggatgcgaacagaccaacgaatgaagtattgttgagcccatccagaaaaaaatccgacttgaccagagatagagggtgtcatgggtaacgaaagcatcaattgggacaagctgggttttgactacatcaagaccgacaagcggtttctccaggtctggaaaaacggcgaatggcaggaaggcaccctgaccgacgacaacgtgctgcacatcagcgagggctccaccgccctgcactatgggcagcagtgtttcgagggcctgaaggcctatcgttgcaaggacggttcgatcaacctgttccgcccggaccagaacgctgcgcgcatgcagcgcagctgcggtcgcctgctgatgccgcaagtaccgaccgaagccttcatcgacgcctgtagacaagtggtcaaggccaacgagcgcttcatcccgccgtacggcagcggcggtgcgctgtacctgcgtccgttcgtgatcggcaccggtgacaacatcggcgtgcgcactgcgccggagttcatcttctcggtgttctgcatcccggtcggtgcctatttcaagggcggcctggtgccgcacaacttccagatctccggctacgaccgcgccgcgccgcaaggcaccggcgccgccaaggtcggtggcaactacgccgccagcctgatgccgggctcggaagcgaagaaatccggcttcgctgacgcgatctacctggacccgatgacccactcgaaaatcgaagaagtcggttcggccaacttcttcggaatcacccacgacaaccagttcatcacaccgaagtcgccttcggtactgccaggcatcacccgcctgtcgctgatcgaactggcccagacccgcctgagcctggaagtggtcgagggcgaagtgttcatcgacaagctggaccagttcaaggaagccggcgcctgcggtaccgcggcagtgatttcgccgatcggcggcatccagtacaacggcaagctgcacgtgttccatagcgagaccgaagtcggcccgatcacccagaagctctacaaggagctgacgggtgtgcagaccggtgatgttgaagcgccggcgggttggatcgtcaaggtataagccagcgacaccgcaataccctgtgggagggggcttgctcccgatagcggcaggtcagtcaacatcttcatcgactaacactccactatcgggagcaagccccctcccacattggatctccagtattttcaggattgagggatattcccgacaatcttcttgcccatactgatcctcggctccaccccataccccaacgcttcgtagaaccccaccaccgcgtcattgccgccggtgatctgcaggttgatcttcatgcagcccaaggccgtcaacgcctgctcggcatggcgcaccagcgacgatcccaaaccatggcgacgatagtcggcatgcacagccacggagtacagccagccacggtgaccgtcatagccggcgagtatcgtgccgatcacagctttcttgtcggtggcgacgaagaacaacccatcgttgaccgccagcttcttgtcaatcgccaggctcggcaggttatgtgcggtgtcatagccaaacgcctcctgccataactcgatcacttgggtacggtgctgacggtctcgataagggccgatgggatgtcgtgacagcagcgccttttccatcaccagcgtgcgctcgttgccatggtagacgtcgcgcacggtatgaaaacccagcctggtatagaagggctccgcagtcagcgaagatggcacgctcaataccgttacgcccgcctcccgggcacgcagttcgatctcgatcatcaacaaccggccaatgccctgcccttgcaacgccggattgacgaacaccgaacgcactacgttggcatcgagcgcggcggtggcgacgattacctggtcctgggtggccaccaacacgacacggcgcttgagcagttccagcaccgcgtcaggggtgaaactgctggcgactcgcgctatcacatccgccggataatcccgcgcattactgctgtgcaaggcggccaggatgacctggctgatgccctcggcatcggctggctgggcgaggcgaacggcggtagacatgactcctcctggctgacaaagctatcacaatcgctactgtaccaatgcgggaggggcggtgcgacgattcgacggccccctcccacatatgactgcatttcaatctgacagccgattcggctgcatcactgcccttttcagctttcccggctgggccgccctgctgtttcagccgagatacttccccgacaacgcacaaaatagcgctacaagatcaccccatggacccgtgcccccatgcaaaccaccaacaccgtcctgatgatccgcccggcgcgctttgccttcaacccggacaccgcgatcaacaaccgttttcaacgcccgccgctggacccactcagtgcacagcacaaagcgctggaagagttcgacggttatgtcgaaaccctgcgcaatcacggcgtggaagtactggtggtgcaggacaccccggcaccccacactccggactcgatcttccccaacaactggtggagcagccacgccgacggcagcctggtgctctaccccatggagggccagaaccgccgcctggagcgcaacaaaggcgtactgcaagtactggagcaacgctttgcgataaaagacaccatcgacctgagtcaccttgaacaacagaacatcttcctcgaaggcaccggcagcatggtgctcgaccgccagcaccgcatcagctacgcctgccactccgggcgcacccaccacgccgccctgcgccagttcgccgaacgcctcgactaccagctctgcgtgttccacgccctcgaccgccaccacgcgccgatctaccacagcaacgtaatgatgagcgtcggccgcgacctcgcggtggtgtgcctgcaagcgctgcctgatgagggcgagcgcctgacgttggagcgctccctgcgcgacaccggcaaagatatcctcgccctcgacttcgaccagttggaagccttcgccggcaacatgctcgaagtccacgaccgtgacggtcagccgctgctggtgatgtccgccagcgcctggggcgcgctgcaacctgcccaacgccagcacgtggagcgccacacgcggccggtggtggtgaatatcgacaacatcgaacgcatcggcggcggcagtgcccgctgcatgctggccgaagtgcatctgccggcccgtccctcatttcaataaggagtcttgccatgacccgttacatcgacgtcaacgacctcagctacctggtctcgcagaaaggcctgcaaacctgcatcaccgagatggccgactatatccgcgccgactacctgcgctggcaggatttcgagaaatgcgcgcgcctggccaaccattctccggatggtgtgatcgaactgatgccggtgtccgacgcttcgctatacgccttcaaatacgtcaacggccatccgaaaaacaccctggctggcatgctcacggtgatggctttcggcgccctgggcgatgtggacaccggtaaaccggtgctgctggcggaaatgaccctgaccaccgcgatccgcaccgccgccacctcggccctggttgcccgctacctggcccgtgccgacagccgcagcatggcgctgatcggcaacggctgccagagcgaattccaggccctggccttccacgccatgcttggcatcactgagatccgcctgttcgatatcgaccccaaggccaccgccaaactcgccgccaacctcaaggccttcccggcgatcaaggtgatcctggctggcagcgtcgccgaagcggtgaaaggcgcggatatcgtcaccaccgtcaccgctgacaaggcctatgccaccatcctgacggacgagatgatcgagcccggcatgcacctcaacgccgtgggcggcgattgcccaggcaagaccgaactggaccgacgcatcgtcgagcgcgcccgcgtgatcgtcgagtacgaaccgcaaagccgtatcgagggcgagatccagcacatgtcggaagactcgccagtcaccgagctatggcaggtgatcaacggccagaaacccggccgcgagaatgagcgccaagtcaccctgttcgactcggtgggttttgccatcgaagactattcggccttgcgctatgtgctggacgtggccaaggccctcgatgtaggcagcgaattggaactggtacccgacctggccgacccgaaagacctgtttgcccgcctggcccagcagccggccgcacagcagaaaaagcgcgcctgagaccgctctggcctgccgctttgcgccaagggcaggccggatttttaccgatgaaaagccgattcagcgggtgtcacagccgattcagctgcattgctcgttttaacagcgcaatttgcgctttgtgcaccgggtaaacgacacaaaaaacgcaccatcatgaagcattctctgctcccagttattcactgccctgacatcaattacaaaataaagggacctccacatgactccactgcgatcacttttcgctgctttgctgttgccactgtgcgctactgctgcccacgctcaggagtggaaagaaatccgcttcggcgtgttccccgaatacccacccttcgaatccgtagccgccgacggcagcctgcaaggcttcgatatcgaattgggcaacgccatctgcgccaagctcgaggtcaaatgcacctgggtgcacaacgagttcgacggcatgatcccggccctgcgggcgcgcaagttcgatgcgatcatgtcctccatggcggtgaccccggcgcgggaaaaagtcatcgatttcaccgatcggctgttcctcagtccgacgtcggtgatcactcgcaaaggcgcggatttcggcgacacgcccgaatcgctcaatggcaagcaagtcggcgtattgcaaggctcgctgcaggaagcctacgcgcgggcacacctggccaagcttggcgcgcagatcaaggcgtaccaatcccaggagcagaactacgccgacctgcagaacggtcgcctcgacgctaccttgaccgacaagctcgaagcccagctcaacttcctgtccaagtccgaaggcgccgacttcaagaccggcccggccttcaaggacccgaccttgcccctggacatcgccatgggcctgcgcaagaacgaccaggcactgcgtgagctgatcaacaagggcatcgccgccgtccaggccgatggcacctacgccaagatccagaagaaatacttcggcgatcaagacatctacaacgaataactaagccatcgcctgccctgtggaacacgcttgtgtgggagggggcttgctcccgatagcagtgtgtcagtcattgaaaatattgactgaaccaccgctatcgggagcaagccccctcccacacaagtcggttcccacagagattgagtgtgtgccttttagagatcttccccatgaacgaactcttcaacctgcaaggctacggcccgatgctggcccagggtgcctggatgacgctcaagctggccttcctggccctggccctgagcctcaccttgggcctggtcgccgccggcgccaagctttccagcgccaaatggctgcgcgtaccggccacgctgtacaccacgctgatccgcagcgtgccggacctggtgctgatcctgctgatcttctacagcctgcaactgtggctcaatgacctgaccgaagtgttcggctgggagtatttcgaaatcgacccgtttaccgccggggtggtcaccctggggtttatctatggagcgtatttcaccgagaacttccggggcgcgatcctcagtgtgccggtaggccaattggaagccgctaccgcctatggcctgagccgctggcagcgctttcacctggtgctgttcccgcaactgatgcgctttgccctgccgggccttggcaataactggctggtgctgctcaagtccacggcgctggtgtcgatcatcggcctgtcggacttggtcaaggccgcgcagaacgccggcaagtccaccagcgagccgctgtacttcctgatccttgcggggctggtgtacctggtgatcaccaccctctccaaccgcatcttcaagcgcctcgaacggcgctacaacctgggcatcaaggggatggcgcgatgatcgaactgttccagcaatacggcctggcctatctgttcagcgatggtacggggttgtccggggtggccatgaccttgtggctgttcatcatctcggtggtgctcggcttttgcctgtcgatcccgctggcactggcgcgggtttcgcagcacttttggctgcgctggccggtggaggtctacacctacctgttccgtggcacaccgctgtatatccaattgctgatttgctacaccgggctgtacagcctggaggtggtgcaggacaacgccctgctcaaccagtttttccgcaatgcgctgaactgcactctgttggcgtttgtgctcaacacctgcgcctacaccgtggaaatcttcgccggggcgatccgcaatattccccacggcgaaatcgaagcggcacgcgcctatggcctgcacggctggcggctgaacctgtatgtggtggtgcccgccgccttgcgccgcgcgctgccggcctacagcaatgaaatgatcctgatgctgcacgccacttcgctggcgttcaccgccacggttgccgacatcctcaaggtcgcccgcgacgcaaatgccgagacattcctgaccttccaggccttcggcatcgccgccctgctctacatgctgctgtcctttgcactggtgggcctgtttcgactggccgaacgtcgctggatgcgttttcttgttcctacccgaggctaacccatgaatcagtccgcgcaggccctggccgcttatccggtggatgtacccgtgaccaacgctgcaactgccgcgatcaagctgcaagtcgaaggcatccataaacgctacggcgaacacgaagtgctcaagggcgtgtccctcaatgcgcgccagggcgatgtgatcagcctgatcggcgccagcggttcgggcaagagcaccatgttgcgttgtatcaattttctcgaacaacccgacgccggggttatcaccctggatggcatcagcatccagatgcagcaaggccgcgccggcagccgcgcaccgcatcaggcgcaactgcaaaacctgcgcacgcgactggccatggtgttccagcacttcaacctgtggagccacatgaccgtgctggaaaacatcaccatggccccgcgccgggtgctggacgtgagcgccgccgaagcggaaaaacgcgcacgcctgtacttggacaaggttggcctgccaagccgcgtggcggaccaatacccggcgttcctgtccggtggccagcagcagcgcgtggcgattgcccgggcgctggcaatggagccggagattatcctgttcgatgaaccgacttctgccctcgacccagaacttgtaggagaagtcctcaaagtcatacagacgttggccgaggaaggtcgtaccatgctgatggtcacccacgaaatgggctttgcccgccaggtgtccagccaagtgctgttcttgcatcagggccgggtcgaggaacacggcggcgccgagatcctcgaccatcccaacagcgaacgcttgcagcaatttctttccaaccgtttgaagtgaacccatggataccaaggccaacggaccccattcttcccctacgctggatcgcatcgacgaagcgatcatcgacgtgctgcggcaccaggggcgtatcacctacgaaaggctctcatcgctggtgcacctcacccccaggccctgcctggaacgggtgcgcaagctggagcgacgcggggtgatccgtgggtatggggcgatcatcgatgtgcagatggtctcgccagggctgtcgctgctggtgctggtggccttgtccaaccagagcgggcgctcggcgcaaaaggccttcgaagcctgtgtgaaggcctgcccgcaggtattcgagtgccaactgatcagcgggccgttcgactacagcctgcgcatgcgctgccgggacatggagcattaccgggtgctgaccgagacctggttgaataatgatgagttgcacattgataagctggtggcgcatccggagttagcggtagtcaagaacactgccaccgaactggcctgagccccttaccccagtcacagaagaacaaatgtgggaggggcggtgcgacgattcgacttgctcccgatagcagcgtgtcagtcagctcatctatcactgacccaccgctatcgagagcaagccccctccctcatttttagccatgcccacttaagattttcttaccaggccttgccccaaccagcttcgcctgcccatccttctgcttgcccgtgcgcgcctcgctgatcaaacccggtatcaacttgccctcgggcagattcttccagaatcgactcggcaagtgaccctccatcaccttagggttcaaccgtgccgggttgaagatgtggctgtagtaggtcaaccacatcgcactgtgggggtcctcgacattctgcgccagttgctgccaggcctcggggcaccggcgttgatgaatcaactgttcgccgtcgtaatacaccccgtccaggggcgtcgcgatcatccagcgatggcggcccatgcgcccgacaaagtgctggctggcgcttttgagaatgtcgtgggccggctcatgccaggccacgtactccggcagttctggtcctgcctcggcgggaagggcaataaagcgcacaaacgcatgcaggtgatgggcttcacggctgacctgcttgatgcgccgttgcaactcactgccgagcttgtcccccgccaacatcgcggtgcgatcaccatggctgacccgccacagcacctcgtacaacaaactccaacgctgatcgccgtggtaacaggcggccgactccagcaattccaacagcgccttggggatccgtgcctggaacggccccagccctggcgggatcggctcatcggtggcgaacaggtccgccgcctgcgtctggccccaactcacctggctggggtcgacctgatggctgagcagccagcgcgcctgttcgcgccaggtgctgaacaggttgtcgcattccaggctgatcatccccacaaccccatctgttgtggctgcgggcggtcgcgcaattgctcgcgcaacaacacgctggtgctgtcggcctgttgcgggtggtagtcgctggtgatgaagaacggcttggccttggccagcacgcagcgcatgcgtgcaaggtcttcgaagcggatcttgcgttcgcggcgcaggtccaccaggcgctgggtggtgcgcaggccgatgccgggaatacgtgctatcagggtcggctcggcgcggttcaggtccagcgggaacacctcgcggtgctcaagggcccaggccagcttggggtcgatatccagggccaggtggccggggcctgtaaacagttcgttggcgctgaaaccgtagctgcgcaggaggaaatcggcctggtacaagcggtgttcgcgcatcagcggcggcgcggccaggggtacgcttttcgggctgttggggatggggctgaacgccgagtaatacacgcggcgcagcttgaaattgccatacaacgcctcggcaccgtggaggatggtgctgtcatcggtgtcgtcggcgccaacgatcatttgcgtgctctgcccggccggggcgaaacgcggggcacggggttcgttcagcaccgtctgctcgccggtgtagatggtctgcatggcctgcttgatcgagacgatctgcttctccggcgccagggtttgcaggctggcgtcggtgggtagttcaatattcacgctgagccggtcggcgtagcgcccggcctccgcaatcagcgcggggtcggcctcggggatggtcttgaggtggatatagccacgaaagtcatgctcttcgcgcagcagcttggccacccgcaccagttgttccatggtgtagtcggccgaacggatgatgccggaactgaggaacagcccgctgacgcagttgcgcttgtagaaatccagggtcagggtcaccacctcttccgggctgaaacgcgcacggggcacgtcgctggaacggcgattgacgcagtattggcagtcgtacaggcagaagttggtgagcaacaccttgagcaacgacacgcagcgcccgtcaggtgtgtagctgtggcaaatgcccatgccatcggtggaccccagccccgccttgccctcggaactgcgcttgggcgcgccactgctggcgcaggacgcgtcgtacttggcggcatcggcgaggatgctgagtttttcgatcaactgcatggcgggctaccgatactggttttttgtacagtaccaatagccacaccttgtcacaagtgccgtctgtaggaacgagcttgctcgcgaagaacgtcaacgattacgcgtcctgtctggattaacgcgttgctcttgggttcttcgcgagcaagctcgctcctacagaggggccgctcagctggcggtggccagcagcaggtcctgcaccgaacgacccttgtcacgatttcgatcgttctcatacaacgacgccgcaatctcatcggcgcgaatcggcagcaccgacagcaaggtatcgctcaagccatggctggcctggctgaagccctggatgtagatgccggccttgcagcgctcgtcggtgacgatgcggtagtcgcgggccacttcgaaatcgcccatataggcctgcagcggcgccaacagttcgcggtgcatctggcgctcgtagccggtggccaggatcactgcgtcgtaatggttgaggctggtttcgttagtggcgttgttgcgcagcaccagttcgatacccagcgggccggcggtggctttctccaccacggtcatggtgcggaacgcctggcgcgcgatgccggagactttctggcggtagaaaatcccgtagatgcgctcgatgaggtccaggtccaccaccgaatagttggtgttgcggtactcggcgaccagacgctcgcgctcggcaccgacttgctggaataccaggtcggtgaaggccggcgaaaacacttcgttgacgaacgggctgtcatcggccggcttgagcgccgagccgcgcaggatcatatcgacctgcaccgacgggaagctgtcattgaggtcaataaacgcttcagccgcgctctggccgccgccgatcaccgcaatgcgcatggccttgccgctcacgcagggctggctggccatgcgctccaggtagtgggagtggtggaacacgcgggtatcgtccttaagcgcctggaacgcctcgggaatacgcggcgtgccaccggcgctgaccaccaccgagcgagtggtgcgcacatgctgctcaccctgggcatcacgggagatcacccgcaacgcctcgacctgctgctgatgcaggatcggctcgatggccagcacttcctcaccgtagctcgcctgggcctggaactgccccgcgacccagcgcaggtaatcgttgtactccatgcggcaggggtagaaggtgcccatgttaatgaagtccaccaggcggtcatgggccttgaggtaattgacgaaggaatatgggctggtggggttgcgcagggtcaccaggtccttgaggaaggaaatctgcagttcactctgggtcaccagggtgttgccgtgccagcggtagtcggcttgcttgtcgagaaacagcacgtccagcttgccctgggccttttcacgttcctgcagggcgatggccagcgccaggttcgaggggccgaagccgatcccgatcaagtcatgaaccgcgggcgaagcaattgcctgtgtcattccagtgtcctctggataagccccttggcggtgggggcgggaatacctttcatggcctgaacaaccggccgtgtgttgataggaaacgaggacagtgaaataaaatttaaccaacagctgatcagtgcgcttcccactcgcgcatgcgcacccggcaatgcttcatcgcgttgacaatgtgtttttccaccaggctgcgggaaatgcccaggcgcgcagcgatctgcaggtgagacaggccttcgagtttacgcagcagaaagctgtcgcgacaggcggccggcaactcggccagggcgcgctcgagcatctccaggcgttggcgctggtcgtggctggtgtggggtgaacaaggggcgaaacgttcttcgctgtccagcacctcaaggggttcggactgacgcaaggcattgcgtcgatggccgtcaatcaccaggttcaaggccgtgcgataaagaaacgcgcggggctgctcgatcggcgtatcgctggcgcgctccagcacccgcacataagcgtcatgcaccacatcttcggccacctgacggttgcccagcttagcgttgaggaaacacaccagctcgcgatagtagttttccaacatgactcctggccccgtggccgtggtgctgacgatgcccgcccgagcagaacgaggtcatcgatgatggcagtttgagtgtgtgcaatttatagtaattctcatctacttttaaagaagtcttgcatcaacgtcggtttttttctccgcagacctgtttctgcgtgtgtaacagcctaaatccctggagctttttctcgtttaactgtcagctttgcgcaactgcgccccgatctttcctggctggaacctacccatgaaacgccctcgacctgcccgacgcgccctgctagcggtagcgtgcctgattcccatcgttgcgttcgccacctggcagggcctggcgccgggccgtgacgccctggcgaccgtcaccgtgacccgcggcgatatcgaaaacagcgtcaccgccctgggcaccctgcaaccgcgacggtatgtggacgtcggcgcccaggcctccgggcagatccgcaagatccatgtcgaagccggtgaccaggtcaaggaaggccagttgctggtggagatcgatccttcgacacaacaagccaagctcgatgccagccgctacgccatcgaaaacctcgaggcccaattgcaggagcaaaaggcccagcacgcgctggcccgccagaagtatcagcgccagcagcgcctgagttccggcaacgccacccgtgaagaagacgtgcagaccgcccaggccgaactgagcgcgacccaggcccgggtcgacatgttccaggcccagatccgccaggcccgggccagcctgcgcagcgatgaggccgaattgggttacacgcgcatctatgcaccgatgaccggcaccgtggtggccgtggatgcgcgggtcggccagaccctcaacgcacagcagcaaaccccgctgatcctgcgcatcgccaagctgtcgccgatgaccgtatgggccgaagtctccgaagccgacatcggccacgtcaaacccggcatgcgtgcgtatttcaccacgttgagcggcggcagccggcgctgggccagcaccgtgcgccagatcctgccgatcccgcccaagcccctgaacgaaacccagggcagtggcagcccgagcagctccagcaagagcgggaccggccgagtggtgctgtacaccgtgctgctggacgtggacaacgccgataacgcgctgatggcggaaatgaccacccaggtatttttcgtctcaggccaagtcaaggacaccctgaccgtgcccgtcgccgccctgcagggcacacccggcgcagacacacagatcgcccgggtcgtggcgcaaaacggcgccatcgaagagcgcaaagtgcgcctgggtatcagcgaccgtctgcgcgtcgaggtgctcgagggtctcaatgagggcgatcacctgttgatcggcccgtccgacagcagtgggagttgacgtggccacgccgctgatcgaactcaagcacatctgcaaatcctacggcggcggcgacagcccgcaggtcgacgtgttgcgcggcatcgacctgtcgatccatgccggggaattcgtcgccattgtcggtgcctccggttccggcaagtcgacgctgatgaatatccttggctgcctcgaccgcccgaccgaaggcgactacctgttcgccggggaaaacgtcgcccacctgggcagcgacgagctggcctggctgcgccgtgaagccttcgggtttgtgttccagggctaccatttgattccctcaggctcggcccaggaaaacgtcgagatgccggcgatctatgccggcatcagcgctgctcaacggcatgcccgcgccaacgccctgctcacccgcctggggctggctgaacgcaccggcaatcgcccgcaccagctttccggcgggcaacagcaacgggtatccatcgcccgcgccctgatgaacggcggccatatcatcctcgccgacgaacccaccggcgccctcgatagccacagcggcgccgaggtcatgaccctgctcgacgaactggcgggccagggccatgtggtcatcctgatcacccacgaccgcgaagtggcggcgcgggccaaccgtatcatcgagattcgcgacggccagatcatcagcgactcggccgacacctgcacggtcaagccagccctggcggccggcgccctgcatgccgtggacctgcgccagcgcctggccgacggcgccgagcacaacggcgcatggaaggccgagttgctggacgcggtgcaggccgcctggcgagtgatgtggatcaaccgcttccgcaccgccctgaccttgctggggatcatcatcggcgtggcgtcggtggtggtgatgctggcagtgggtgaaggcagcaaacgccaggtcatggcgcagatgggcgcgttcggctccaatatcatctacctcagcggctcttcgcccaacccgcgtacgccactgggtatcgtgaccctcaaggatgtcgaggccctggcggcgttgccccaggtcaagcgcatcatgccggtcaacggcgccgaagccggcgtgcgcttcgccaatgtcgactacatggcctacgtgggtggcaacgacaccaacttcccgcacatcttcaactggccagtggtcgagggtagctacttcaccgaggccgatgaacgggctgccgcaacggtcgcagtaatcggcgcgcgtgttcgtcaaaaactgttcaaggacgtgtccaaccctatcggccaatacattctgatcgagaatgtgccgttccaagtggtgggcgtgttcgcggaaaaaggctccagctccggcaacaaggacagtgacgatcgtgtcgccattccctacagcgccgccagtgtccgtctgttcggcagctacaaccccgaatacgtggcgattgccaccaccgatgcacgcaaggtgcatgaagccgaagtggcgatcgaccaactgatgttgaagctgcacaacggcaagcgcgactacgagctgaccaacaacgccgcgatgatccaggccgaagcgcggacccagaactcactgtcgttgatgctcggctcgattgccgcgatttccctgctggtaggcggtatcggcgtgatgaacatcatgttgatgaccgtgcgtgagcgcacccgtgaaatcggtattcgcatggccaccggggctcgccagcgcgacatcctgcgccaatttctcaccgaggcagtgctgctctcggtggtcggcggcctattcggtatcgccctggcgttgctggtgggcggcgtgctggtgctggccgaggtggcagtacagttttccctggtggcagtgttcggtgcgtttggctgtgcactggtcaccggcgtcgtattcggctttatgccggcccgtaaagctgcccggctcgatccggtaaaggcgttgaccagtgaataatcgatccattcccgcgcagctgtcagcgctcagcctatgcctgctgctcagtgcctgtaacggcaaccggccgatactcgacagcggcatcgccccgcccgccgcctggcaatacgccgaacgcgaggcgacccaggccaccaaccagcgctggtggacgcagtttggcagcccggcgttgaaccgcctgatcgaccaggcccggcgcgacagtttcgacgtggctgccgccatggcccgggtgcggcaggcccaggccacggcagtgatcgctggcgcgccattgttgccggaggtgaaattcaacctcgccagcagtcaccagaggctgctgcgcggccagggcgggcctgacctggacgcctcgcaaagcgatgaaacggtgaataatttcggcgccaacttcagcgccagctatgaagtggacttctggggcggccgcgctgccgcccgcgacagcgcgctgtacagcctgcgcgccagtgagtcggaccaggccacggtggagctgaccttgctcagcaacgtggccgaccgctatgcgcaaaccctggccgcgcagcaacgccaacacattgccgaactcaacctggccaatgcgcgcaacgttctcggcctggtgcagacccgctacgacgcaggctctgccaccgccctggagctggcccagcagaggagcctggtggccagccagcaacggcaattgccgctgatccaacaggtggccgaagaggcgcggatcaccctcgccgccctcctcggccagccggtgcaggccctcgacctgggccatgaagccttccagacacttacctggccggcgatcggcccgggtgtgcccagccaactgctgagccggcgccccgacctggccaaggccgaagccgagctggccgctgcccaggcggatgtcagcgtggcccgcgccgccatgctgcccgccgtgaccctcggcgccacgctcggctccgacgcctacaaggctgggcaaatcctgcgtagcccctactacaccctgaccgccggcctggtcgcacccattttcaacaacggccgtttaagcgccgagcgcgacaaggcccgggcacgtcaggatgagctgctgcaaacctaccgcggggcgatcatcaatggctttgccgatgtagagaaaggcctgagcagcatcacccgcctggaccaacaacgccaatggcagacccaagagttgcaacaggcgcagacggccttccagattgcgcaaagccgctatgaggccggggccgaggacttgctcacggtgctggagacccaacgcaccctgtacgccgcccaagacttgaacgtgcaattacgcctgtcgcgcatgcaagccagcatcgccctgtacaaggcattaggggggggttggaacaccgaaagctgataaacaaactctcatttcatacacgagctgtttcttcaccttacattttccaacccaaggtccttggtaaaaaagccgttatcacacggctgcccgggacctctttgatgaaacccagcgttttcgtaaaaagcctggcctgcatctgctgctggctgatacccagcgtggcgctggccgagcccttgattgcccctactgcgatcgattggctgctggactgccccctgcccacgacggcgcgcctggatcccgaggtcgtagaacgcacccaatgcggcctggtcagcgtaccccgcgaccatgccgctccagaacgcggccgtatacgcctgagcgttacccgcgtcggcgcacggcaaccgctcgaccgcgaaggtgtggtgtttatccaggccggcgagccctctccggccagggaagcgcctttcgccctgcatctggccagccgctgggaatccctggccacccacgcctatcgcacattggttgaccgttatgacgtcatcgaactgagcgcccgcgacctgcggcagatgaatgcggtcgagcaagccgcacgggacatggagttcgtacgcgtgcaactcggcgaggcacggctcaactacctgggcaacgccaccgccgcccgcctcggcagccgctacggcgcgctgtatcccgagcgcgtggcgcgcatggtgctgatcaatgccgagcctggcgaacctatcgccatgggcgtcgagcaactcctgctcaaggagtcgaacgccgacggctgtgtcagccgctggctgggggatttccttgccttcggcaaacaaccaccgccgtccgcccgttgcctcgacctcggcacctggcgttgatcagcacatttacgacctgttgccaccgaaaacgacaccctgcgttgacgctcaagcccaatcgttattaagtgctatttatccgcattaatacgataaatcgcacccatgctgactcgtccgctgcgccgcaaacgccagaagctttccgatgtgattgtcgaatcggtcaagcgctccatcgtcaccgatgccttgaagcccggcgaccgcctgcccaccgagcgcgagctgatggagagtttccagtgctccaagggctcggcccgtgaagcgctcaaggcgctggaggtcgagggcctggtgagtacgcgcaccggccccagtggaggcgcctatctgaaccaggccggcaccgagccggccagccgtgccttgcgcaactacctgcacttccagcatctggatggcgagcaggtctatcaattgcgcaaggtcatcgaagtggaactggcggtgtcagtactcgggcgcttgggcgaagacgactatcaagccctgcaagccaacgtggatttctgcagcgcccccgaagacagcgaagccggccagcgcgaacagcgcctggcggaactggaattccacaacctgctggccagggcctgccccaacccgctgctgagctttatggcgcagtttctcaacgacctgctgcgcgacctggtggtgctgaaaaaagcctacaagcccaagcgcaagcagttcgacgcggccaacctggactatcacaagcaattgttgattgcctttcgtgcaggtgatgagggcgcggtgcgcagcttgatgcatgagcatatgtgcgacgccgaacaccacatgaccgcccttgaaggccaggtcagcccacacttccttctggagttcgatcactcttaagcacaccgacaatccaatgtgggagggggcttgccccctcccacactttaccgagttcacccgctgaatcgagttatcccataaaaagcctgcccacaggcccttgcaccaccgtatcgcccttgccgctcctgccaataactaaaccagggagtcaccccatgcagcgtcgtacgttattgaaagccagcctcaccgcggccgccgccctcagtttgccgctgagcgtgcgttcggcattcgccgcccagccctttaccttttacggcctcaagtccatgtctggtgcctttgccagctatggcaaatttgccgacatgggttcgcgcctggcagtggaccagcaccccgagctgctcgggcgcccgctgaactacaaggtcatcgacaccgaaggcaacgccggcaaggcggtgcgcaaggtgcaggaggcgattcagcaagacggcgcgcggttcttccagggttgcaccttgtcatcctccgccctggcggtggccaaggaagtcgacaaggtcggcggcgtgttcatgaccccggtgggcgccgatgaagtcaccggtaaagactgcaacaaggcgaccttccgctggtcggtgcccacctacggcgcgatccgcgaaaccatggtgccgctgatcaaactgctgccggacgccaagcgctggtacaccatcaccccgcaatatgtattcggcgaagccttgctcgaaggcgccagaaacgtgctcaaggagcacggcctggaacacgtcggcaacagctatcactcgctgcaggagcaggagttctccggctacctgaccaacgccatttccacccggcccgatgtgctggtgctgctcaacttcggcagccagtcgtccaacaccctgcgccaggcggtgaacttcggcatcaaggagcgcatgaaggtactgctggtgtggtcggccggcctcgatcagttccaggaactgggcagcgatgtgctcgaaggcgtgtacctcggcgcgcagtactggcaccaggtcgacaccccgctcaaccgtgaactggtcaagctgacccaggccaaatacgggatcaaccccacctacccgctggccgccgactacatcagtaccaaggtcatgctcgataccatcattgccaccggcagcttcgacggtgcaaccgtggccaaggccatgcagggcttgagctacgaaggcccgaccggcaaagagtcgatccgtgccggcgaccatcaggtgatcaaggattactacctgctggtcggcaaggcctgcggcgacatggccgacaaggacgacctggccaaagtgctcagtgccggccagtcgttccctgcggtcgaggcgacgggctgctcgctcggctgatcccctgaatatgtagcgcagggccgcgtaagcggcgtcctgccgagggttcctgcatgcttaatctttacctgttccagatcctcaacggccttgggctggggatgatctatttcctgattgcggtcgggctgacgatcattttcggcctgctcaacttcgtcaactttgcccacggcgcgttcttcctgctgggggcctacatctgttacaccgccgtgagcctcaccggcagcttctggctggcgctgctgatcgcgccgctggtggtcgccgcgctggcctgggtgatcgagcgcttgctgatccaacggatctaccacttgccgcacatgtttcagatcctggtgaccctgggcatcgcactgatcatccaggaagccagcgtgatgatctggggcccggtgggcaagagcgtcgccgtaccggaactgctgcgcggcgtgctggtggtgggggatttcgtctacccctactaccgcctgttcctcatcgtgttttccgggctggttggcctgggcctgtggctgctgctggaacgcacgcgcttcggcgccttggtgcgcgccggcagtgagagcaccgaaaccgtgtcgctgttgggcaccaacatcttccgcctgttctccatgacctttgccctcggcgtggccctggccggcgtcgccggcgtgctgttcgcaccgttgcgcggcgcccagccctttgtcggcccggagattctcggggtggcgttcgtggtagtggtgatcggcggcatgggttccttcagcggtgcgctggtcggcggtttgctggtgggcgtggtgcaaagcctgatgaccacactctggccccagggtgcgagcttgatgatctacggcgcgatggccgtggtgattctggtgcgcccttacggcctgttcgggagagcctgacatgagcgagaaaaatcccctgccgtttgccaagacgcaatccaaaaccatgctgctgtgggtattggcggtgctggtcggcctgccgttgctattgccctcggcgaccctggccaccgagatcctgatctttgccatggctgccctggcgtgcaacctgctgctgggctacaccgggctgttgtcgttcggccaaggcatcttctttggcgccggtgcctattgcgcagcactgctgatgattcacctgcaacaggggttgttcaccgcactgctgggtgccgccatcgccggcggtttcctggcgttgctggtgggcgccctggcgattcgtcgcaccggcatctacttcgtgatgctgaccttggcgttcagccagatggcctacttcgtcgcctacaccttgagcgactggaccggcggcgacaacggcctgctcagcgtgccgcgcccggaaatccgtatcggtgacaccgtactgttatcgctggccgacgctcgggccttctatggttttgtcgcggtgctgttcctgctgatctttatcggcgcacgccgggtgatcgcttcgccgttcggcagcacgctgatggcgatccgcgaaaacgaaacccgcgcctcggccatcggctacgacacgcggcacttcaagatcctggtgttcgtgctgtccggcgcggtcaccgggattgccggagcgctgtacgccatgttgctgcattttgtgccgctgtcgaacatcgacctggcgatgtccgaaaacatcctgatcatgaccattgtcggcggcacgggctcgctgttcggctccctgctcggcgccggctccatcgtgctgctgggggattttctctccgacctgtggccgcgctggctgatgctgctgggggtgatcctgatcctggtggtgatcttcatgcgcggtggtttgtggggcggcctggcgtcgctgttcgagaaggtgcgcggcagccgcaaacccgccgtcgtcaccaaggagcaagagctatgagcatcctgctggaaacccggaacctggaactggcctacggcgcgttccatgcagtcaatggcgtcaacctcaaggtcgaggccggcaccatccacaccatcatcggccccaacggcgccggcaagaccagcctgttccactgcctgaccggcgaacgccaggccaccgccggagcaatgcatttcgatggcaagaacctgatgcgcaaaccggcccacgcccgtgtcggcctgggcatggcgcgctcgttccaactcaccagcctgttccagaacctcagcgtgcgcgaaaacctgcgcctggccgcccagggccgtgacggtgcgcgcgccctgaatttctggctccgtgtggacagcaagcgcgaacacctggagatggccgaccaggtgctggaacgcctgcaactcaccgcccgtgccgacaccctggccggcgagttgtcccacggccagcagcgggtactggaagtgggcatgtcgatctgttccaaaccgaaactgctgatgctcgacgagcccacatcgggaatgggcatcgacgacatcccgatcatgacccaactgatcagcgacctgggccgcgaccacacggtgctgctgatcgaacacaacatgagcatcgtcatgtccatcagccaacgcatcacggtgatgagccacggccagatcctggtggaaggcacgccggatttcgtgcgagccgatgagcgtgtgcgtactgcgtaccttggggaggctgcctgatgctgatcgtcgagaatatccattcctactacgacaagagccatgtgctggagggcgtgtcattgaccgtcaaccctggcgaactggtgaccctgctgggtcgcaatggtgccggcaagaccaccactttgcgcagcatcctgggcatcatctgcccgcgccagggccagattcacttcaacggccaggcgctggtggggcagaagatctttgaaatcgcacgcaagggcgtggcgctggtgccggagaaccgtgggattttccgtctgctgaccgttgaggaaaacctgcgcatcgccgcccgcaagaacagccgctggcagttggaagacgtctacgccatgttcccgcgcctcaaggagcggcgcaaaaacgccggccatgcgttgtccggtggcgaacaacagatgctcgccatcgcccgtgccctgctgaacgatcccaagctgctgatcctcgacgaacccaccgagggcctggccccggtgattgtcgacgagctggtgaagatcctgcgcaaggtcaaggacgacggcctgccggtgctgctggtggaacagaacctgatggtctgcgacaagctcgccgaccgccattacgtactcgaacagggccgcgtggtgtacgaaggcagcgccgctgacttccgtgccgacccgtcgatcaagaaccgctatctggccctgagtgcctgaccggagaatgcccatgaatagttttgcgcaaccgctccagagcaacgccccgctgatcaaccgcgaccgcctgtggcaatcgctgatggacctggcccgactcggcgccaccgccaagggtggcgtgtgccgcctggccctcaccgatctggaccgccaggcccgtgacctgtttgtgcagtggtgcgaagcggccgggtgcagcgtcactgtcgacgccatcggcaatatctttgcgcgtcgtgccggacgcaaccccgccttgcccccggtgatgaccggcagccacatcgacactcaacccaccggcggcaagttcgacggttgctacggggtgatggccggactggaagtgatccgtaccttgaatgatttgcagatcgagacccaagcgccgattgaggtggtggtgtggaccaacgaagaaggctcgcgcttcccgccgtgcatgatgggttccggggtatttgccgggaagttcgacttgcaggacaccctcgacaaactcgacgaccagggcctttcggtgggcgccgaattacagcgcatcggctatgccggttcgcgcgcagtgctgggccacccggtgggtgcgtacttcgaagcgcatatcgagcagggcccggtactggaagaccaggccaccactatcggcgtggttatgggctgcctgggccagaagtggttcgacctgaccctcaccggcgtcgaagcccacgccggccccaccccgatgcacctgcgcaaggacgccctggtcggcgccgccgaggtggtcagcgcagtcaaccgtatcgcccatcagcaacaaccccatgcctgcggcaccgttggttgcctgagcctgcaccccggttcgcgcaatgtgattcccggccaggtgcagatgaccatcgacttgcgccacctgcatgccgacaagttgcaagccatggtcgatgaagtgcgcggcgtgatcgaaaccacggccgcccgccacggcttgacctttgaactgacgccaaccgccgacttcccgccgctggacttcaacccgacctgcgtcaatgccgtgcgcgaggctgcgagcaccttgggcttgagccatatggacatcgtcagcggcgctgggcatgacgcgattttcgtcgccgaactgggcccggccgggatgatctttgtgccgtgcgaaggtggcatcagccataacgaaatcgaaaacgccacaccggatgacctggcggcaggttgcgcagtgttgctgcgggccatggtcaatgcggcacagggggatctggcatgagtgagattggccaactgacagcggtgcaactgctgcagcattttcgcgacaaaagcttgtcaccggtggaggtcaccgaagatgcgttgctgcgcatcgagcgctacaacccggtggtgaacgcttactgccatgtggacccgcaaggcgcattggacgcggcgcgtgtctcggaacaacgctggttaaaaggtgccccttgcggcgccctggacggcgtgccggcgtcgatcaaagacctgaccctgaccctcggcatgcctacgcgcaagggctcgcgcacctcatccgccgagggaccgtgggatgtggacgcgcccttctcgcacttcatgcgcaaggccggcgcggtgctgctgggcaagaccaccacccccgagttcggttggaaaggcgtcaccgacaacccgctgtacggcatcacccgcaacccgtgggacacccgcaccacggcgggcggttcctccggtggcgccggtgcggcagcggcgctgaacctgggtgtgctgcaccagggcagcgatgccggcggctcgatccgcatccccagtgccttcaccggcactttcgggatcaagccgaccttcggttatgtgccgcagtggccggccagctccatgaccatcctgtcgcacctggggcccatgacccgcacggtggaagacagcgtgctgatgttgcaaaccgtggcacaaatggatgtgcgcgatggcctgatcggggcgccaaggaccacgccctggctcaccccaggggcggatctgaagggcttgcgtgtggcttatagcccctcgttcggctatgtggatgtcgacccgcaagtcgccaaggtcgttgcccaggcggtggagggcctggtgcaattgggcgcccatgtcgagcagatcgacccgggtttcagcgacccgcttgaggtgttcagcaccctttgggccgccggcgccgcacgcctgaccagttccatgagcgacgcgcaaaagcaactgttggacccggggctgctgcgtattgcgcaacggggcgagcatctgagcctggatgacttcaacgtcgccttggaagcgcgcgccgcactggttgcgcgcatggcggcgttccatgagcactacgacgtgctggtgtcgccgatgatgccgattaccgcgttcgaagccgggcacaacgtaccgccgggttcggggatgaacgaatggatggaatggacgccgtttacctaccccttcaacctgacccagcaaccagcggcgtcggtgccctgtggattggcggcgaatgggctgccggtggggctgcatgtggtgggcgcacggtttgccgatgagctggtgttgagggtttgccacgcgtatgcaaaggcattccctaccgagcatttggcagcacctgaaaccctgagctgaaattcagttgaaccggtgggagggggcttgctcccgatggcggcgagtcagtcaccgctgcatttgctgaaactccctcatcgggagcaagccccctcccacagttttaccgcattccactacaatgccctccattcatcttccgggggggcttcatggacatcgaactggcacgcaccttcctggaaatcacgcgctgcggcagcctggctgcagcggccgagaaactgcacgtcacccagaccgccatcaccgcccgggtgaagaacctggagagccagctgggcagcacgctgtttatccgcaaccgtgccggtgcgcgcctgaccgccgatggcgaagcctttgtggtgtacgccaaccagctgctgcaaacctgggaggctgcacgccgtgatctgccgttgcccgatggctatcgcaatgtgctgcatatcggcggtgaggtgagcctgtgcaacccgttgatgctcggctgggctcaggcgctgcgcgaacatatccccgggcatgccctgcgcaccgaaatccgcgagggtgaacaccttctgcgccaattggaactgggtgtgctcgacgcagcgctggtgttccagccgcaatactggccgggcttgcaagtggagcaagtgctggaagaaaaactgatcctggtgcaactggcgagcaaacccgagccctacgtatatatcgactggggccagggttttcgccagcaacatgacgccgccctgcccgacaaggcccgcgccgcgctgagcttcaacctcgggccgttggcgttgcagtacatcctggaaaatggcggtgccggctacttccgtacgcgggtggtgcaaagctacctggacagcggcgtgatgcagcgggtggccaaggccccggaattcagtttccctacctatcttgtgtattcacgggcgcgggactcggcggtgctgcaacaggcattggcgctgctgcgcgaagtggtcaaggctgaaagtgactggtcgcaacgctgggatccgctgatttgaagcaccggatgccgccgcgcatgctagcctgcgggtgtgtccttttgcagccttaccgatgaacaagaaaaagtccgtcaccatcagcgacatcgccaaacgcgtcggcatgaccaccatcacggtgtcccgggcgctgagcaaacccgacctggtcaaacccgccaccctggcgcgcatcctagaggtagcgcgggagctggactatgtgcccaacgccttcgcccgtgggctcaagcgcagtgagagcctgatcatcggggtgattaccgcgtcggtggacaacccgttctacagcgagatgatcaaggcgatttcccgcgaggcgaaaaagcacggctacaccatcatgctggtggacaccgatgagctggaggaactcgagagcaaagcggtggataccctgctgggctaccgcgtggcggggatcatcctgtcgccggtctccgatgaaccgagctaccagcccgattacctggaacgcctgggcaatggcaagaccccggtggtgctgcttgatcgcacgatccacgacagcccgttcagccgcgtagtgctggacaactaccacagcggcctgcaagcagcacactacctgctgcgccagaccccgaacttcaggcgcctgctggtgctgaccggccccgagcattcgcgtatcacggtggagcgcctcaagggcctgcgcgaagtgctggccgaacacccgcacattcaggtcgaggtgcaggccggcgactacaccttgatgccggcgtatttgcacaccctcgactacctggccacccactcggcgccggacgcgatcatgggtttcaaccagttgattaccctgggagccttgcgcgcattgcgcatgcacgacatcccccacgacagcctgaccatctgcggtatcgaccgcctgcccttcgccgatatctttggcgtgcccatcgcctgcgtggcccacgatgcctccctggccggcagcagcgcggtacgcctgctgctcgaccggctggaagatccctacaagccacgggacaaggttgtgatcgccgggcaattggaaaacggctagcggctggtgtagccaccgtcgataggcaaactcacgccgctgatcatgctcgccgcatcgctcagcaggaacagcaccggcaacgccacttccgccggttgcgcaaaacgccccagggggatcgccgccaacgccgggtcgcgcttggccgggtcggaccaggccatgcttgccatcggcgtcagcgtcacggtggggttgacgctgttgacgcgcaggccaaaccgcccccattcggcgcattgcacacgggtgattgcatccagggccgccttggaggcgcagtagccgagatggtcatccaacgccaccaacgacgcctggctggacacattgacgatacggccggcgatgtccgccgcgatcatcttggccgcgacacggctggccacctgggcggcagcacgagcgttgacgtgcatcacctggtcgaaggcgtctgcgctgatggcagcggcgggctccaggcgcgagatgccggcgcaattgaccaggccgtgcaggggcggcaggtcttgcagcactttatcgagggccgcgctgtccgcaatgtccacacagagggagtggcagcccagttcggccaaggcttgggcgtcgcggccgagggcaaagacttcggcgccgctggcaatcaactgccgggcgatttcccggccgataccgctgctggcgccggtgacgaggatgcggtggtgggtgaagttgaagactgcgttcatagataaaaatctcaagaacaatgaagatccactgtgggagggggcttgtcccctcccacattttttctgtgttgaatcaggtaacttgcaggttgtgcatgatcggtttcagcgccgggtatagcttcaggtactcggcaaacgcttgatcataggccaggacattctcgcgcttgggctgcgcccgttgctccagtttcacccagcccgtgtccatggcttcatcactcaccaaccccaccgtatgcgccgccaataacgccgcgcccagggccgcttcaacctcttgaacaatggtgtagacggggtagcgagtgacatccgcaataatctgcatccacaggtccgaatggctcgccccgcccactacaatcaagcgcggatccagggagtgtgcgccctgggtgcccgcttcgatattgtggcgcagggcaaaactcaccccttccagcactgcgcgatacaggtggatgcggctgtgatacaggttgagcccgacaaaactgccgctggcgcggtcgtcccataccgggctgcgctcacccatcaggtacggcaggaacaacaggccttcactgcccgccggaatcttcgtcgcgctctgctccagcagcaccaggctgtcttgccccgtcgcctgggcctgttgctcttcggcctggcagaactgctcgcgaaaccagctgaccgaggccccggcggtgatcgcgccgccgaagatgtacaggtcgcggtgaccgttgtagacatggggcatgctgaccaagcaatggcgggcatccacctgctggttgaggtaaccccagcacatgctggtgccgatcattgccacatgattgcccggctgggtgacgcctgcggccagggtggccatggccgcgtccacaccgccggcaaggatcggcatgcccgcctgcaaacccaggcgcgccgcccagtccggcaacagcccacccaccacctcgccggaatacaacaggcgctcgggcatcatggccagggggatttccagcgccgcgagcatcttttcggaccagccgcgttgggccacgtcatacaccccgccgatattgccggcgctgctgtggtccaccgccagctcaccggtcaggcaccagttgatatagctgttgggcggcagcaggtagcgggtgttcgcccacgcctgcggctgatgctgcttgagccagagcatcttggtgaagccgtagtagctgtccaccgagttgccggtcaccgcaaacagccggtccaggtccacgtgctcacgcacccactcgacctgctcgccggcgcggcgatccatccagatcaggcacgggtgcagcggcgtcatctgtgcatccacggcaatccccgagccgccgtacaggctgctgatgcacagcgccttgacctgctgcgccggcacgtcggctttggtcatgcactgggccacgcacgcctcgactgcatccagccacacctgcggccattgctcggcccaacgcactttcggggtatccacgcgatagccctggctgtgctgggcgatgatcgtgccttgggcattcaccaacagcgccttggtgctctgggtgccgatgtcgacacccatgacgtagtgcatgccgttactcatgggcgggcagcaccggcttcaacagcaccttgatcgacttggtggagttggccagttcgaaggcttcggcgaagtcgtccagcgggaaatcatgggtgacaatgcctttggaggtgaccaggccgcgttcgaacagatcgatggcgatcgggtagcaatacggcccaaggtgcgcaccacgcacgtcgagttccttgcggtcgccgatgatcgaccagtcgacgctggtctcggcgccaaacacgctgaactcgacaaagcgcccgagcttgcggatcaggtccaggccctgggtgacgccggccggtacgccggtggtttcgatgtagacgtcacaaccgtagttgtcagtgaggccgttgatgatctcgcgagcattgtcacgggccgggttgatcaccacatcggcgccgaattttttcgccagttccaggcgctcgtcgaccatgtcgatcaccaccagttttttcggggtcttcagcgccgccacctggaccatgcacaggccgagggtgcccgcgccggcaatcaccaccacgtcgtcgagctggatatcgccacggttgacggtatggatcgagcaggccatcggctccaccagcgccgaatcctccagggacactgcctcgggaatcctgtgcacgatggcagtcttggggatgcgcatgtactgggccatgccgccttcggccacttcgcgctggaagccgaagatgttgtgcacttcgcacatccagtatttgcccgatttgcagaagcggcacttggcacagggcacgatctgttcggcgatgaccttgtcaccgaccttgacctcaaagtgctcctcggcgccctcgcccgcttccaccacgtagccgaaaaattcgtggccgggcaccactggcgccttgacccaggggttgtcgccaccccagaacatcgccgcgcccgagtggcacttgcagtcgctggcgcagatgccacaggcggcgatgcggatcaccagctcattggcgcgggcctggggcttgccgatgcgttccaggcggtagtctttcgggccgtggcagacgacggcttgcatgtgggtgtgcttgtccatggtgttcagtcctgtgtgatgaggtatttatcgatggcgctgacggctgataaagatcgccagcaaaatgatcccgcccttgatcacgctctgcacgtaaggcgatacgccaagcatgttcaagccgttgttcaacacgcccagcagcatggcgccgagcaaggtaccgacgatcaccccgcgtccgccggcaatcgacgcgccgccaagcaccacggcggcaatcgcatccagctcaaacgacacgccggcattcggctggccgctcatcaggcgcgaggtgagcaccaacccggcaatcgccgcggtgaagccgctgatgccatacaccagcagcttgaagcgcgctgcgcgcaccccggacaaacgcactgcttcttcattgccaccgatggcgtagatgtagcggccgatgcgcgtgtgttgcagcagcacataggccgccaggtaagtgagcagcatgatcaggatcggcacctgcatgccgaacacactggcgcgaccgaaaaaggcgaaccactccggcaacccggaaatcgggtagccgtcggtgtacatcagcccgaacccacgggcgatgcccatggtcgccagggtgacaatgatcggcggcatgtgcaggtaagccacgaacaagccgttgccgatgccgaacgccacgcccaccagcaacccggcgccaatcgccaggccgggcggcacacccgcgaccatcagcccggcagtcaaggtgccggacagcgccatcaccggccccaccgacaaatcgatgccaccggtaagaatcacgcaggtcatgcccaccgcgataatcgcgttgatcgacacctggcgggcgatgttggacaggttgctggtggtaagaaacgtgtcgctggcaaggatcatcaccagggtcaccaccaccagcccgacaaacggataaaacgctggcgagcgcagcagccgcgccaggttcaggcgcaagcggctggtgcctgcggtgttaatggacgtattcacttgagccccctgttgcatggcgcatgacctcttgaggattgacggcggacccttccagcaccttgacgatcgcgcccttgtggaacaccgcgacgcggtcgcacatgccgatgacttcgggcagttcggaggaaatcatgatgatggcgtagccctgttcggtgaggctgcgcatcaaggcgtagatctgcgccttggcgccgacgtcgatgccacgtgtgggttcatcgaacaccagcacgtcgcagtggtggttgatccagcgtgcgatcacgactttttgctggttgccgccgctgaggttaagcacccggctttcgccgctgggcgccttgatcgacagctggcgcatcagcgcttcgacgctggcgcattccttggccgtgtcgatcagcccgctggcgttctggtacttgggcaggttgttcagggagatgttttcgcgaatgctgaaatcggtgatcagcccttcgctcttgcggctttccggcagcaggccgatgccatgggcgagtgcctcggccgggtcattgaggctgattttttcgccgcgcagccacacctctttgctcaccgacgccagcgcgcccatcatgcccagggccagttcggtgcggcccgagcccaccagcccggcgaagccgaggatctcgcccttgtgcagttgaaagctgttatgcgggccgttgcgtaccaactggatgtccttgacctccagtaacagcgggccgcgctcgcccgtgggcttgggtgggaaactgcatgccaggcgccgccccaccatcatttccaccaggcggtcgatatcgctgtcggccacatcggtaacgcccacattgccgccgtcgcgcaacacgctgatgcggtcgcacacctggaaaatctcttccagatggtgcgagataaaaatcaccgccacgccctggcgcttgagttcgcgcatgatctcgaacagcagctcggcttcgctgggggtcagggttgcggtgggttcgtcgagtaccagcaagcgcgcatccagggccagggccttggcgatttcgacgaactgctgctcggctacgctcaggtgcttgaccgcgcaatgcaggtcgatgctcaccccaaggcgctggaacaacgcctgcgccgccacggccatttcgcgcttgcgcaacagaccgaaacggttgctcaactcatggccgaggaagatgttttctacggctgtgaggtagggaatcaggctgaattcctggaacacgatgccgataccggcggcaatcgcgtcacggtaagtcgcaaattgccgggcctggccatcgatgaggatctgcccttcgtcctgatgctcgacaccgccgaggatcttcatcagggtggatttacccgcgccgttttccccaagcaaggcgtggatttcgccgcgctccacttgcaggttgatcgacttgagggcctgcacgcccgggtaccgcttacagatgttttccagcttcagaagactgctcataccgccgacctcgcgttcagaaggtttgcctgggccccacggcgagcgtgggacttgaggggtttaccagctgaaatccttggccttggcctggtcgatcagggtgatgtccactggaatggtggcgggtacttgcgagccccacttcttggccagggcaatgcccagtgccaggcggatctggtcacgggggtattgggccgaggtggcgatgaaatgactgccgggcttctggatcgccttgatcgcttccggcgcgccatcgacgctgaccagtttcacatccatgccgctggcttcgatggccgagagtgcaccgagggagccgttgtcattgacgctgaaaatgcccttgagggtgggctgggcctgcaacatgttttcggtgacggtcagcgcctggtcacgttcctgcttgccattctggatgctcacgatcttgatgtccgggtgcttggccaccgcctctttgcaaccgcgcacacgttcgaggatcggcaccacggcaatgccgtcgaggatggcgatattgcctttgtcaccgatgtttttcgccaggtattcacacgcctggaagccggcgtcgaagttcttcgagccgacgaacgaatccagcgggccgtccgcctgggcgtccaccgccaccaccacgacgcccgcggcatgggccgacttcacggccgattgcacaccgaccgaatcggtagggttgatcagcagaatatcgatgcctttttgcagcatgtcttcgacatcactgacctgcttggacacgtcgtggcgggcgtcggtaatgatgagctttgcaccgatggtcgcgccggcttcttccagggcgtttttcatggtgacgaaataggggttattgatttcctggaacgacgcaccgatgcggatgggcgcaggtgacgtggcggcaaatgcctgagtgccgagggtgatgccggcagccagtaaacacagggtcttcgggagcattttcatggcgtgggtctctgttttgtttttatttttagagcaaatgttatcgttaacatttcgccagaaactaacaagtaaatcggacctgcgcaagcctccactggtcggtctcgatcaaaatgtgggagggggtttgcccccgatagctgtgggtcagtcactgatgtatcactcagattccgccatcgggggcaagccccctcccacattggctcgccgtcactggcgcaaatccccagcaaaaactcgcacattgcgccccatccactaagctcagtccctgacaaaaagaccgagcagcccaccatgccccaccccaccgaaaccttccgcgcccactaccgcgccaacgtgcaccgccactacaacccctggctgtacgccatgttcgtcctcggctacggcatcgcctgcatgaccctggcctggtccgccaccgccgacatcaccgcgctagagtggctgaccgtgcccttgaccctggtgttcttcaacctgtgcatctacctcgttcaccgccacctcggccatcacaaacatgggttcgctcggctgttctacgcacgccacaccggcgaccaccacagcttcttcacccctgggcacatgacctacgacagcccccgggactggcgcgtcatcctgtttcccgcctggctgatcgtactgcacagcctggtcatcaccctccccgcctggtggctgctcaagcaattgagccccaacgtcgccgggctgtttgccgggtgcatgatcctcggctacctgctctacgaagtgttccacgcctgtgaacacttgcccgctgaacacgcggtggcgcgtctgccatggattcgccagatgcaccgcctgcacgctctgcaccaccgtcgcgagctgatgcaggggcgtaatttcaatatcgtgctgccgttgatggactatctgtttggcactttgcattgggaacccacggtaaaaaaaaggggcagtccaactggactgccccccgcttcacacacatagatcaatcagtgcacgatggtctggctgcagatgtggccgaggctgacgtattggacgttattgccacccacgcccacaccagggaactccctgagctcgatgcgccagccgccctcgttgaaccaggtttcccagttgtaggtctggcccgaggcgctgtccgggtaccgcactttatagtcgccagagcaggtgcccagcgcgacattccccgaggctgcaccggtgatgccggtcttggcctcatagtcgacccagttgtaagtggcgccaaaatgcttgtcgacacgcagtacaggggtgacgccgcgcaggggctcgccagtgctgtctgaccactgggtgctccagctcagattgcgggccgcctgggtggccagttggaagatcgagctggggatgcgtaccacgttatcgccgttcacattgtgctggttcaggcgtggcgccgaaccgagggtcagcttgtattgagcctgagggttcagtgccaccgctggattggcccgtacacgcaccttgaccgtgtagcccggcgtcaggttgggataggtggaggtggagccctgcgggacttccacccacttggtgccatcgaaccgttcgaagatccactggttacgcgtgcccgcaccatcatcgcccaggaacatgcccacaccttggccacgcaacgagacgaaggagaagtaatccacgtcattgacgctgtcgaggttaccagtcacctggttcaaggcatccggcagcgcgaacgcggtttgctcagtgtcattgggctcgtaggcatcaatgttgctgtccaccgccacgccgaaactgaactgcgcgttactcgcggtattggccaccatgaaccagtagtagtcaccggccggcaacacgccgttgaggtattcatcggcactgccagggttatcagaagtgcccagtggcgtcaggttaccctggccgtcgtcgtggaacagggtcaacgacatgttcgtaccggcgctctggttcagcagttgcacctggattcgcgagtttttcggcaggttgaagtggtaagcgatttgcgcgccggtctctaccccggtgagggtgtagagggtattgatatccagggtcggaaacagcggcgtgaattcagcgatcgcagcctgtttcatttgcgccgggtcaggtttttgcagctcgctgatcttggtgtcaaccgccacattgctggccactggtttgctcttgacgaccttggtctgccccgccttggccgcattgagcttttgcttgagtgcatccgacaggctgtttttttccaacgtaccgccgggtttcaacgctttatccacggcctgtttgaccgtctgcgcactgagtttcagcggggcttgctcggccagggcgaaggccgaaacgaagcaggaggccgccatggccgcgcccagcataaaggcttttttcgatttcattttttatccatccatagttaaaaaattgaagctcaggtaaccggtgacatccggtcacctgggatggactgtaggacaatactgtatttatgtacagtatttttcaaaatatgtgctcccggttttttcgctgtgagccctcctgctatggaattgggatatcgcaccacctgcgccaaatctcccatacaaccatttcgaggacacaaacatccgcgaggcgatacggccactaagcccagcgcttaagcgtcaagggaacagatgccagctcagcttcggtcacaaggcctgcctttaggtaagctttcggccctgataggatgtcgaccatcaggctcatgcgatgatatctgtcgatcggatcattcccttccctgaagcgcttatgcctaagaaccttctcgttctcactgaagtaactttccagttcatccagctttgcgtattcagcaaacaccatcagtccgaagacgacaaacacccaagcgaacatcacaatgctatatacaagaaaaaggggcatcgttatgtcccctcgggttggaatatcagatcgccgtcgacttccaatattcttccccccaaaaacccaccaagctcacccaaaaaagagcctcccgccgccccgcctacagcccctccgataactccacaagccagttcaccattgcctttcagtgaaacacccaatgcaacccggcatgcactgcgagcaatattcgcggcacgcttgcccacaacagcagccccgaatactccacccaccaacctccccgtctccacatacttcgcccgccggcactgcgcctcccttcccgccacgcacgcctccttgatttccaaacctgccacgcccacatccaacgccatcccaagatacgttccttgcttcaaccgctgcgacatctgcgtaatcgcccgaacccgctgcgcataccccgcaatctcaccttgatgcagatagcttttggtcgagatcccaagcgttcccttcagcggttgattgccacgcaaccctgagccaaatcgtgcggccccttgcagttgcgaatccaaaacgccaaacatttgttggcgttggcgtataaacgtctctctgtctaaaccaccgtccttcaatcgccgatgcagttgctcgatgtcctccaaagtgtgtgcgacctccttcaggtgccggctccaagccgatgtcgcactgcctatcccaatcgagccataccccagaatgctctgcgccaggtcataatttttatttccagttccatcgagcggcatatcctggttcagccggcgactaatctcttcagcgtggcgcatcaaccaggcttcttcgattgtgcaatgggcaccgggcgcttctggaacgatcaccaactcacccggcctcaccaatccgcggctcaggtgttgattcagcacatcgaaatgatctcggccctgcaacaagcctgcatgccacagctgtgatttcaaaaatgcgtacggtaaagcctgttgattgatatagccgtacgccatgtcctggattccgatatcgagagggatggcatcgaaagataagcaagcgcctacagcctggacacaagcaggaggggtcaaaaaatacgtttgggaagttgcctacacagcaaaagatacgaacctacggaaagcgtccctaatagcccgtcatctccaaataccccaccccaccctcgaacttcactggcccttcccagtagggaatccccaagttcatccacgccttttgattgaccgcctcggtggtgatatccaggtgtttgccggggatcttcagcgaccagcgcgtgggaatgctgcgcccgtcaatcttggttctggtcagcggtgtcagttggatatcggcgttgtgcaacgtctcggtatggccttgggcgtcgatccaagtgccggtgaggtaaccgccaccgtctttttgccgcacgcgaaacagcatcagttgctcgccccggtccaggtgcagggagaaccagtcccaaccggtctggctggcggccaggggttggctgctccattcgcggtcgagccaggccgggccgctgacctggtagacctggccgtcgagactgacgctgccattggcggtgaagaaaggctggctgtagtagtacgacgcctggccctggtcggatttgcggctgtagcccttgtcaccttgcagcaccagtgggcggttggaggtcaggcgtaggtcgtaggcgaattgggcaccgctggccttgagctgcatgtcagccaggggggtggcggcgccaggttgggtggcaaagttccagtcgtcaatccaggcgttgaacggcaccgcctgggccccggcctggccgacgccgccgcgggccaggcgttcggcggcgtagtggcgggtggccgaagtgacggcagcatggccgagccacaccgttgaatcgtgccagcccggttgcgtggggccggccttcagcgcattgcgaaacagcgtccattgcacgccgaagagattgccctgggcatccttgaggttggcggtgacgtaccaccattcgatacgaaagcctgggtgcgggccatggtcctcgggaaagctgaagactttaccgggcaccacctgagtaaagtccgccgcctcactgcccaggccggcgaagctggtctcaggcgcaggcgtcttgtcgcatgcgctcagcagtaacaaggcggcgcagcacaacgccttaatcttcatgggcaaaggtcctcaacaaatccgccgggcggctgcggtacaactgccacaagggccaggcagacgccagcaacgtggcaaccatcgccagccccagcaattgcgcaagctgccaggggaacacctgcaacggcaggcgccaaccgaaggcctggacgttgatcaccgcatccaggcaccacgccagcagcagccccagcggcaacgccagcatcagcgtgagcagcgccagcagccaggtctggcccaggttgagcagcatcagttggcgccgtgtcacacccaatgcccacagcggcgcgagttggccgaggcggctctggctctgggtcagcaggctgataaacaacgccacgccagccacgcccagcgtaaggctgttcaacgcggcagtagcggcgaaggtgcgttcgaagacctggctggaccagcccttgagttgctgttgatcgacgatgcggctgtcttcgagggcaaattgacgctgcacttcacccaccagcgccggcacgttctggggcgccacccgcaggttgaatcgcgccggtgacagtgtcggccagtgcgccagcaagtgccgggcattgaccagcagatggcccttggggttgccgtagtcggcgtagatcccgacgacctgcggtgcccagcttccttgtggcgtagggatcgagagcgtatcgcccaactgaacgttcaagcgtcgcgccagttgctcgctgagcatcacactgtcgtcctgcagcaagcggtcccagggtgcgtttgcagcctcaagcaacggccagtgccggcgataggtggggtcgtcgaccacgccgaacacttctgccggccagccttgcagctgcaccgccacctgccaggtaggcaacactgcctgcaccagcggctggcgggccagccaggtattgagctgctcggcctgagccgggttctgcgggttgaggtacagctcggcggtgaggcgctgctccaaccaatggttgaaggtctggcggaaacccgaggtcatggaaccggccccgatatttgccgccagggccaacagcagcgccatcaacgccaggctcaaggccggcagttgctggcgacaatcggcgaggaaccactggccgagcaccgagcgactgcgacccagcatgcctttcaacaacccgttgagcagcaccggtaaccccagtgcggcgcccagcagcaaggccgccatcagtacaaacccggcggccaggctgtcgcccagccacagcgccaacagcgcgatcagcaacgccgcagacgccacccaaccctggcgccgcaaccagcgcccatgggcctcatgccatgcttgggcgttggccaatgccaataagggcaggcgcgcggcacgccacaggctgctggcccctgcgagcagtgcgccaagcaggctcaagcccaggccggcgagccaccaccagggactcaagctcaattggcccggaacctctgcgccgtacaggccgcgcaaactggcggccacatccggcagcaacaggctggccaatacatatccgctggcgatgccgagcaagccgcccaacaaggacagaaatcccagctcaacccccaggctgaggatcagcatccgcgcgctgactccacaggcacgcaaggtgcgcagcaggccacggcgttgttccagggccaggccgatggccgcatgcacgataaacagccccaccacaaaggacagaaagcccaacgcatcaaggttcaggtgaaagctctcggtgaggcgcgcgaggttgttgtcctcgccctgcttgagttgcagcgcggcgggtggcgtggggtggcgggcggcgaaggtgttgtccagcaacaagcgtgacagttgcccctgcatgtcgagcaaaggttgggcaaacgcgatatcggtcaacagcaaacccggcgccatgtccgcctgtacctgcaatggcggcagggtgtgcgcgttgactgtctgcggctgatcgccctcgtgcaacccgagcgcctgcaaggtttgcgcagccacccaggtacgccctggcggggtgaaaaacgccagcatctgcgcctggctcagccgttgccccgccacactgccactgccgggcaacgacaccgggtcgatgcccatcagttgcaggcgctgttgctcatgccccttgagcaccaaccgtccctgcaccaccggggacaccggccacccggcgcggcgcagttgggcaaacagcgcttgcgggaaactgccggcgtccggcgcactcaggctggcttggggctcaccaccgatcaactggctggcgcgcgcatagctgtcccgtgcctgactgttgagggcctgcacgccggtcaataacgccgtggccagccacagaccggtgagcacgctgaaaaattgaactgggtgacgtcgccaatggcttaccaacgcacgcaacgtccagtagaacagtgccatctcagcgcgcatccatcggcacgacacggccatgatgcagcaccacctggcggtccaggcgtgcggccaggcgtgggctgtgggtgaccatcaacaggctcgtagggctgtcgcgcagcaggtccaacagcagttgcagcacttcatcgctggtggtttcgtcgaggttgccggtaggctcatcagccaacagcaagcccgggcgcgaggccagtgctcgccctaccgccacccgttgctgctggccgccagacagttgctcaggatatcgcttgagcaaatcgcccagtcccaggcgctccaccaactgcgcctgccactgcgcatcgaaacgcccggccaaccgcgcctggaatgccaggttgtcctccacgcgcaagctgccgatcaggttgaactgctggaacaccaggccgatttcagtgcggcgccaatgggccagttgcgcctccgtcaattggtcgaggcgctgcgcgccgatttgaatgctgccgccatccacacggtccagcccagccaccaggtgcaaaagcgtacttttgccgctgcccgattcgcccatcagcgccaggctgctgcgttcccccaggtagaggtcgacacccgccaggacggccagcgggccttggggggtggcgtagttttttacaacaccttgcacctgcaacataaaaacgctcgtaggaaggactgccaacgagaataacggctgattgtgcagcccatgcaaatttttcacatggatttcactgcctgcccatcctcgacactttagattgcgcgtcaagtggcgataagccgcaacttattagttagcgcacagagtacttttaataggcaggtgttcagcaaaaagacagcagcgctatgacaggctcttgttccacaacgggcaactgcccattcactgtgcgtgtttataaacacaacaatagtgccaaaggtgaacagcgtggcagatatgaccctggccgaccctaaactcaaatgggcacggttaaagcgcctgaaaaaataccgcctgcatttgctgggtatgactgttaccgcagctcttctgacgggcttcctgttatggccggtctcgccgctggacctgggcgtgggcaaccgactggtaacctcgggggtgctcgccagttggcgcaatggtgacgtggtagtgctggtgcgccatgaagagcggtgcgaccgctccaccaacccctgcttcggccccgccggcggcctcacggtccaaggcagccaacgcgccgcgcaactgggcaaagcctttgattcattgggcatggagcttaccgacgtgctcagcagccccaccacgcgcaccgcccagacctcactgttcatgttcggcaaggccgagctgtcgccggggcccctcgccatctgcggtgacgccatgggcgaggaaatcctcggccacaaacgcagcggtcgcaacctgatgctgatcacccacagtgcctgcatgagcgacttccaaaagtcgcttggcttcccccacgctgccgccgccgaatatggcagcgcgctgttcgtcaaggtattacccaacggcgaattcgaggcattgggcactatgaacatgcggcaatggacggtcgcactaaaacaactttaaacacacttttttacatataccacagctattacgttcagcaaaacgacagccctgttatggcatgttcgcttacacctgttagttagcacctcctcaatggttcagtgaacatcgtgactcttcgccctactcatttaattgcctcattgtgtcttattgaacgtcatggagcgacgcactcatgacccgcttgaatcccctgccctggttattactcggcttcgccgtcttcttcctgctgcccttgggtttgcatggtttgtggaccccggatgaaacccgctatgcccaggtcagccaggaaatgctgatgagcggcaattgggtggcgccgcacttcatgggggtgcgttatttcgagaaacctgccgccggctattggctgatcgccctcggccaggccgtgttcggtgaaaacctgtttggggtgcgcatcgcctcggccctgagcaccggcctgagtgtgctgctggcctacctgctcgcccggcgcttgtggaacgatccgcgcaagagcttcgcctgcgccctgctgtacatgagctttggcctggtggccgggcaagcggggtattccaacctcgacccgcaattcaccttgtgggtgaacctgagcctggtagcgctatggtttgccctggatagccgcacgccccgcgagcgcctgggggcctgggcagtgttggggctggcctgcgccatggggtttatgaccaagggtttcctggcctggctgctgccggtactgatcgctgtgccttacctgctctggcagcgccgcgtgggcgagctgatgcgttacgggccactggcagtgctggtcgccatgctggtgtgcctgccgtgggccctggcgatccatgtgcgggaaccggattactggcattttttcttctggcatgaacacatccgccgctttgctgccgacaacgcacaacatgcgcgaccgatgtggttcttcctgccgatcatggtggtggcgtgcctgccgtgggccgccttgttacccaccacattgctcaagacctggcaggaaaagcgccagccggcgattgcctttctcgccctgtggctgctgctgcccctgggctttttcagcctgagcaaaggcaagctgcccacctacatcatgccgtgcctgttgcccctggcattgctgatgggccacgggttgatcgacctgatcaagcaaggcaaggcgcgcacgatcgtgatcaacggtgcggtcaatttcaccctcggcatgaccgccatggtgctgctgatttacctgcaaatcaccgacccgctgtacggcaacagccatgccgagatgttcagcctgtccctggtgtttatcgtgctgctgggctggatcctcgccaacctgttgcaagcagtacggccaatgacgttatgggcgatgccggccctgggcatcggcctgctggtggcattgttgccggcgggcatgccggcgctgatcgcggataacgaaatgcccgaccagttcgtgcttgagcacctggacgaactgcagcaaacccaggctttgctgagcaacgaactgggggctgcgtcggccttgtcatggcgcttgcggcggccgcaagtggccttctacaacaccgtgggcgagctgcgctacggcctgcattaccaagactcggcacaccgcaagatcacgctggataacgtccaggcctggttggccgaggctcgccagcagggttcggtcggcgtgctgatgcgggtcaggagcaccagcgaacatcgcgaagaagggcaactgcctctcggcggcaagcgttatcgcaaaggcaacctggtgctgacgatttacccacgacaaccttaatgcagcgcctgccacagggaaaacccatgggcttctggagaaccgaacgcggcgccttggctttattgctgggcacctcggccttgctattgctgctgggcctaggcagccgcgacctgtgggggccggaaacccgctgggcgaacatcgccttgcagatgctgcaaagcggtgactacttcgatccctatctcaaaggcacgccctactacgacaaacccctgccctcctactggctgattgcaggcttcgcccacctgatgggcggcctggggccgtggtcgctgcgcctgtcatcggtaattgccgcatggctgagtatctggctgatttacctgattggcgaacgcctgttccgcaagggcaccgggttgattgccggctggatgctcgctaccaccttctacttcctgttctgggggcgagtagccaccgctgatgtgctgactgtttgcggcgtgctggcggcggtgtggtggtattggcgtgggccggacgacacacgactggggcgctacacggtatttttcctgctgctggcagccacctcactgttcaaaggcttgatcggtttcgtgctgccggggctgctgctattgccgcacctgctcaacgagcaacgctacaagcgtcacctcaatctgcgcatgctgctggccgtgctcatcgccgcagcgttctacgcgatccctttcgtactgtcccatcactacggcgcgcccacttacggccagagcggcctggaactggtattgcgggaaaacgtggtgcgcttcttcgaccccttcgaccatatggggccgatctacacctatctgatctacctgccggtctacaccctgccctgggcgccctgctggctgctcggcctgtggctggccgtgcggcagtggcgccacaccccgcccaacgtgcgctggctggtgtggggcctgggcctgttgtttgtattcttcaccgccagcggcagccgtcgcagctactacgtactgccgctggtgccctttgcccaattgctcgccgcctggtggctgagtgaacgccagcaaacaaaaccggcgagttggccgcgttggcagaaaggttttggactcagcgcaggcttgatggtgctggtgctgggcgtgatctacccctggaccaacggcaacggtggcgtgacccgcttcgccgcagatctacaggcccaagcggtgaaaagcgcaccgtggaaccagtggcaaatggtgctggtggaggtcgacaacaagctgccgatgtacctgcaaaaccatggcaagcctttctactacgtcagcgaaacccaggacttcccccgccagggtgacagcgccgcattcatggcctggctggacaaaaccagcggccaacgcttcgacccgcagcgcacgattatcgtcgtgcagtattccaagcaagagccgacgccgctggcgttcctggggatggatcatcaggtggtcaggacgcagccggataatggcgagcggtggtttcacaagcgtgacggggggagcgtggcgttcgtgcccgcgccgcggtgagcctgtgtcgctactgggctttcgtcatggtttgtaaagggccagcaagtcgtatccctttaaattgcaggacgtttccgagacaatccccgccgccttgtgccggttggaatcggtggctagtctgcgatccgtcactgctcatcagtgatcgggtttagtcgcccggattccagttgtgcgcaagctgtcaccttttcatggtggctgtgcgcagggcaccttcgggtgcgccggatccaactggccggtcgactaacctgcgtacagccgccacccaacgtttagtcgcgaagggttcggctcctgacctaccagttggagttacaccatgaataaaatcttacccgatccacccttcgaccctgccaaaacccgcgccgcgttcaaccgcgccatcgaccactacctgcccagccagggtttccacagcgtcaacgacgacctgagttttgaagatgcgttgctgtacaccgccagcctgctcgacagtgcttcggcgacggcgctcgattgtggtgaattgctggatagcccggggcgggcgaagatcctcgcggtgtggcatttgctggagattgccaggaccacagtggatcgctctatcgagtgtatgaaacccttgaagacaacaccttaaaatgtgggagggggcttgctcccgatggcggtgggtcagctgatatatccactgctgacactccctcatcgggggcaagccccctcccacactgtgcgtattccaatgcttggattaggcttcagcaggcgaagagtggaacgttccatcgagtgtatgaagcccttgaaagcaacaccttaaaatgttggagaggacctgtctgtcagccgaacccggggcattcaactggatagaacgggggttggcgagcggttcattgctgaaacgattaaagccctgtaggagattggctatatgtagccgatgctggcagtcgaccattcatctaaattaatatttttatctttaatatcatttacttagctgtctgtaaaaacaacccacctgccttcgttgccgtttttactcgccagaaacgtctaattactgacacgacttttatggcagcctttgtcccgcgtttccgctacatacgtaggataaatccctatggcttaataaaatctcgaacgccgagttacgttcaagcagtacggaccgtcccgcccaggcctagcgcgtcggttgacggttttcgacatcaaggacgagatggctatgagtctgacccgtaatattggcgacacacagggcccgcatttttttgccgaaatgggcgagttgatttcaagcagtggcaatgaacacttcgctgccaacatgctgcatctggtggacaagtgggtgccaatccatttggtaggcctcagcgaatggaccctggacgaactgcgcgactgcgtgctggacatcaagttgctgggcagcgccgggctgaacaaggatttgtctgtagcccagaccctgcgcccggtgagcgaccacccgttgctgcgccagatgctgcgcatgcaagacccgttgttgatccagatgaaagccaaggccgacagcgcacacccacggggcagttcgcaccagtgcaacctagtatcgcgccaaggcaatcgacgctgcgtgatttcgttctatcggcctgcgacccagcgtgggttttccctggcgcagttatcgttcctcaaatgcttgtcggacaccctgttgccgctgatggagcggcacgcgcagcttctgcgccaggcaccgcaggccgagaccgacccggcacataccctgctggagcaatcgcaatggcagcgcgaattctacaaacgcctgaccctcagcgatatcaccttgtcggcacgggagcaggaggtgtgccttggcctgttgaccggcggcaccgtgccgcagatcgcggaaaaactcagtgtcaaaaacagttccatcgagacctacctcaagcgtgccgccgccaagctcggcgtgagtggccggcacggcctggccaaatggatggtgggcgcctgatgaacaaactgacaccgcaacctgcgagtggcggccctgaatgtacaggcgttccaggcacagtaacgcatccagcgcgcagacctgttcccggcgatcaccccgactgccgcagccgatactcccccggcgtcatctgcgcataacgcaggaaaaaccgactgaaatacgccgggtccttgaaccccagctggtagcagatttcatttgccgaactaccggtaaacagcagcaggcgcttggcttcctgcatcagccgttcaagaatcaaacgcttggaaggtaagtcggcgatgcgtcggcatacctcattgagccgcgccggtgtcacgccgattccctcggcatagcgcgccaacggccaatgttccaggtaatgggcttcgaccagttcgttgaaacgatgaaaaatgcgcaagtcttcatgggccatcgggcgtgccggcaacgcgtgggcgcacaggcgcagcaggcggatcatgatcaggcgcgtcaaactgtcgagggcggcagcgcgccctgcccgttcggcgttgatctcgctgcacagcgcttcgaagagctgatccagcccttcggcggcatcgcccagcgcgacacaggccgcacctgaggcgaggcttgggtcggcgtcgatcaatccccacaccagttgctggcgcaccgtcaacacatgcccgtcggcatcggcttcggtaacgaaggcatgcgccaccgtgggcggcgtgagaaaaaacatcggccccgactcgacgtattgacggtcatccagataaacccgcacggcgccactcttgacgtaatgcacctggaaaaaccggtcatgccgatgcacggccatgttgcgcccgaaaaaccccgccaggttgccgagcttgtcgtaatgcacctcggcatcgctgtaacgctggtcgtagacctgcccgatgttgatattgggaatcggcttcacgcggccctcctcttgttgttctgatgccgttggagtttgccatgcttgacggtagttaacatattaattataacgttaacaacttaacgaactaccaacgcagccttcgtcaccgccaggagaaacgcatgagccgtaccctgcatgatgttgccagcggcaccctgttcggcgttgcgctgaactaccagggcctgctggagcaacatctcgccgccttcgagcaggcgccctaccagaagccgccgaccaagccggtgttgtttatcaagacccccaacacccgcaatgcccatggcggtgtggtgctgcagcctacgggcgagcgcctgcaaccgggcccggcattgggcgtggtgatcggccaacgcgccagccgcgtcagcctggacaatgccatggcccatgtcgccggatatgtggtggtcaacgagttcagcctgccggaagacagctactaccgccccgccgtcaaagccaaatgccgcgatgggttctgtgccctggggcctgaggtgattgcccgcgaccaagtgaccaaccccaatcaattggacctcaagctcttcgtcaacggccaactgcgccaggaaaattccaccgttcattgggtgcgagacatcgcgcaattgatcgccgagatcagcgagttcatgaccctgcaccctggtgacgtgctgatcaccggcacaccggaaggccgcgtcgatgtgcagcccggcgaccgggtcgaagttgaaatcaccggtgtgggccgtttgctcaacaccattgaggcagaggtattggcatgaagcgcgcacgtatccgctttgaagatcaaatccattccgtgcaggtcgacggcgactgcagcgtgcgcctcagcgatggccgccggctcgcgcaagagcaggtgcaatggctgccacccgccaccggcaacatgttcgccctgggcttgaactacgccgatcacgccgccgaactggccttcacaccgccgaccgaaccgctggcctttatcaagtcggtcggcacctacaccggccaccgccaagtcacctggcgcccggacaacgtcgcctacatgcactacgagtgcgaactggtggcggtgattggcaagaccgcgcgcaacgtcaagcgcgccgacgccctggactacctggccggctacacggtgtgcaacgactacgcgatccgcgactacctggaaaactactaccgtcccaacctgcaggttaaaaaccgcgacgccgccaccccagtcggtccgtggatcgtcgacgtggccgatgtgcccgacccgggcaacctgaaattgcgcacctggatcaacggtgagttacgccaggaaggcaacactaaagaaatgattttcgatattccctacctcatcgaatacctgtccagcttcatgaccctgcaacctggcgacatgatcgccaccggcacgcccgagggcctggccgatgtggtgccgggggatgaagtggtggtggaagtcgaaggcgtgggccgcctggtcaaccgtattgtcagtgagacggagtttttctccgtgcgcaaagaggcttgagcaacatgatcaaacattggatcgatggccgtgaggtcgagagcaaagacgtgttcgtcaactacaacccggccaccggcgaggccattggtgaagtggccagcggcggcgtcgaagaagtcgcccaagccgtggcggcggccaaggcggcgttccccaagtgggccaacaccccggccaaggagcgcgcacgcctgatgcgcaagctgggtgaactgatcgaacagaacgtaccacgcctggccgagctggagacgctcgacaccggcctgccgatccaccagaccaaaaacgtgttgatcccacgcgcgtcgcacaacttcgatttcttcgctgaagtctgcacgcgcatggacggccacagctacccggtggacgaccagatgctcaactacaccctgtaccagccggtgggcgtgtgcgcgttggtgtcgccatggaacgtgccgttcatgaccgccacctggaagaccgcaccgtgcctggccctgggtaacacggcggtgttgaagatgtcggagctgtcgcccctgactgccaatgaactgggacgcctggcagtggaagccgggatccccaatggtgtgctcaatgtgatccagggctacggcgccaccgctggtgatgcactggtacgccacccggatgtgcgggcgatttcctttaccggcggcaccgccaccggcaggaaaatcatgcagaccgccggccttaaaaagtactccatggaactgggcggcaaatcaccggtgctgatttttgaagacgccgaccttgagcgtgccctcgacgccgcgctgttcacgatcttttccctgaacggcgagcgttgcaccgccggcagccggatctttatccaggaaagcgtctacccgcagtttgtcgccgagttcgccgcgcgggccaagcgcttgattgtgggcgacccccaggaccccaagacccaggtcggctcgatgatcacccaggcccattacgacaaggtcaccggctatatcaagatcggcctggaggaaggcgctacgctgctggccggcgggctggagcggccggccaacttgcctgcgcacttgagcctcgggcagtttatccagccgacggtgttcgccgatgtgaataacaagatgcgcatcgcccaggaagaaatcttcggcccggtggtgtgcctgatcccgttcaaggacgaagccgaggcgctgcaattggccaacgacaccgaatacggcctggcctcctatatctggacccaggacatcggcaaggcccatcgactggcccgcggcattgaagcaggcatggtatttatcaacagccagaacgtgcgcgacttgcgccagccgttcggcggagtgaagggctccggcaccggccgtgagggtggccagtacagctttgaagtatttgccgagatcaagaacgtgtgcatttccatgggcagtcatcacattccgcgctggggcatctgaagcacgcattacctgtaggagcgagcttgctcgcgaagcacccacaggcaccgctggctacctgaagcactgcgttatcgttgacctttttcgcgagcaagctcgctcctacaagaataaatattcaggagaatcatcatgggcgaagtggttctggcagcgaagatctgccacgtaccgtcgatgtacctgtcggaactgcccggcaagcatcacggctgtcgcgaagcggcgattgccgggcacaaggaaatcgggcgccgcgcccgcgaactgggggccgacaccgccgtggtgttcgacgtgcactggctggtcaacagcggttatcacatcaactgtggcgaacggttccaaggcacctacaccagcaacgagctgccgcacttcatcaagaacatggactacgcctacccgggctgccccgagctgggtgagctgatcgccgccgaagccaacctggccggcgtgcgcagcatggcccacaacatcccgagcctggagctggaatacggcaccttggtgcccatgcgctacatgcacatgggcgtgcccgaggatgaaaaactcaaggtcatttccatcgctgcctggtgtgcctggcatcgcctggaagacagcttcgccttcggcgccgccgtacgccgcgccatcgaaaagagcgagcgcaaggtgctggtgctggcgtccgggtcgctgtcccatcgtttttccgacgaccgccaggccgaagcgaatatccataactggacccgcgaattcgacaagcaggtggacctgcacgtggtcgagatgtggcagcaaggccgcttcaaggagttctgcgccatgctgccggactacgccgaacactgctttggcgaaggcaagatgcacgacaccgccatgctcctgggcctgctgggtgggccggactatgcccagccggccgagatcatcacgccggcgtttggcagttcgggcaccggccagatcaatgcgattttcccgctgtagaccagggagaacaccatgccgcactttattgccgaatacaccgacaacctcgagcaacaggccgacctgcccggcctgtttgaaaaagtccaccgcgtgctgggagacagcggcgtgttccccctcggcggtatccgcagccgcggcgtgcgcctggatacctggcgcatggccgacggcaagcacgactatgccttcgtgcacatgaccctcaaggtcggccacggccgcgacctggccacgcgccaggcggtggccgaagccttattcggggtgatcaccgcgcacttcgccgagctgcaggcgcaacggttattggcgctgtcgttcgagatggtcgaactgcacccacagctcaacttcaagcagaacaatgtgcatgcgtttctgaacaacgcggcgaactgaaaagggccccgcccccctgtaggagcgagcttgctcgcgagaaacctccaggcaccgcggatccagcagcgctgcgttttcgttgacgtttttcgcgagcaagctcgctcctacaacaaaaagtacaacatcatgagcacagcccactccactgcaagcctgcggcttgccgagcatgaccgcacccatcgtttggtgacctggcgcctgatgcccttgttgctggtgtgttacttgttcgcccatctggaccgcatcaacatcggcttcgccaagatgcagatgagccacgacctgcagttcagcgacacggtgtacggcttcggcgccgggctgttttttatcgcctacgcgctgttcggcgtgcccagcaacatggccctggaccgcgtcggaccacggcgctggatcgcctgcctgatggtggtgtggggcctgctctccaccggcatgctgtgggtggagagcgcccgcggtttctacctgctgcgctttttactgggggtggccgaagccggttttttcccgggcatcctggtgttcctcaaccgctggtacccggcgcgtcggcgtgcccaggtcaccgccttgtttgccattgccgtgcccatggccggggtgctgggcgggccgatttccggggcgatcctggagaacttccacgacgtcggcagcctgcgcggctggcagtggatgttcctgatcgaaggtgcgcccgtggtgctgctggggctggtggtgctcaagtatctgccggacagtttcgagtcggtaggctggttgagcaccgagcaaaaacagcaactgcgcacccagttgagcaacgaggaacaacgcaagaccatcacctcgttcagcggcatcctgcgggacccgcaagtgtggctgctggtggccgtctactttgcggtgatgctggcggtcaacaccctggcgttctggatgccgaccctgatccacggcgccggcatcggccgcgacagtcaggtcggcttgctcagcgccgtgccctacctggccggctgcttcttcatgctcggctgcgggcgctcctccgaccgtcaccgcgaacgccgctggcacctgtgcgtgccgctgctgatggccgcagccggcatcgccgtggcgggcctggcgcctggcaacgcgctgctggtgatgagcgggttggtggttgccggcatgggcgccagcgcggcgctgccgatgttctggcaactgccgccggcgtttctttccaacaccacccaggcggcgggcatcgccatgatcagctcgttcggcagcattgccgcgttcctggcgccctacctgatcggctggatgcgcgacgccacccagagcgccagcctagccctgtacatactcgccctgtttatcgccctcggtggcctgctggtgctgcgcactcaggccgccatcgtcaacccccactagagaccgttgccatgctcgactcccagcaaatcctcgcggccgccgcgcacctggaccgcgccgaacgcagccgcgaacaggtgcgccagttttccctcgactaccccggcatcaccatcgaggatgcctacgccatccaacgcgcctgggtggcacaaaaaatcaacgatggacgcacgctcaagggccacaagatcggcctcacttcacgggccatgcaggtctcttcaaacatcaccgagcccgattacggcgccctgctcgatgacatgtttttcgacgaaggcagtgatattcccttcgaacgcttcatcgtgccgcgtgtggaagtggaactggcgttcatccttggcaagccgctcaagggccccaactgcacggtgttcgatgtgctcgatgcgaccgaatgggtgatccccgcgctggagatcatcgacgcacgcatccagcaggtcgacccacagaccaacgccacccgcaaggtgttcgacaccatctccgacaacgccgccaatgccggcgtggtactcggtggaagggctgtgcggccgaccgagatcgacctgcgcaaagtgccggcggtgctgtatcgcaatggcgtgatcgaagagtccggcgtctcggcggcagtgctcaaccacccggccaagggcgtggcctggctggccaacaagctggcggcgcatgacgtcaccctgctgcccggccaagtgattctaggcggttcgtttacccgcccggtggcggcccgccctggggataccttccacgtcgactacgacctgctcggctcgatcgcctgtcgcttcgtctgaacactggaggattgtcatggacatgcctgtcaaccgcttcaaacaacgccttcaccagggcgaggtgcagatcggcctgtggctcggcctcgccaatgcctatagcgcggagctggccgccaacgccggtttcgactggctgctgatcgatggcgaacacgcgcccaaccacctgccggggatgcttgcgcaattgcaggccatcgcgccctaccccagccaggcgctgattcgcccggtggtcggcgacacggcattgatcaagcaactgctggatatcggcgcgcagacgctgctggtgcccatggtcgaaagcgctgcccaggcccaagaactggtgcgcgccctgcgctacccaccccagggtactcgcggcgtcggcagtgcactggcccgtgcttcgcgctggaacggcatcaccgactacctcgaccaggccgacgcgcagatgtgcctgctggtgcagattgaaaatcgcgagggcctggccaatctggacgctatcaccgccgtcgaaggcgtgaacggtgtgttcatcggcccggcggacttgagtgcggccatggggcatcgcggtaacccagggcaccctgaagtgcaggcggcgatagaggacgccatcgtgcgcattgttcgagcgggcaaggcggcagggattctcagtgcggatgaacgcctggcgcggcgctatatcgagctgggggcgacgttcgtggcggtaggagtggataccacggtgttgatgcgcgggttgcaaagcctggccgggaagttcaaagacattccagcggccgtgcacacaggcggagtctactgagccccctcccacatgttgacctgttttgatcaggagattgattcagcgcttgatgttcttcaagtcatccagcaaccccagcaaggtctggaatttctcttcgccaagctgatcctgcaagcgctggtagttggcctccatgcactggctcatggactcgaaactcgccttgcccttgtccgccaaagtaatgagcacccggcgctggtcctgttcggccttgcgtcggtgcaccatgccggcggcttccatgcgcaccagcacgccggtcatgctcggctttaggatgcacgccagttccgccagttggtaaatctccagctcaccgtgctgttcgaggatgcggatgatgcgccattgctgttcggtcaggccgtgttcattcagggacgggcggaaaaaactcatcgcggcctcacgcgcttgcagcaaggccagggtcagggattgtcgaggtttggacataggatcagggtcacgaagtatttagttaataatttaacgaaactctaacattccccgccagcgagcgcgctataacttgtgtatgccctcgcccgtggcgcgctgaatcaaaaacccgggcacgcaggatcaagacttccagcccgtcaggggccctaatggaggcatccgcttcagcgccttccttcactttttcaggctgcgccatgatcaatatcgaaacccccacctattacaccgccaccaagaaatacaaccttagtttccccacactggagcaagacatcgacgcggacgtcgtggtgatcggtggcggcttttccggaatcaataccgcccttgaactggcggaaaaaggcatcaccaatatcgtggtgcttgaagcgcgctacctgggctttggtggcaccggccgcaacggcgggcagatcatggcgggcatcggccatgacctcgagaagatcaagaaggacgtgggcgaagacggcctgcgccaggtgttcgagatcagcgacctgggcgccgatatcatcaagaaccgcatcgccaaatacaacatcgatgccgatttctgccacggctacggctatatgggcttcaacgcccgccaggaaaaaactctgcgcgcctgggagaaggacttcaagtcggtcaacagtcagcatgaaatccgctttctcggcggctcggatgtgcagcagatcatcggttccaacgcctacaccagtgcgctgctgcacatgggcggcgggcatgtgcattcgctgaacctgctgctgggcgaggccaccgcgctggccggccatggggtaaagatctttgagaacagcccggccctggaggtcagctacggcgaacgcatcaccgtgcgcaccgggcgcggttcggtacgcgccggcaagttgctgtgggcctgtgacagctttctcaacaagctcgaaccggaactgcaccgctcgaccatcaacacctacgccttccagatgatgaccgagccgttgtccgaagaattgatccagcgcatcagcccgatccgtggcgcctacagcgatatccgcccggtgatcgactactaccgcgtaaccaatgaaaaccgcctgctgttcggcgccgcgacgcctttggtcgagcatattcccggcgacctgaaagcctggaaccgccacctgatgctgaagattttcccctacctcaaggacgtgaaaatcgacctggcctggggcggcccgatggcgtgcagcccgaatctgttcccgcagatcggcaccttgccggggcgcagcaatgcgtttttcgtgcagggctattcaggctttggcgtcacgcccagccacatcatctgcaaggtcctggccgaaggcatgagcgaaggctcggcgcgctatgacctggtcagctcgatccgccgcccgaccattatcggcaaggacgcaattcgccccttgctgctgacggcgggtaaatcctggcaccaattgtccggctactggaacgggcgtcgctaacccctgtaggagcgggcttgcccgcgaagaacgtcaacgataatgcgggcactcaggttaatcgcggtgtcatgacgtttttcgcgagcaagctcgctcctacaaaaaataatgttgtatttatcaggagcaattgccatgacccttactgctatcaaacataacgtccagctgtcggaactcgatgcctggggcaccgtggccgacctcggctcgcagatccttgaaggtgaggtgcgcgccttcggcaagatgaccttcggcgcccccaccgatgcggtcagcagcgcctacttcggcaccacccagggcaagttccgcatggtctaccccttcgccgaacaagctaccgtggtcaccggcgaggtggtactcaccgatgagtccaccggccagtccacccgctacaaggccggtgacagctggtttgtgaccaagggcacgccggtgctgtgggaagtggtcagcgagagtttcgtcaaacactacttcgccgttgtttaaggagccttgccatgagcacttcttctgactggatcaccgtgggcgccctggccgacggttttgcacccgaagcgttcatcctgccgaacctcgccgacctagctggccagaccttcactctgcactttgccaatggctggcagatcgagcatcgcttcgaacaggagcgcctggcctggcgcgccgccgacggacactccagcggtagtgcagcctaccgcgccagctcgattcgcccgggcctgtacctggtggacttcatcaagcatgaggccgggcaaagctggtcgatcagcctggtgctggacacgccaactgcctcctttaccgcggtgattggccgtatgccggagccggcagagacccacgaaggtctttaccaccgcgccctggccggcaaaccgctgacctcggtgcacgccgagttcctccacggcagcctcgaccggccgtggcaagagggccattgcctgcacacccccaccgaggaactggtgggcctgcgcaaccactaccgctacagccccagcgaggtctacgagcacatctacctcaacccgcagttctacgcctggcaatgccttgagggtgtggagaaaggcttgtgcgacaccgaccgctgccattactacaagatcgccgagcagctgtacctgttcgtctggcaggagaagatcgtgcccaccctcggcctggtgctgatcgacctgcaacaacaccgcagcgacggcaagatcttcggctatgcgggggcatccttcgacgcgctgtcgaacttcccgatcagttcctattgccaggtgctcaaccgcacggagtacccccgtgactgaggcgcgcacggtagtgatcaccggggccggcaccggcatcggcgccgcctgtgccctgctgtacgcgcaggaaggcgcacggctggtactgatcggccggcgccgcgagccactggaacaggtggcgcaggccagcggcggcctgatcctggtgggcgatgccgcctgccccgacacctgggatggttttatccgagagattcacgcccactgcgggcgtatcgacgtgctgctggcgtgtgccggcggtcatggcctgggcagcgcgacccagaccagcccgtctacgtgggaagcggcgctgcgcagtaacctggacagcgcgttctacagtgcccgcgcctgcctgccgctgttgcgggaaagcgccggcagtatcgtgctgatcggctccattgcctccctcgcagcagggcccgaggtgtgcggctacaccacggccaaacatgcgttgctcgggcttaatcgctcgctggcacgggactacggcccccacggcgtgcgcgtgaacgcggtgtgcccgggctgggtgcacacgccgatggccgatgccgagatgcagccgttgatggaggcgtacggcgacaccttgcagcaggcgtacgagcgcgtgtgtgccgatgtacccctgcgccgtgccgcccgggccgaagagatcgccaaggtatgccgcttcctggccggcgacgacgcatcgatcattaccggggccacgttggtggcggacggtgggtccagcatcgtcgacgtgccgacgctggcgtttacgcgcctggagccggcccatgcccaatgatctggatttcagcgaccaagtcgtgctggtcaccggcggcgcccaggggattggcctgggcatcgtcgaagcctttacccaacgcggtgcgcgggtggtgattgctgatcgcctgcttgaacaagctgaaagggtggccgctgggttgtgcgcgcagggctatcaggtcgaggccgtgggcgttgacctggcgcaagccgaggcggtgttcgcctgcgttcaagggttggcgcaactggatattctggtgcacaacgctggctatttcccgctgaccgcgttcgctgacatcaccccgcagatcctgcaacgcaccttggcggtgaacctctcggcgctgttctggctgacccaggcggcgttaccgatgtttcgtgagcaaggccggggttgcgtgctggtgacgtcttcggtcaccggcaatcgggtgggttatccgggactgagccactatgcggcgtcaaaggcgggggtgaatgggtttatccgcaacgcggcgttggagttggcgccgttgaatgtgcgggtcaatggcgtggaaccgggcatgatcgccacgccggcgatgagcaacctgggcgataccgcgttgaacgacagcatcgccaaccgcgtgccactggggcgtttgggcgcggctgcggatattgccggcgcgatgttgtttctggcttctgacctggctggctatatcaccgggcagaccttggtggtagacggtggctccaccctgcccgaaatctgaatcttaactcggtccaatgtgggagggggcttgctcccgatagcgctgtttcagctacacatgtgctggctgacacactgctatcgggagcaagccccctcccacattggatctcatgcacattgaagaagctgtttatgcccccaccgcctgcaaccggctggagcgaaaatccttgggcgacacttcgaactgtttcttgaatgatcggctgaaatgcgccgagtcggtaaagccccatttgtaggcaatcgaggtgatcgattcactgcgcaggaacgggttggtcaagtcgtccgcactgcgcttgagccgcgcccgctggatatagcggcagacgctgtcgtcctgctcctcgaacaaacggtagaggtgccgcaccgagatattcaggcggttggccaggccaatcgggctcaggccaggttggcccagtgactcgtcaatgactttttgcacatagctgcgcaggttattgccctgcaacgaggccacaccttcgtggcactcatcgccctgctccagcgccgaccccaacagtgagacgaaggccgcttgcagtgcttccacttccgtggcgttgtcttcggtatcgtccttgcacaattgatccatcagcacatgcaacatgcgcccacaggccttggtcgatgaaatcttgccaaaggcccgcccctggccgcgcaggtgcttgcacacctcagtgcgcgagagggacaacgaggcgtgttcgatcaagccgaagggagtgatttcgatagagcctaccgagtccatcagcagcatctcgccaggggccagttgcacggtctggtcgttctgggtgatctgcgcatagccgctgcgctggctgaccaggaaacattcctggtcgttgtcgtggtcggcatggtgcgtgaggcgcttgatcagcccggcattggtgcgcaggatggccaggccacggggcaggttgtgaatctcgccgataaacagcgaacggttgaaggccagttcggtgtcgaagtggccgcacgcggcgcgcagttcgcggttccagctgtcgagcccgtcgggtgcatgctgtgggatgctcatggggtgtctccgcagtggcgttctttttgttgttctggtgcaatagttaacatgttatctatatgcgcgcaacaacaactcgtttggcctttgcagaagcactaatgatgccaatcagagattcgacagtacccgcttcatgccagccaacgccgccagtaaatggttgcgttgctccgggcttacagcgatataacgccgaaacgccggcatgcggttgaccacttcgctgccgcccatatgctccaggcgcacgcaccattgctggtccttgaggtcgatacgcagacgcttgaaatccaggggcatcagcgcttcgaataaccctttgtccgccagcaaacgcgcctgcaactcaggccccagggcctggttgccagaacgttggcgcacgcggatgccgttgcgccgaatagccccgccatggtgcacctccaagctgcccgcccctggggtaggcgtgggtacgtgcaacacgaactccgtcatgaccagatgcatcaacaactgcgattcggtgcgctcgaccagctcaaataccgccccgcccacgtcgagtttcgccaggccaagatcacgccgcaagcgcgccagggtcaccccgggtcgatagccgctcggtgcgcgatcagcgctgaacagttcaaacagtttttgccgcaaagtcgctataaggctcatgggcatgtcccggttcatgactgaattccttggccaacacctcctcgacgcaggctggcttgaaggggttgaccttctgcaccaccagggtccagaacaacgcataggtggcggtcacgccgagcatcaccccaaacggcacataaatgtcggccgggttcatgccgggcggggtgataaaccacatgcccagcaggatgccgatgctcgacacgacctgcggcagcgggaaccacggcgatcggtacgcccggggcaaatccggacggcgaatgcgcaggatcaccaccgacagcgtcaccagcaggtaggcaaaactccacgcgcacaccgccgccagcaccagatgcatgatgttgtcggtgttgccgcccaggtacagcgcatgcaggcacgggatcagcatggccaccaggatgcacaacagcggtgtcttgaagcgcgggtgcaggtaggtgaacaccttcggtaacgcgccatccaccgccatgccatagaggatgcgcggtacgccagccatcagggtattgatggttgcagcgccggcgaacaggaagccaatgcccagccacaacgggccgatctgccccatcacctgttcagcgaaccgtgggatagccatgggtgtgtccaacaggtgcacgccggaggcggcgtcgagcaccacgttttccacctggcgcttcatcgcggcgccatagataaacatgcacgtcgccacgcccatcagcccgagcatcatcgcccgtggcatcaccttggccgattggcgcaggtccggcgccagcggggtgacgaactcgcagccgacgaacatgaacatcgccatgcccaccagcgacaacacggtgaccagatcagtgcccaccagcgattccccgaaccagccgtccagttgcaccgctggcgcggcgatcaagcccagcacgccgaacaccatcagggtggtccacatgccgaacgtaaggatgatctctgcgcggccaaaggcgctgaccccgaaggcgttcagcaccccgaacaccagcacgaaccccacgcccagcaaccacgagccgccggccgattctgccagggtattgaggtgttcgaagttcaccagcgccatgaccccggcgaggatggtttcggcggtgccggcgaacacatgcacgatcagatacgccgacagggtgccggtgatcgcgaagaaccggcccatgccgcaattgatgtagtcgtacaccgaaccggtggtgggcagcatcgatgcggcctcggcgaaggtggtcgcctgggccagcatcatcaccacggcgatcagcattgccagggcaaacgcactgccgccgatgccgaagcccatggtggcggtaagaatcaccgggctggccatgatcaggccaatggtgctggccaacgcggtggggaaacctaccgtgcctcggttgaggtgcgcggtgagtcggtcgttgatcgacatggtggggtcctcgaaagcggtttttttagtgtgtcggcactctgcgccccacccgcgttgatcgtcttgcccctgtctgccgctggttttgtagctgcctgccacggcgtagcacctggcggccagggtcaattccctggcacgcatggcaaagacttggcttgacgcccctcgccctaatgcgccctcactcttaaccaagatggggacaataacaatggagcacacactgaaaaaccgccgtctacgccgagcggtcgtcataggcgtcgcgctgttggccgggcaagctcatgccgtcgagttgtacgccgatgccgacacccaggtcacgggaaacttcctcgctgtgtatgggatgttcaacagtccgaaaaattacgacggccgccgcggcggctccacctggcgcgaggcgtttatcaagtacggcctgagcgtcgagcaaaacctgggtagcctgggcggcgtgtatggcacggctaacctggtgagttccggtacctggggggatggcgatgcgtccggggtcaccaatggcaccgagcgcaccaccaagtttgacgaagccttcgccggctggcgctccggcgagctgttcccggcactgggcaaagatggtgtagacctgtcgttcggccgccagatcatcatgctgggcgacggttttatcatcaacgacgacggccccaacctcggcaatggcgtgggcgatggggagttcaatcgcggcggcgcctactacatcgctgcgcgccatgccttcgacaaaaccgcggtcattcgcctgggcggcaaggatggcgtgcatggcagcctgatgtggatcaagtccgacaaccgcgcccaagccagaaccgaaatggctgcgggcaccctggaatacagcgccgccccgggcaccctggggctcacctatatacacgggatcgacgtggatgagcgtttcgctaccgacctgcaacgccagcgcaaaggcatgaacctctacagcctgcgcggtgccggcagtgccggcatcgacaacgcccacttcgccttcgaactggcccgccaggaccgacgcgacagccagcagaacgctgggtacgccgaagccggctacaccttcgccgacctgccctggtcgccggacctgacctaccgctacgcccgttattcaaaaaactgggacggcatgttcgcaggcttcaaccgcggctatggcacctgggtacagggcgaagtggcgggcaactattccggcccctacaacagcaacacagcggtgcaacacgtggcgctcaaggtcaagccgctggagaacctcaccctcggcgcattgttcttcgactacaacaccgtcagcactcgcggccagttgaacctcgatggccgcgaactggacctgtacgccgaatgggcggtgaacgagcacctgatcatcacgccgttgctgggcctgtacaaacccgacaaagatgccgacaccggcggtaaccaagtcggcggcagcggtaccaatgtctacagtcagctggtggtggccgtaccgttctgaaccgtctcgggcgcgcacggaggcagcgcccgcacctcggcataggcgccttgatgatagagcagcggcgcacggccaaagtcgtcgaaggccaccaccttgccgatcatgatccagtggtcgccgccatcgatctgctggtatttctcgcagtgaaagcgcgccgagcaatcggcgaacactggcgagccgccctcccccggctcgtattcgatcagggcgaagcgatcttcacgggggcgcgcaaagttgttggacaggtgcacctggtcggccgccaacacattcacggcaaagtggctggcctcctcgaacacctcatggctattggagcgtttgtcgatgctccacagcaccagcggcgggtcgagggacaccgagttgaaactgttggcggtcacgcccaccttgcgcccggaagcggtggcggcggtgaccacggtcacgccggtggcgaagttgcccagggcgcggcgaaaggcacgtgggtcgaaaatgtcagacatgcaagactcccgggtggcgtctattggccgccctgatggttatggaggaatacgcgactacaccatgctcgggtcgggctccaggcccatcagctcacggccgaggatctgcgcgcagacgtcgtagtcggtgtaggcatgggcgccggtcatatgggaatcgcggaacaggcgctgcatctcgttatgttcgaaccaggcattgccacccgcggcggcgaacaggcgatccaccgcttcgatgcacattttggtggcataggcctgattggtgcgccagaacgccagggtctggcgcgtcgggtaacgttgggcggcgctgtgctcggcgtgttcctgccaggtcttctccaggaacgcccgggcggcggccacctgatgggtggactcggccaggcgcatcaacgccggggtggcggcgcccacagcggcaccggtgtaggcgcgcacccgggtcttggttttttcgcggaacacgtcgagcatgcgctcggccacaccaaggctgacggtggaaaagccactggcgaaatacggtcgataaggcgcgtagaaaatccggctgtccgggtagaggccaaagcctgcggacttgccctccatcatgtccttggccttctggatacggtgctcgggcacccaggcgttgtcgataatcaaggttttggtgccgctgcctttcatgccggcagcgaaccagtcgtcgcgaatctgatagtcactgcgcggcagcacggcaaagcagtaatcctgggtgccttcggcattctggcggcggcagccgacaattgcccactcaccatggtcgcagccgctgctccagcccatctcgccgctgaagtacacgccgccttcgccctcggtgacccgaccaaacggcgcaatactgctgctggccgtggcatccgggttggcaccccagatttcctcctgcaaccgagccgagaacagcgccaactgatggctatgggtgcacaacaaactcatggcccaggcggtgctggcacaactgccggcaagcaaggcgatgcagtcggcgaattcgggcaatgacagctcgagtccgccgtacgccttgggctgaaaggcgcggtgcaggccgatgcttttgagcaaggcgatattctcatccggcacttggcgcagctgttcggcgcggctggcattggcggcgatggccggcaggaggggcttgaggtcttcgaggagcgggtttggctttttcatggacagccctgcttattattggaagtccggcaggcgctccagatcgcggaacggcgcgggatgcagggccagtatcaaacggctcacgcaggcggagaatgcacattcggcaggcaaacttgtacttttcacaggtgcggcaggcacaggcataaaacctggcaggcacagtcaagccgcttatcggtgcgttggttaccctcgggttttctttatgaactgccaggaacctgccatgagcgatatcccgctgctgccccaagtcgaagcctttctgcgtcgccgccatggggtgtttatcgacggtgtcaacgtgcgcagccacgccactgaaagcctgagcgtgaccaaccccgccaacggccaggtgatcgccgaagtcgccgatgctgacctggccgatatcgacgcagcggtcgcgtccgccaaccgcggtttccaactgtggtcccaggccgcccccgccacccgtggcaacgtgctgctgaaactggccgacctgctggaacagcaccgtgaagaactggcgcagatcgaaacctgccagtcgggcaagatcatccagatttcccgcgctttcgaggtcgaccaggccgcgcacttcctgcgctactacgctggctgggccaccaagctcagcggccagacgctgactccatcgctgccgtcattcaatggcgagcgctacaccgcctttaccctgcgcgagccggtgggcgtggtggttggcatcgtgccgtggaatttctcgaccatgatcgccatctggaaactcgcctcggcgctggtgaccggctgcagcatcatcatcaagcccagcgaattcacgccgctgaccctgctgcgcatcgctgaactggccatcgacgccgggctgccggcgggtgtgttgaatgtgctgaccggcggcggccatgtcggcaaggggctggtggaacaccccggcacgcacaaggtttcattcaccggctcagtgcccaccggcatcgccgtcggccgcagcgccatgggcgccggcctcacccgtgcgaccctggaactgggcggcaagaatgccgccggcttcctacccgatatggacgtggacaaggcagtggacggcatcatcgaagcgggcttcttgcactcggggcaaatctgcgcggcggccgaacgctttttcgtgcaccgctcgcaaatcgacgccgtgctggaaaaactcaagacgcgcctgagccgcctgaatatcggctcgcccctggacgaacacaccgaattcggcccagtcacacaccagcagcaccagcacaaactgctcggctacttcaaccaggcccgcgccgaaaacaacacgatcatccacggcggccaccttatcgaccggcctggttgctacgtcgaacccacggtgatcctcgccaaccacctgcacgacaccctgctcaacgaagaaaccttcggccccatcgccaccttcctgccctacgatgacgaagacgaactgctggcgctgatgaaccacgggccctatgggctgagcgccagcctgtggaccaacgatttgcgcaaggccctgcgcatgatcccggccatcaatgcgggcaccttgtgggtaaacatgcacaccttgctcgacccggcagtgccgtttggcggcagccggtcttcgggggttgggcgggagtttggcagtgcgtttattgaggattacaccgagcttaagtcggtgatgattcggtattgaatcgggtagcgcagtgcgagggggcttgccccaatctctgtaggagcgagcttgctcgcgaaaaacgtcaacgataatgcgtgtgtcctgaataaaagcggcgcctatggttttttcgcgagcaagctcgctcctacaaaagccttactgactggcattggggcttgctaccgatggcgttgggtcagtcaccgatgtgttgactggcaccacctcatcgcgagcaagcctcctcccacatttgggtcgcattgcgtcagtgagatagctgtcgttttcagcgcccagcgcctgcgcctccatctcgatcaaccttgcggcaacgaccacccgctgacgttgatccaaagagtgagttcatcagaccgctcttacacaaacttcgggttgcgcccgatgagtctcgtcgctaaccttcgcgggtcgctgcaaaatcagcgaatgggtgtggtagcccagttctttcatagaccccaaaacgctcaagggcgtttttttgtgcgggctgctttgtggcggctgtgcatgggaggcttctgcctgccgggtttctatgaccggtctaccaccccgtgtacagtcgcctccttacttcgtgtggtagcgaaatggaggtgctcattcataggagcttcgccatgaagaaagtcacacccaatcccccgccatccccctcggatgacaacccacaactacctcccgatgtcattttcaccgtccgccccggactcagcactgaagccgccttgagcaatgccagcgaaatgctggagtcagcgactgtctgtgcctacgactgtgccgaacagcttgacggccagagccgcaagcatgtgctggcggtggtgcagatgattgagattgcgcagttgctggtcgatgaagcgctgaaccgggaatgcccggcggcctgatgaacaaacgcaaacccaacaggcaatgacgttctctgtgggagggggcttgctcccgatggctttgggtcagtcacagatgtgctgactggcaccacctcatcgggagcaagtcgaatcgtcgcaccgcccctcccacatttgatctcactgcatcagtgaggtagctgtgccagggagagcgtgccaggctaccaggtgcccattgccaggctgtgcggtgaaaactctgcgaactgccaccgcaatgccaatgctgccggacggcggaccacgtgctccaccgtcaccgtccacaagcgctgcgcgccctcgaactcggccactggcggcccgctgagaatcaatgatgtacgccccgccacgtgcagcacgtcgccggtttcaaaatcgacaaacagcaaccccgctaccgggttggcgtgcaggttaccgagggtgttgaagaacaggttgccggcaaaatcagggatggtcagcacgttgccttctacccgcacaaaccccgtgttgccgccgcgatgggaaacgtccaccgagcgttcgccgtgctggtccacgtagctggcgacgaagaaggtgtcagcgttgcggatcagcgtttgggcggcggcgtccaggctggtgctgcgctccgctgtatcgccaggtttgcgcgcaatcccagcgacaggccgcagttggatgtacttggggcagttgccgaaggtgtgcaccacgttcaccgcaaagccgtcatgatccagcgctccgatccgaccgttcatgcggttgcgacgccgggtgccgaggtcgatgcccagcaggccaacggacgcgccacgagtgatgccagcccaggccgggtcgcttctggcgggcaggctgtcgacttgcagcgcctgtggatccggtgaatgggcaaaccctggcgcgccctccagcatggtcgcccaggggataccctgttcgtccaccacacccagaatgaggtaaggcaacaacggataaaaatcacgatgctgctcgggcaaataatcacgaatgaccttcggcccgatcatggccatgcgttcggcgacgcctgcactttcctgcaattgccgttcgccgacatgccaaggggattgttcgatcgagttcatggcgatcacctctggttggataaccgaatgctgcgcctacccaaccctgcagagaatgcccaccctgggcaatccactattacgccaactgaaatgccggatgttcgcgcaacgcggtgacgcagtagtcgacaaaactgcgcacgcgcatcggcgcatggcggccttcgcggtagatcacatgcaccggcagcggcggcatttcaaaggccggcaagacacgacgcagttggccatttatgaggtgatcatgaaccggataactgaggcaacgaatcacccccgcgccctgcaccgccgcattgatcgcgccttgcaccgtggcgcaactgaggcgggcgcgggcgttgagggtgtaatgcaggaaatcccatcgcagcgcttcggcgctggcaatcagatgatgttgcttgaggtcggccggatgccggggctcgcctttggccgccaaatacgtggggctggcgcacagcagggtgcgcacctggccgacctgccgtgcaatcagcgacgagttgggcagctcacccacccacaccgccacgtcaaacccctcttcgtgcaggttggggtaatagtcgtggtagctagcgatgacacgcaccgccggatagtgatccatatagccagccagcagtggcgccatcacatagcggctgaacagcaacggcaggcatatccgcaggttgccctgggcgtgcacatgggcgccgttggccgaggcttcggccgcgtccaccgctgccagcaggcgtacacagtcggcaagataagcctggcctgcatcggtgaggttgaccccacgtgtgctgcgctgcagcaacaccacccgcaggcgtgcctccaggcgcgcaaccgcacgtaccagggtcgggccggagacctgggcacggcgtgccgccgaggccaggctgggttgcccggccagcgccgcaaacagctgcatatcgcgaaagcgctccatcaggcgcgccgcttcgtcgccgggttcagggccgggtcctgcccgaggcgatggcttaagaagtccacaaaggtgttgatcttggccggtacgcgaccattgtgctggaacaccacctgaatcggcagcggcgccggttcgaaagcctccagcaccagctccagctcacccgccgccaccgctgccgccacctgataggacagcacccgcgtcatgccccagcccagccgcgccaggttgatcgcggcattattggccgtgacgatcaggcgtggctcaatgggtaccttgagtggccgcccggcgtcgacgaacgtccattcactgaccagttggctggacgatgaggagacgatcctggcttctcgcaattgctcaggccgctgcgggcgcccatgttggtccagataagccggcgatgcgcacaccacccggcgcacttcgccgaccttgatcgcctgctgcccgggttcgtgcagatggccgatacgcaccgctacatcgacgccttcatcggccatattgaccacacggtcgaccagcaaggcactgatgttcaccagggggaactggtccaggtactcccccagcacaggcgccacatacagctcgccaaacagcaccggtgcggtcactgtcaggtgaccgccggggatggagtaactgcccgctgccgcctcctcggcctcttccaattcggcgaggatgcgccggcaatcttccaggtaacgctggccggtttcggtcaggtgcaggctgcgtgtggtgcgtgccagcagttgcgtaccgatgcgctgttccatagcggcaatggcgcgggtcacgctgggtggcgaggtcttcaggcggcgcgcagcagccgcaaaaccctcctcctcggccaccgccaggaatacctgcatctcatgaaatcggtccatcgccatcccttgatcgttactgtgattgcagccccaccgccgtgcgcggcatagcgacaaaccctggcaaggcttcgatgctggcaagccaggcacgcacctcagggtagtcggccagcgacacgttgccttccggcgcatgggccacgtaggtatagaacgcaatatcggcaatgcttggctgatcaccagccagaaaacggctctcgcccagctcctgctccatcacgttcagcagggcataggctcggttgattgcgctgacagtgtccacctcggcgccaaacactgtggccaagcgcgccgtggcgggccccgcatggagttgaccggcggcggccgacagccagcgttggacccgcgcttgcccgatgggctcgcttggcaaccactgccctttgccataggtactggcaaggtaaaccagaatcgcattggagtcggccaagacagtaccgccgtcatcgatcaccggtacctggccgaagcggttgagattagcaatgaattcgggcgttttatgcgcaccttgcttgaggtccaccaggataaattcattgggcaagcccagcagggacaacatcagctcgacccgatgggagtggccggacaatggaaaaccataaagtttgatcgcaggctgggtcatgaaaggctccaaaagaatgggtatcgacgccaggcatattccactgccgcctcagtcggcggaatgaccaggatttacaatccagcatttcattgggcgaaacaatcacctgtccgaaattctcggcgccggcgtcgcaatttcatgaaaaaaattcaaactatcgtcctccctatcgttcacaccttcacgtgcaacgttaagtaggaggcgacatgcaataccgacaactgggtcattccggcctgctggtatcggaaatcatcctgggcaccgtgccctttggcggtcgtgcggagttcgaaaaatgcggcgcggtggacgtgcccctggccaagcgtatgttcgatatcgcgttcgatgccggggtgaatatggtcgataccgctgacctctactcccacggcctggccgaagaggtggtcggcaaggccctgggtgacaagcgcaacgatatcctgctggcgaccaagggccgcagcccggtggacagcaaccctaacaattccggctcatcgcgctatcacctgatccgcgcctgcgaagcgagtttgaagcgtttgggtaccgaccatatcgacctttaccaactgcataactgggacggcatgacgccgatcgaagagactctcgaagccctgcgcctgttggtcggttcgggcaagatccgctacttcggcaccagcaacttcacggcctggcagatgatgaaaaccctgggcaaggccgagctgcacggcatgctcaagcccatcacccagcagatctactacaccccggaatcccgtgaagccgagtacgaattgctgccgttggccttggaccagcacgtcggtactttggtatggggcccgatgggcgaaggcttgctgaccggcacgacccgccgcgggcacaagccgccacccaatacccgccagggcagcgactggccggaaccctatgtgcatgaccaggagcgtgccctggacattatcgagaccctcgccgccgtcggggatgagcatggcgtctcggtcgcccgtacctgcctggcctggctcaaggatcgtccagggatcacctcgctgatcgtcggagcgcgtaccgaagagcacctgcgcgacaacctcgccgccactgagctgaagctgaccgaagcacaatcgtcacgcatcgaggcggtcacccgtcgccagccgctgtacccctactggcatcgctttacggccgggatcgatcgttttgatcctgcagaacagccgttcctggccgagcatcaaaagaccatggatgcgcgcaaagacaaataacagtgcggttcaaaggtgggaacacacccttcccacctttggatcaagtgcccccagcaaaggagtctggctttgatcgcgcaaatcatgatcgccgccctcggcgtcgtcgctatctggttcagccagagcaaacgcttgaaggtacgccgctacgcctgcctgtttggcatggccggccagccgttctggttctggtcgtcgatcaatgccgagcagtggggcatcgtcttgctcagctgtttttatacagtggcctgggccaagggcatcaagacccattggatcgatcgcaagggtgatgggcaaggttgatttgcaatcgtgcgtcgcgctgcctatatttgcggcctggcgctctccacgccaccttccgcggaaagggctgcgcccaggacatcacagctctacctcatttctacgactcccaaccttaaagcggaaaaggttcgaacaaggagctcgtatgtcgcaacgccctttcgcctcaaacaccgacggccgccttaaccttgagcagcagcgcaagcgcgccaaggaactgttgtcgcgcctgaaaagccaagaccccagcgcaaccttgtcccaggctcagtggcagcttgccaaacagctgggcttcgccagttggcccaagctcaaggcccatgtcgacgccctcgactttgccgcccgccaccctggtttcgaggccagcgatgaatcgcgcaccacccattggcggtgtggcaacgatattgcccacagcctgcaactggccgggttcaagggccagttccggatgctcacggacccgttgtgcatggggccagtgcgtgaactgcccagccaagcgttccgcgcgatgcgcagtacctttatcagtcaggcctttgcccttgactccactgaagtcgcgcatcgcgtcaacgatgaatacgaccaactacaaaccttggccaacgccgatcacagtgtgctgtggtgcgaggcggacgcctacgaccaactgtttctggtgcgcgccctggccggcctggagcgggcgccgcgcaagctggaactgattgaggcagaccgcattcccggggtcgagcgatttatcggcataggccaattggcccccgatgtgctggcctggctctggccgcagcggcgcttgatcgacgacaacgcagtgcaattggccaaacgggcctggtcggcttattgcgacagctcaccgctcaagctcgcggaactggcccatggcaattaccctgccctgccttttctggcaccggcgttacgacgccagttacaggagttgccgggtatcgaggacggtttgtcgctgactgaacgtttgtccctgaggtatatcgccgaggccgggcctgtgcctttcggccgggtgtttgccgagttgatggccaagcgcgagccactgcctttcctgggcgacatgatgttccatgcgctgctgcgcccattgattgatggggcggcgccgctgctgatcgagtccgaaacggacgtggagtggccgcgccgcgtattggcgctgacgccactggcgcagcaggtgctggatggcaatgcctgctggctggaccacgccagccatgagcgttgggtcggcggtgtgtgcctgcggccacggcaaccttattgggcactgggccttgctgatcagcccgtctggcgtgactgatgctgcgcgatacgatcagcgcttgggaaacaaccccacggcacatgccaccacagtcgggtcgccctggtagaccgcccgcgggctcatcgaaggctggggcgaccggccgtccacggtgcgcagtatcgggcgctcaacggtcggggaactgtgcgccggatcgacaatttccatgcagcgacgcagggagttgaagtcgggcgattgtgacaacgacaggtgcagggtctggctaaccgagaccgacaccacagagcgctgcgcacattgcccgtcatagatcagcgtatggcggatcaacgggttgtcatggcagtacttgagcaggttgacctgccgtgagtgcactagcgcagtgttgatgatcagcaggtcaaacgccacaacgcccgagcgtgtcagtgcctgcaactcgtcgaacgaactcaacggcacgatgcggtgatagcccagctggttgagcattttctcgatcttgatccgttgcaaaagctctgcatcggcaatcagaaggcgtaacgctttattggacatagggtaaacctgacagttgggcatccgcgtcgatcattcaacgctgagcaaagtaaccgtcaggggtgaacgctgactttaaggcgattctgaaacggcaatccggggcacaccgtacttttaagaatcgcctcaaagccttcgcgccactcgccacctaccatgagctgcgttcccttacccgaccatggaattgccgtgttcatgtttctactcagaatggtactggtggcctgcgggctgctggtgcttgcgtccccacctgccaatgcggcgctgaagatcgaaggcacgcgcctgatctacttcggccaggacaaagccgccggtatcagcgtggtcaaccaggcctcgcaggaagtcgtggtgcaaacctggatcacaggcgaggacgaatccaccggccgtaccgtgccctttgccgccaccgagccattggtacagctgggcgccggggagcatcacaagctgcgcatcctgtatgccggtgaaggcttgcccagcgatcgcgaatcgctgttctggctcaatatcatggagatcccgctcaagcccgaagaccccaacagcgtgcaattcgcgatccgccagcggctcaagctgttctatcggccccccgcactccagggcggctcggccgaggcggtgcagcaattggtatggagcagcgacgggcgcacggtaaccgtcaacaaccccagcgcctttcacttgtcactggtcaacctgcgaaccgacagccagacgctcagcgattacctgctgctcaagccccatgaacgcaaaaccctgaccgcgctcgacgctgtgcccaagggcgccaccctccacttcaccgaaatcaccgatatcggtttgcaagcccgtcatagcacggcgctcaactgataaatcacggggtatttgaaccgatgtcactgaccaaacgctgtttaccgcttctggtgttgacctgcgcggtcttgcccgccaccagctacgcactggcctgccgcgaggacggcaccaactcgatcatcacccaggaagcgctgggcacggcgctggcggtggcagccgatgcccccaacggcacgattatctgggagtccggccctcgctcgaccaacgtgatctgcaaggacgactacctccacggccgtgaggaagtgtatttctacgtcaacccggccaacgtgagcatcggcaccgggatccgcgtgggcattcgctacaacaaccagccgattacccaaagcaccggcaaggtgggcaccggtttcttctccgaccgaggctgcaatttgtccaattgcgtgggttgggacaaggcgcgctttacgctcaatttcagcgtattcatcgagaagtacgaccccaccccaccgagtggccaggccagcaccttgacctcttaccgcgtgttccaactggatggcgtgcgcgggctcaactcacgacccaacagcaacttcaattatgtggtcaccggcatgaacgatatccgcttcgtgccttgcactcccgaactgaccatcagccccagcgtggtcaacttccccacaccctcgcgcaaggcctcgatcggtgaagtcgccagcagcgcgaacttcagcctgaacctgcgcaagggctgcgacacgccctataccgtcagcgcacgcttcgccaccacgccgggcggcggcagtgtgaacaatggcctgctggtgccggacaacaacagctcagtcggcatctcgctgtctcgcgccgagagccagcagcaactgcccttcaacaactggttcacgctgcaggaactgatgggcctgggccagagccacgatgaattccgcgccgacctcaaatggcgcaccttgccgattccaggtgcgttcgacgctgccgtggtagtggatatgtactacaagtaggtgatttttaaggatcgtcttatgccaccggcaaaggcccagacataaagtttgccgatgcgattgaaaagttatctgctccagatcaaccccgtcctttcccgacccgaagcagccagaaggctgcttcgtatttttgcgagcgtgctgctggtgggcatcctgggcggggtctatacctttctgctgtcaaccttcaacaacgacatttcccagcgccgcggctatatgagcagcgctatagccgaagcccatacgtttttcaccaatcgccaagccttgctcgaaagcctgagcctgtcggcagtgcgcaagcagaccagggtctatccctcttcggcggaagaacaacacctggagctgggggacacgccaggcagtcaatggagcatctggctgaccgcgcgcatgcgcgactacctcaaggccaaacagctcaacctgctctacgtcaacaccggctccaacccgcacgtgacgcggctgttcgatgcgaccacgcaggtattgccgatttccaagtgcatgctcaaccgcctcaaggccctgcaacacaccgacccggccacgctcaacgaactctggctgagcgacaggactgaacagcactcgcacctgtatatcttcatccgcctggacgagcgtgatcgcgactccggctggctgggactggagatggatagccgtgaagtctcctcgacactcagcgaccagagcgccggcgagttcatgatgctcaattcccagggcatgctggtgttcaccaacagcaccgatacacagttgagccagcaacacctgaggcccggcgaagacagttttttcggttttgtcggcaacggctggctgcccgaccacctggtgattcgcaaacacctgaagtcctctgaatggcagttgatgtactccatcgacctgcgtgcggtggtcaccggtttgtggaaacagctgctcggttcgctgctgttctgcctgttcagcctgacgctgatctggttggtgatgcgccgcgtcgatcagcgtttcatccttccgtctatccatcgcatccaggcgttgatcgaaagcgaagccttcggccgcgatgtgatccagaccgcccccgtggccctctgcgtgctgcgccgtaccgacggccaggtggtactggaaaacaccctggcccagcaatggctgggtaatgggccggagcgcgaggcgctgcgcgccggctggatcgagcaagcctttgccaacggcccttccgagcgcagtgactactttgaaaccatcgacggccgtcacctatacctgagcagtgcaccgacccgctacaaaggcgaagacgtcctgttttgcgcattcagtgatatcagtgcgcgcaagcaggtcgaggcggcgctggaagaggcgcggcaatcggcggacgcagctaatgccgcgaaaaccctgtttctggcgaccatgagtcatgaaatccgtacaccgctgtatggcgtgctcggcactctggaactgttggcacgcacgcaactggatgcgcaacaaaaggactatctgcaggcgatcgaaggctcatcgtcgaccttgctgcaactgatctgcgatgtgctggatgtatcgaagatcgaagccgggcagctggcactggagatgagcgagttctcgccgctggacctggtgcatgaaatcatccagggctacgccgcggccgcccacgccaagggcctgcagctgtacgcctgcttcgatcccaagttgccggaacggctgatcggtgacgtgacgcgcatccgccagattctcaataacctgctcaacaacgcggtgaaattcaccgactatgggcgcgtggtgctgcgggtcaaagtgctgggccgcgacggcgaacgctccagcctgttgtggcaagtttcagacaccggcaaaggtatcgcccaggaagaccaggcgatgatcttcgagccgttttaccagagtgagggcaataccaatgtggttgccggcaccggcctgggcctgccgatttgccagcgtctgacggagttgatgaacggcaatatccgcatggtcagcgaactcggcctgggtagcagtttcagcctgatcctgccgttggaggaagcatctgttgcaccgatgacaccgttgctggccgagaccatttacgtggcctcgccgatcccggaactggcaaacgcgatcgccggctggttgcgccgttggggcgccagggcccaggcgggcttgccgacgttggcggacaagcacctgctgctgcaagtgcaccccggcagcgttgacccgttactggtgcccgagtggccagggccggtgattcacgtgagcagcaatgcctgcccatgcgtagaagccgacgctggcgcctggcacgtcaacctcaaccacctgggagccattcatcaggccgtgagccaggcgcaagggctatgggtggcccgcgccgatgagcaaacgcaccagcgggacctgaacaaactcaacctgcatctgctggtggccgaggacaacatcatcaaccagctgattttgcgtgaccaactcgaagaactcggctgcaccgtggaactggcggccgacggtcaagaagcgttgcagctgtacagcgccggcaacttcgatgtggtgttgacggatgtgaacatgccccatatcaacggctatgaactggcgcgtgaactgcgtcgacagggctgcccgttgccgattatcggggccaccgccaacgccatgcgcggcgaggccgacctgtgcctggccgccggcatgaaccattgcctggtcaaaccttttgcgttgcgggctctattcaactccctggcgccttatgcacggatcccccatgaagccccttagtattctgattgtcgaggaccatcccctgcagcatatctacctgcagaacctgctcagcgagttgggagatttcctgctcgaaaccgccgaggatggcaaccaggcgctggagcgtctgcgccagcgggacttcgacctggtgctgaccgacctgctgatgcccggcatggacggcgtgcaatttatccagtgcctggccaacctacgctgcaagccggcgctggcgatcatgagcgcggcgtcacggcgcatgctgatggcggccagcctggttgcaaaaaacctcgatgtcgaagtgatcgggctgatctccaaaccagtgaccgccgaggccttgcgcacactggtcgatcaactcaggaacaaggtgcacaagccctctccggaattgctcgagcacatggacatcgaccgtcaaacgctggtacaggccatgagcggtggccagttccaggcctggttccagccgaagaaatcccttgccaacggccgtatcgtagccgccgaagccttggtgcgctggatgcaccccgagcaaggcgtgatgctgcccgccgcgttcctgccggcgatcaaggcattcgaactggaggaacgcctgttgtggctggtgctcaagcaggcgatccacgcccaggaacactggcgccagcgtggctatgaaatcccggtgtcgatcaacctgcccacacacctgctcaacagccatgacctggccgaccgcttgttggagttcgtgctgcaccacaacggcatccccgcaatgatctgctttgagctgatggaatgctcggtgccgcaagacatcagcaacttctacgccggcgcctgtcgattgcggatcaagggattcggtttgtcccaggatgatttcggcaagggctacagctcctacctcaacctggtgtccacgccgtttaccgaattgaagatcgaccaggcactggtgcagggcagccacgacaacgaaggcatcgcccaggcgttggcgagcattatcgcgctgggccgcaagttgggcctgacggtggtcgccgagggcgtggaaacccctcagcaattggcgctgctgcgcaaaatcgactgcaatcaggtgcagggcttcctgatctcccatgcggtgtcttcagaccaatttcagcaactactgaacaatgatggccccgcgacatctcactagctggcggcccggattacttgccctttaaaggagtaagcagcatccagtgccgatttttcctgcgcctgcggaccccctgatgaagcacaacaacgcgatcctcgaagcctttacccgcagctcattgcgcctgaacaagggcttgatggtcctgatgggaattgctttgctactggtactgaccaattactggtctctgcaaaggggcgtcgaaatccggtacggcgccatgcgctttcactttgcgcgactgatggaaaatctctcagatcagcaaacctacctcaagagcctgacgcatcccggcatccaggccgaactgctgcacgccacccacgtgcagatcagcctcaagagccgcatggtcgacaaccgccgcacgttgtacgaaggccagaagtattcgttttcggtaccgttcagcatcaagttcgatgaacagcagatcggcgccgccgccagaccgccgatttttgccctgggcgcgcacctgaccagttactacagcgccttctggtcctcgtcgccgtacgaggcgccgcaaacctttctgctcaatcgtcaggcgaactacaccatcactgttccgtccgtgggctatcagcaccgggaaagccccgaggataccgacaaccccgtggcgcgagtcaacgctgtgcagcaaatcctcgcacagacaccgcagccgcttgagcagaatcgggtgtattggcaggccggacccgaacccgaatatttgctggcctacatcggcctgccactcgactcacagggccaggcagtgatcggcaccctgctcgatgtgtcgcaggtcgacgatgtacagcgcgcattgaatcactcggcgtttgatcgcttcaccctgattggccctgacggcagccggttgatcgggcctaccatccaggcgcagctcagcgacggtgtgcatttcacggccaacggcattgaattcaagatcacccaggccggcgaccagccctggagcgcggtctatggcctgaactactcgcacttctttcactccgcattgtggccgttgagcaccttggcgttgctgctgttcagcctgatcaccctgggttgggccggcagtcgctggtatcgacgccaggtgattacgccggcgcaactggcccacgaacgcattgccgaaagcgtggcattcagccgcgtgatcatcgacaccgcccccaccgggttatgcgtggtgcgacgcagcgatggcaaggtgttgatcgaaaaccagcgggcccagcaatggccgggtaccgcacgtttggtggcggccatggccggtaagcacgacatggctgagagcggagaaacgcatctggagatcgagggccggcacctgcagatcggctttgtgtcaacccgctatcaggctgaaaacgtgcgcctgtacgctttcaacgatattacccggcatatcgaagatgcccagtccctggaagaagcgcgtcacgccgccgatgcggccagcgaggccaagacgttgttcctggcaacgatgagccatgaaatccgtacgccgctctatggcgtgcttggcaccctcgaattactcggtctgacgaatcttgacccacaccagaaggcctaccttcacaccatccagcgctcgtccgccacgctgttccaactgatcagcgatgtgctggatgtctcgaagatcgagtccgggcaaatggcgatagaagctgtggagttctgcccgctggacatgctcgaagacaccctgcacacctacgccgctttcgcccagcgcaaggggctgcagctctacagctgcattgacccgcagttgccggactgcgtgatgggcgacccgatgcgcatccgccagattctcaataacctggtcagcaacgcgatcaaattcaccgatttcgggcgcgtggtgattcgtgccagggtgacggggcgcgacgccaatcatgtcgacctgcaatggcaagtcaccgactcgggcgtaggcatccccgaggcgcagcaggccaagctcttcgatgtgttctaccaggcgccggacaccgccagcgaaggtggcgccgggcttggcctaccgatctgccggtggctggcgcagatgatggacggcgagatccgtgtggtcagcgagcctgggctgggcagcagctttacgttgaaaatgcgcctgccgctgtgtggcggcacactcaccaacctgccgctgatcgaacccagcccgaccccggtatacgtacaggcaccggtacgcgaactggcgcaggcgatgagtgactggctcaaccgcctgggcattaccgccgccctggcggcgaccgcccaagacaaagacaaccaccatgcagtgctggtggacctgttgcccagggagcccgccaggccatgggtcggccagcgcgtgctgtgcctgccgggtgcgcacagcccgccgctgcacacggcgcaaggctgggtggtggatctgcacgacgtacgcgccctcgccgccaccgtgtcactggcgcagcatggcaagcatgagcagccgacgccgacccgaccacaaagcgcggggcggttggggctgcgcatcctggtggccgaggacaacccggtcaaccaggcgatcatcaaggagcagctggaggcactcggttgctcagtgagcctggccgccaacggcgagcaggcgttgcaattgtggcaaccccaggctttcgacctggtactgaccgacgtgaatatgccgttgatgaatgggtacgagctggccagaatcctgcgcgaacatgaccctcagttgccgattatcggcgtgaccgccaatgcgatgcgcgaggaaggcgtgcgctgcctggcggtgggcatgaacgcctggatcgtcaagcccttgagcctgcaaaccctgcgtggccagttgatcaagctgtgcaaggtccagcccccggttgagcctgccgcgtcggtattcgacgacagcgtgcaactgtcggacaagatgcgcccgctgttcatcagcagcgtgcagcaggacatacagcgcatcggtgtggctctggcacagcgtgatacccgcaacctcggccaattgctgcattcgatcgccggcgccctgggtgctgttcaggccctcagcctggcccaggcgtgcatcgaactggaaagcgcccttgaccgcggcagcctcgacacaacgcttgagctcaaggtgaagactgtgatgcggcgtctgtcggccgttctggagactctccagcccgggcattcttcactcacttgaactggcactacggacggccctttatgaaaaaattcaacgtggtaatcgccgacgatcacccgatcgtgttgctgggcgttcgcgaactggtagagcgggacatacgctttcaagtcgtcggcgaggccgtgtgttcggccggcctgatcgagttgttgcagcatcaaggcgtcgatatcgtgatcaccgactacaacatgccaggcgactcgccctacggcgatggcctgaagctggagtacctgaaacggcatttcccgcaggtacagatcctgatcctgaccatgatctccaactacctgatcctcacccgcctgcaggaactgggcgtggtcggcatcattcagaaaagccagttgcacaccgaaattcaattggcactcaaggcgatcgcccagcgcagcgcctatcgaagcctggagccgcccaaaacctcagtgatcgagaccctcaccgccatagacgaacgcttcaccagtttatcgcccaaagagttcgagatcctgcgcttgttcatttccggcatgagcgtgagtgatattgcccgccgtcagaaccgaagttcaaagaccatcagcgcgcaaaagatatcggccatgcgcaaacttgaagtgagcagcgaccaggatctacttgcttattgcctggaacgaaacatcttcaactaacgcataacttgcaagccattcctggacaatggctttgccctttgttttcgagccttccaccgttgcaacagcacaaataagctgcccgccccagagcttataagaatcgtcttattcgctccctctgcctcgtcgcctactctttgctcgcagttcaacaacagcacttttttcaactaacacttacggacatcatcatgaagaagttttccctggctgtgatcgcctcggccattatcgccgcttccggcagtgcatttgccgcggaccctgctccgacgccaaccctgggcggcagcggtaaaatcaccttcaccggcgtcattaataacgatgcctgctcggtggacggcgccaactccgaccgcaccatttcggtggacatgggcaacgtatcgatcaaggacatgggcaccgcggaaaacccgaccgcaggccgcgtgaccgccaaagacttcaacctgaacgtcaactgcaaccagggcaccaaggtcgccatgatctttgacgccaacaacggcggttcgggcctggtcaccggcaaaaaagtactggccctgaacccgggttcggccactgcacaaaacgtcggtattgccctgctcgacagcaaaggcggtctgatcgacctcagctcgccaagcaccgcacgcattgaaagcaccatgcacggtgccggtactgaaggcggcgacgccaccctgagcttcgcggccgcctacgtcactaccgcagccgcgggttcgtccaccgccggtcgcggtgacgccaccctgccgttcatcctgcaatacgaataattcggcgccccaggcaccaaacgcgcgaggccttgcggcctcgccattgtcttctgattacaccggataaccctcatgccgcctcgttctattgccgcatgtctggggctgctgggcttgctcatggctacccaggccgccgccagcatttcattgaatgccacccgtatcgtgtttgacggtgaccacaaggaagccaacattaccgtgcgtaacggtagccaggatgtattgattcaatcctgggtcgacatgaacgatgccagcgccagccgcgcgccgtttgccgtcaccccgcccctggcgcgggtatttgccaaggaacaacaactgctgcgaatcctgtacgaaggcaccggcatgcccacggaccgcgagtcggtggtgtggctcaacgtgcaggaaatccccaaggccagcgaagccgagaacaccttgcagttggctatacgccaacgcatcaagattttttaccgccctgcaggcctcaccggcagtgcgctgcaagcccctgcgcagcttgaatggacgctggcaagacatggcagccaaaccctgttgcaggtgaaaaacccgacgctgtaccacgtgtccatggccgacatcaaagtgcaggcggtactggccagcgactccaccatgatcgcgcctggcgagcaaaaacagtttgcgctcaatgctccagttgccagcggaccggtgcagttgtcgttttccagtatcaatgactacggcgcgcagaatcactacagcgcgcctttgttcagcggcgcgacgctgccggcgcacgcgactgaatcgcgcctcaacccctaagcactttcgttaacccacaggctcacttcgcgtgcgtgtttgcgtgcccggctgtccgtcaatcagggatgtcataggtcttcgcatgtcttttctttccagcaacaggcccgcacgtggcgtactgaagttgaagacgctgtcgctggcgatcgctgccagcttgcccagcctggccatggccgatgacgctgcggaaaccttcaacaccaccttcctgcaaggctcgcagtcaccagtggacctgcagcaattgctctcggccaacagcgtgctgccgggcaactaccgcgtcgacctgtacagcaacgaagtgctggtgggccgacgcgacatcgacttcaagcgcaaccccaagaacgaccgcgtcgaagcctgcctgaccctcgacctgctcaagcaactgggtatcgacctgcaccgtttgcaggccgagggcaagctcgacccgcagcagccgcaggaatgctacgcccttgccgaaatgatcgaagacgccagcgtgcgctacgacagcagccgtctgcgcctgctcgcgagtattccgcaggtagcgatgcagcgcggcctgcgcgggtatgtcgacccacagttgtgggacgacggtgtgcccgccgccttcatcaattaccagctcaacagcagccgcaccgctggcgactacaagacccgcatcgccaataacctgggcctgcgcaacggcatcaatctgggggcctggcgcctgcgcaacgagtcgaacctgagcggcggcaccgatcgctcgaataccttcaccagcaaccgcacgtacttgcagcatgacgtcaccgcgatcaagggccaattcagcgccggtgaaattttctccgacaccgacttgttcgacagcgtgcgctatcgcggggtcaagctggcttccgacgacggcatgcgcgccgacagcgagcgcggctacgcgccggtgatccgcggcgtggcgcagaccaacgcgacggttgagatccgccagaacgactacatcctctacaccgccaacgtcgcgccggggccgttcgagatcaacgatatctaccccagcggctccaacggtgacctgcaaatcaccgtgatcgaagccgacggcacgcgccgggtgacgatgcaggcgttctccagcctgccgatcatggtgcgcgaaggccaggtcaaatacagcgtctcggcgggcacgttcaaaagcaatgccgatggcctggcaagcccgcgtttttttagcggtacgctggcttacggcttgaccagcaacctcagcgggattgtcggtgtgcaagccagtgaggactacagcgcgctgtcgatcggtgccggccggaacaccgcattcggtgcgttctccctggataccacccattcgtccagcaaggcccagggccgaacctcccagggcagcagcgtacgcgccttgtacgccaagacctttgccggcaccgacaccaacttcaccctggccgcttatcgctactccaccgagggctatcgcaccctcacagaccatgtggaagacagcagcgaagacctgcgcgtgcgcactggccactcgaaaacccgcaccgacctgaccatcaaccagagtatcggacgcaacagcgaattcggcagcctgtatgtaaacgccagcgaccagcgctattggaatcgcggcggttcccagagcttttccgcgggctacaccggcaactggggcgacctgagctacaaccttggcgtgacgcgcaccaagcagatcgtcacctggggcgagccgagcagcgacacacagttgaacctgtcggtgtccttcccgctgggcagccaggcccgtgcgccacgggcgtttgtcaccaccagccaccaacgtggcgacaccaccacccaggcaggcatcaacggctacgtggccgacaccagcgacaccttctattcggtgcaggccggccacagtgacaccagcggcgactcaggctcggtgaacatcaacagccgcaccgccgtggcagacgtcagcctcggttacagccagggccagggctacaactcacaaaacttcaaccttgccggttctgtggtggcccatgctggcggcgtcaacctggggcaaaccgtcagcgagaccttcgccctggccgaggtgcctggcgtcgctggagccaagatcagcagctacagcggggtggaaaccggttacaacggctatgcggtggtgcccactgcgcaaccctaccgggtcaactggatcagcctggacacccgcgacctgggtggcgacgtggaaatcaccaacgccacccagcaactggtgccgcgccgtggcgccatcgtggtggcgcattacagtggtactaccggacggcgcgtattgtttgagttgttcgacgcacagcatcagccgctgtcgtttggtgcctcactggaagacgccaatggcaagcagttggcgattgccgatccgaatggcaatgccctggcactggtggaagaggatcagggcacgctgatcatcaagtggggtgagcagcattgtcgtgccacctatgcgttgccaccgccgaacaaggcgctgaattatgagcgccagtcactggtgtgcacgccttgattgtgcgggtgattgcgctactgtgctgaccacgcgcctaccctctgcgagacttgcccatgcgtaacttgttcttcgccagtgcctgcctgttgaccaccgccctggcaggctgccaacagaccccgccggccaacgaccaactcgacgctgtgctctggacccagacgtccatcgagcacgagctgatctaccgccagctcttcgccaacgccacccgccaactcgatgtagcgttggccgacccaacctgggacgccctgcccttcccggcgcgcaagctggccggcctgccaccggcggtggtggtggatatcgacgagaccctgctggacaacgtgccgctcaacgcccgcgacatcatcaataaccaggtgtattcctatgaccgttggaacacctgggtggagcaggccaaggcccaggcactaccaggttccgtggcattcctgcaggctgccaggcaaaaagggatcaaggtgtattacctcaccaaccgggaacacagccaggtcgcggccacggccaacaacctgcgtttacgcggctttccgattgagagtaatgaacagatcctggcggccagcacgcctaccggccactgtgaaagcgccggctacggcaagaactgccgccgtcaatgggtcgccagccaggcacgcgtgctgttgatggccggtgactccctgggagatttcgtgcaggccgaacacaataccctggctgcgcagcgcaaggccgttgaaccctatgtgaactggctggggcaacgctggttcctgctgcccaacccgagctacggcaattggtacagcgcgccgtatggggatgatgaaaagttgccgtttgtgcagaagcgcaggcttaagcagcaggcgttgttgttgcaggaatagagagtagccccctcccacattggatctgcgttgaaccagtatctggagcgatcaacacttcagccctgaggcttggtgtgccaacccgagggccgttcatcccactcatttgcaatgcggccctcatatcatcacactcgtcatccacccgccggctcaggaaccgcaaatgcctcactccttgctcaagcctgcgctgcccggcattgcgctgcggcgatggcgtttgctgcaccgcgtcaagcaaagccatgcggcgcagctattcaacgtcacgcaatcgactatttcgcgctgggaaagcggcatacaagcaatggatccggctgcgcaccaacagcttgagcaactgttggcagcccggcttgatgcagccgccgaccaggcattggcccggctggtcagtgagagttcgcaagcgatgcacctggtatgcgacctgacgcaccgcctgctcgcatgctcgccctcccgcgcactccaattcaccagcccgctcaccgaccttatgggccagtcgctgtggcgcttcgcaacccaggaaatccagctgatcgaagccagcctggagcacaccggctggcgcgaaacccaggcccccccagcccttgagttcaccactggaagcaacgattccagcctcgtgccgatacgcccaagcctgtgtcgctggacgcgcatgaccctgagcgatggcagcgccgcgcgcctggtcgagacgctctgactgaacaccgcgcatattttatgcgtggacgatctacgctcgcgcacctaggcttacctgcataaccgaccttgtgggggcagcatcatggacctggaaaaaatcaaaggccgtctcgatttcctgcgcgaagcggaaaaactcaaggatgtgctcagaagtgcccacacggcttcgggtcgcactgaaagcacggccgaacacagttggcgcctgtgtctgatggcgatggtgttcgccgatcaactgcccggcctggacctgctgaaaatcctcaagatgtgcgttatccatgatttgggcgaagccatccacggcgatatcccggcggtcagccaggcggcctttcccaacaagggcgaacaggagcgactcgacctgctgctgttggcccagtccctggacagcccgctgaaaaccgaaatcctgacgttgtgggatgactacgagaacgcgctttcgccggaagcaaaagcggtcaaggccatggacaaactggagaccctgctgcagcacacccaggggctgaaccctcccgatttcgactacgccttcaacctggcctacggcaaaaaacacacggatgccgaccccttgttcgaagcattgcgggcattgatcgatcgagcgacagagcaaaggcttcacgccgccgagtaacgggtttaatcacaacgcccgagcagcaatcgcctccacctccaccaacgcccccggcaacggcaacgccaccacttgcaacgctgtccgcgccggtttgttcggctgctccggcgtgccgaagaactgcgtatacccacgctgcagcccggcaaaatccagcttgccgtcggtttcttcggtaccgaccagaaacacccgcaactgcacgatatcgcccaggtccaggtcgtgttggctcaggatctggcgcaatttgttgaacaccgaaacagtctgcacttcggtatcgccaaaaaccccaggcacgctcgggtcggcaaggtccggcagggtgccactgacgaacaccaggctggcggaggccggcacggtgacggtttgcgagatggggaagtcgccgacgctggtgcgttggatgctgttgctcatggtgttactccttaggaagcggccacggccgcggtctgtcgttgttggatgacgcgctcggccagttgcgcgaccacatggcgcgctgagttggcggctgactcctgccagatccccacgccgctttgcaccaggccgtctcctgcgaagtacacgcggccgtgggggcgttcgagcaaggcgctggcctcggccgggaagtgctcgcgttgcagccatgggccttcgctgtaggggatctgttcccaggacaccgccagcggattgcgcaggtgcttggaataacccggatgcaggagctccacggcctccctcgaagtggcgtactgcttatcgagaggctgtgcgccaaacgcgtcggcgccctcccccgtcacgtatccagccaccagcacaccatcgcgggtgttgaggtcgttgctgggataccagagcaggcgcgctgggtgttcgatccacgacaggccgccgtaggtgcggtaatcggtttcccagaagcgcggggattgccacgccaccttggtcgcctgatcgctgcgggtgctgcgcaacgcggccttgatcgggtcgctgaaatccgtatcgagtttggccagcaatggcagcggcaaggtcgagatcaagtaatcggcgcgcaccacctgttcacggccgctgtgctggtcgtgataggtcaccgccacgccgtcctccaattggcggatctgccgcacccgggcgcccagttgcacctgctcatgcacgcgccggtagaaggcatcggtgatacggtccataccgcccaccggctggaacatggtggcggagaattccggaaactcggtgtgcagcaaggcgccccagagttccgggtgcagcaggcgttcgagccccagcgggcgacaacgggcgggcaaggcgccagggtgggcagcggattccaggtgccccgaacgcagggtgccctcgaaggccagctcctgggacaggtcgccatacacctgcaggaaacccagcaagcgcgtgcgctcttcgctcctcagtacatcatcgagggcgtcacgctgcaccgccttggccaacaacccggacaggtgcccacgggtatcgttgagcgcctggccgaggctgaacgccggttggctgaggtccggccgcacctgggcgccatggctgctgttgaccagcacttccaggggcacgcccagctcgctgcaatagtcgaggatcgtgcggtgttggctgggaatgcgcgcaggaccggcgttgaaatactggcccggatcaaaccccacggtctgcgagcggccatccttgtagtccacgcggtcaccgttgcgcagggtccaggtgcggcccccaacgcgctctcgggcttcgagcacttgtacgttgaagccggcgcggctcagctccagtgccgtgaccagcccggcaatcccggcgcccagcaccagcacacgggtgccctgccccaggccgtcgttgagtttcagcggttgcggccggcggtgtgaggatgggcccaggcccaagaccgccaatgcgtccttgacggccttttcaccgcccaccgcagcaatgctcgacaacgcttcacgtcgtgtcagtcccatgtgcaaacctccttaatccggcagcccgggcgggttgatcagcgactggtcgacccgttccacatccaggccccagcgctgcaagacctgttcgtattggccaccggcaatcgcgccttgcaaggcggtgtggatcggctggaccaggccattgtccttgcgcgtggtcacggcgatatcggcctgcagcggccagccaccgttgacggtgccgacgcgcttgataccgccggtgattgccgccgaataggcgtacaccgagttcggcccgaacagcgcatcactgcgccctgactgcaccgccagttgcgcggcggcctggtcatcgaagtactgcaacagtgcaggcttgaggccggctttttcattggcctcgttccaggccagcaggaccttttcctggttggtgccggagccgacgatgatcttcagcccggcaatgtccgctgcctgcttgatctcagtgatcttgctggtgctcttgacgtaaaagccgagcacatcctggcggtaggtggcgaaatcaaagcgctttttgcgtgcctcggtgacggtgacgttgctgatcaccacgtcgtatttgcccgagctgacgcccaggggccaatcctcccaactggtctgtaccacattgagttgcaggccgaggctatcggcgatcagttgtgcggtatcggcttcgctgccgatggtggtcttgtcgtcactggcgagcagcgccaggggcggcccggccacgccggacacggccacggtgaacttgcccggctgggcgaacttgaaccccggcgggatctgcgcgatggccgcttcattgcgcggcacatggatgcgcgggcggtcggggctgaggtcgacctgttgcacggcgaaggcgtattgcgcggtgctggcggcaagcgccagcaaggccacgcgggtggtatggatgaacatgacagtcactccttgaactaaagcaccttgccgagaaaggcctgggtacggggatggcggggtcggcggaagatctgttcgggcgggccttcttcgatcaactggccgtcgcagagaaacaccacgtggtcggcaacttcgcgggcaaagccgatctcgtgggtgacgatcaccagggtcacgcccagccgggtcaggcccttgatcacgtccagcacctcgcccaccagctcagggtcgagggccgaggtgggctcgtcgaacagcagcaccttggggtccagcgccagggcccgggcgatggcgacgcgttgctgctggccgccggagagctggcgcgggtaggcgtcggccttgtccgccaggccgaccttggccagcaactcggcagccttgaagtgggcttgggccttgctccagcgcttgtgggccaacggcgcttcggcgatgttctcccaagcggtcaggtgcgggaacaggttgaagttctggaacacaaaacccacgtcgatgcggcgcttgaggatctcgcgttccttgagttcgaacagcaggtcacccttgcgccgatagccgacgtattcaccatcgatggtgatatgcccactgtcgatcttctccaggtggttgatggtgcgcagcagggtggacttgcccgagccggacggcccgaggatcaccgtgaccttgccggggtcgatggtcaggtcgatgttatcgagcacctgctgattgccaaagcgcttgcccacgccctggatctgaatgcgcccggcgcgtgcttcagccatgggccttctccttggaccagcggcgcaggcgctgcaacggcgtcggcggcagcacccgggcggtgccgcgggcaaagtggcgttcgacgtagtactgggcgctggtgagcacggtagtaatgatcaggtaccagacggtggcgacgatcagcagcggaattaccgcctgggtgcggttgtagatgacctgcacggtgtagaacagctcgggcaaggccagcacgtagacgatggaggtgcccttgaccaggccgatgatttcgttgaaccccgacggcaggatcgagcgcagtgcttggggcaggatgatgcggaagatacgccgcgaggccggcaacccaagggcggccgccgcttcgtgctggccggcttccacaccgatcaggccaccgcggatgatctccgccgcgtaggccgcctgcatcaggctcaagcccagcaccgccacggtgaattggctgagcacatccaccgtcgaccattcggcgaacaccaggtcggtgaacggcaccccgagcacgatgtggtcatacaggtaggcaaagttgtagagaatgatcagcaccagcagcgccggcatcgagcggaaaaaccagatatagccccaggccaatgcggccagcaacggcgaacccgacagccgcgccagggccagcgccgtgccaagaatgacgctgaacacagtgctcagcagggtcagcaacagcgtctgccccagcccgcgcagcactgacggcgagaagaaccactggctgaatacgccccactcccagcgcgggttggttgccagggaatgcacgatggcgagcagcaccagcgcggcgaagatcgacccggcccagcgccagggatgtcgggcgggtactacttgcagagcctttatcggcgtcgagatacggcgctggcgcagcggttgggcgctgacctcatcgagcaggtcgtagggtttggcgacaatgggcatgtgctattcctcgcaggccttagaaggcgtaagtcagccgggtgtagtagtacccgccggtaaaaccgtagggcgaataggtgccgtagctggcgaccatggtgctgctcggcaccccttgcttcttggggtattggtcgaacaggttcttggcaccaatggctacgttgaggtctttggtgaggttgtagccaaggtcgaggtcggtgatccatttggcgctgtagacccggtccaggtcgcggttggccgatgaattgacttccttgtaggaaccgtagcgggtcagggccaggttgaggttcaagcgcccgatgctccagtcgccgccgaggatcagcttggtagtgggctgcacgccggtgatcaggttgcgggcctcgcggtccatcagatcaaaggaggtgccgaggatgttggtggattgcttgtaattgagaatcctggtctggttccagttgaacgcggcggtccatttcagggcgccgaacgtgcccaggtcctggttgtagctgctgaccaggtccaggcccttggtgcgcgtatccgcgccgttgataaagtactggccgccggaggtggagttgacgccattgttctgcagcacctgggtgacttgcgggccgagcaaggtgccggtgagggtgatgcggtcgcgcaggttgatcacgtaggcatcggcggtgaagctcaggcggtcggtgggcgtcagggtcaagccgaggctgaagttggtcgagcgctcgggcttgagttcttcggcgcccaacgccttggccgccgccgaacccactggcagcacgccgtagttgatcgactggtacaccccgtccaccacgccgtaggtggtggagcgcgcactgaacaaactgttggccagagacggcgcacgaaagccattactcaccgtggcacgcactgcgaactgcggcgtgaagtcgtagcgggtggtcaacttgccgctgcgggtagcgcccacgccttggttgtaatgctcatagcgcagggcggtgccgacataccagtccggcaacgggttgaagcccacgtccacatagccgaccaggctgttgcgcgaggcgctgctttgttcctgcggggaaatgccgttggtgacctgggctcccgaggacgcacagttacccggcgccacgcagtagccgccgttggcataagacccgtagtcaccggcctgtacctcgtaggtatcgcgccgatgctcgaagccataggacaggtccaagggtttttgcaggccgatatcaaagccgcgcttgaagtccaggttggtggtcaactcggtggaaatccaggtaccggacgtgaagctgttcggcgtggcctcgcccagggacgggttctggttgtgggtggtgccctgctccgcctcgttacgcccgtaggtggtggacaggtcccagtcccactcgcccacgctgcccttgccaccgaacgccgcctggaaatcgtcctcgtcgatgtaccaggtcggggtgtacccggccgggtagccgttggggccagtggtgatggtgttggtgatggtcggcaggcggaagttctgaccctgctcggccttgcgtcgcgagtaggtggtgaaggagtacaggctgaaactgtcatcgatcggcagctcggcgttgtagcccagggtcagcaggttggtcttgggcgtaccgtagccaccgtaggtggacttgcctgccaggtcataggcttgttcatagctatagccgttggcgctggccttgttatcgtcgttctggctgcgcgcatccagggccagctgcacgatgccgccattgccgatctcgaagcccttgttgaggctttgttgcacggtctgcttcttgccgtcatagccaagccctgcgttcgttaccgaggtgccgctggcgtcggccttgaggatcacgttgatcaccccggcgatggcatcggaaccgtactgggcggcggcgccatcgcgcagcacttccacatggtcgatgacgctgatgggaatcaggtccaggtcggccggtgccgcaccggtgttgataccgttgatattcagggtggcgctggtatggcggcgcttgccgttgaccagcaccagcacttcggcggcgctcaaaccacgcaggttcggcgcccgggcgatgccactggcgtcccagccggttttttccggcagggtcagcgatgggatcaccgcgctcaatgcttccatcaacccgggcttgccggtgctttgcaattgcttggcgctgaccacatcaatgggcaccgggctgctggtgaccgtgcgctgctcggcgccacggttaccggtgaccacgacagtcgagagtgtgctgtcgtcctgggcctgtgtcgctgcggccagcagggtcaacgccagggcggtggtgggttgtagaacgtgcttcatatccattcccagcttgtccaaatcgcgaagtcgggcaggcacgctgcttggtgcggcgtggccggcgttccaggggttggcgcggtttgggctaggtgtggggcaagcgcggggtgtgaggtggcaacatacgttgagctcccgtccaacgattctgctgcgacgggattacccggtcaggcgcgcagaatctgaatcacgctgggtaccatccgaggtcaggggtaggctgttgaactcaaacataacggaatgaattttaaaaatataatgctgttttggtataagctaatattctctactttcattatttataaatatctttattcataaaaatgattattttttaatttgaacgtgcgcatacccttgtggaagggggcttgcctccgatggcgttgggtcagtcacagatgtgctcactaacactccctcatcgggggcaagcccccttccacattggtactcggtgcagccggaattattgagcgggccgcaacagctgcatctgctggcgatagtcatccgtcacctgccgcgcctggctactgctggtaattacccgaggcgtgatcaacacgatcagctccgtacggtccttggacttgctggtattgccaaacaaccaacgcaacccggggatcttgcccaggtaaggcacggcactgacactctcagcgttgtcctgcttgatcaacccgccgagcaacaccgtctgcccactctgcaccgccacctgggtggacaccgagcgtgtggaaatccgcggattcaccggtgtgtcgctattacccacctgattctcggcatcgctgacctgctgctggatatccatgtacaccaggccgcccgggttaatgcgcggcaccacgtccagaatcaccccggtctgcacatattcgacactgctcagggtggtgtcagcgtcaccggtattgacggtggtctggctgatgggaatgttgtcgcccacctggatctgcgccggctggttgttcatcaccaccagcgacggcgccgacagcacctgggtacggccgttggtttccagggcgtgcagggccacttgcagattggagctgacaaaagagtagaacaacgagtccgccgcccccagccctgccccaccaccgcccagtgcgccctggctgccggaggcattggccaccgtggtgctggtggaattgccggccaggcggccgaggtaccactgcacgcccaggtccagttcaccggtgagcttgacctcgaggatgcgggtctcgatctgcacttgcagcggcggattgtccaggcgcttgatcgccgcttcgatctctttccactgcgccgggcgggtgcgcaccagcagttggttgctgctcttttgcgcggtgatgcgggtgccggcctcgaggtcgctggtgggggccgccggggtgttctcgccgctctgcggctcgggctcttcgggggctggcacaggagtgttggcttgcaaaccggcgctggtggacgatgacaatgtagtcgtacgcaagcccggggcgaccttggcgggggtgtcgtccttgatcgcgccgttgccgtagatctgccgcaggtacttggccaggtcggcggccttcatattgcgcacgtcgtacacatacatctgcggctcgttgccgccgccctcgtcgatggtgcgaatccagtcgcccacttcgctgaggtactcgggctgggaagagatcgccaccaccgaattggtgcgctcgaccggcaggaagcgcagcatgcccgccaggggcgtgccgctgtcggcaccgaacatggcttgcagctcgggcatcagttcagccaccgaggcgcgttgcaggccgaagaccgccaccgacatgcccttgagccagtcgacgtcgaaggtgtcgatggtgtcctggtagttggccaactcttccggggtgccggccaggctcagtacattgcgtgccgggtcgaccaacagaaaggcgttctctcgggcaaacggcttgagcagtttctgcatctcggtggcggagatatagcgcagcgggaacagccgcgccgagaggccgctggacggttgcgccacgcgcatctggggcaccagcttgcccgccaccgcctggttggccggcaggatcacgtagcggttgccctgcttgatcatcgcgttgtcggtccacgacagcagcgtctcgagaatcgacagcgcctgttgcttgtccaccggtttggaggtggagaagctgacattgcccttcaccccctcggcgatgctgtagttctcgtgcagcaggtcgcccatcacgctattgattaccgcctcgatgggctggtcggcgaagttgaacacgatgtcgccgccctgctccggtactttcgcgggcgcggtgggctggcgcacgaagccttgattgccgcgaatcaactggcgttgcggcggtgccggggtggccggctgcgggttttcagccacgggcgactcgggcggcgggcgttgcgagccggtgccctgcagtgcttcgtgcagcaggtcggcgtccgggtcgagggtatcgggcaacgatccacagccgcccagggagacggcagtggccaggcaaaacagcgaagtgcgcatatcgatcaagggaggggctcgcggggatgggaaatcaggggtaaccgtttgccgtagaggctcagggtctgggtgcgcccgtccagggcgaaacgggcgtattgcggggtcaggtgttccaggcgccagccgttgggcagggtctggcccaggcgtaccgtcagcgccggaccatcggcttgcttgagcatggccatttgcaggttgccggtgatcatgatgccgctgagggtcaggttggccaggcttgccactcgcaccttgcccaccacccggtccgggcggcggtccgggctgaacagcggtgcttgccaggtggcagccagatcctgcaacgccagcgcaggagcggcttgcacactgacggagggctgcgcaggcaccggcgctgcaggcagccaccgcggttcatcgccgatgctgctgaggatcaccgccatcaacagacctaataagccggccaggccgagcaagctccattccaatgggcgcagtgagccgatcattgcaccacccgcgcaggttgcaggtaaccacgcaccagcagctgcaccgccagcttgcccgccccgccagtggacggcgcctgtttgctgcggcgaatgcgcagctcatcgacaaacagaaacggcggctgatattccagcgcatgcaggatcgcggtcagcggttcgatggcgcagttgagtgtgaggctgaccttgacctggcggtaaggctcgctgtcatcctgttcggcagtgatgggtttgcgttgggtcagggtgcagccgccgccaaggttggcgtggctgttgatcaggtcggcgaggcgctgcatcaggtcggcagcgaccacatcgggatcatcgccgggcaacaggctggcgctgctggccgggtcttgccgcgcccgctcaagctgctcgcgcaacgcatcgccctggcgcaatacgctggcgtagcgttgctgctgttcacgcaattgttcggcttgttcgcccatggcccgcagcggcccggcaaaccagctgtcgatcaacagccaataggccgcaccgagcaccacggcgagaatcaacaaggccccgccgcgacgttcacggggtgtgaggggtcggcgcatcggcggcctcctggcgtaagtgggcacgcaaggcaaactggtccttgccggtgcgcgcatcgggttgaatgaccccttcgaactgggcattttccaggcgccggcagcctttgatgcgggtgatcaggccactggccttggcactctggccggagaacgtcacctcaccctccttgacggccaactggtcaagccaagtgtcggcgggcaggcaggtggtcaagtcattcagcagcgcggccaggggcggttgtgccagtttgcgctgggagaggtactgtgctgcgccgcgggtattgagcagttgctggcgtaccgcgtgcacctgggcgacttgggctttttgctgctgtaccgtggcgtgcatggtgtcgagtacgcgctggcggtcgttgagccacagcagcatcgcagcgatcagcaaggcgccgcataaccacggcaagctgcgctgcaactgctttccggctggccgttggcgcgggcgcagcggcgcgggcagcaggtcgatacccaggcccgctacgtccacgcggtgcggatgcaagccaagggcggcgcagtcactaaggatctggtccaggcgctcgcgcaggatcgccaccagtgttacctcaaggtgactggacgtgcgccgctcctggcgagccacgaagtacagctgctcggcgtcgaacggggtgtagcggtccagttcatagccgaccacctccgtgaggttgcgcgcggcagccaggggcagttgcacgcgttgctgcaacaccgtgtcgtgggcgagcatcagcacctggcgtgcattgcccggcgcgaccggcgtcgtcagcggccaatgatggacctgctcaggtggctcttgcagggccagccacttcggcacacagccgcgcaactctgtgagccacagccgccagccttgttgcaacaggctgccgcgccactgcctggcgataggttcgagtcgattcattcttgccaccgcacgacccgatagggctgtgcgctgtcctccacggggctcaataagacggtgagttgcaggcgtgcctgatagccgccggggcgttcggcgcggctgtcgatttccagcacctggccagggtcgacgccctcggcgttttggcgcggcaggttcagtgccttgcgcatcaaggcgctggcgaatgccggatcgggtcggtccaggtcgctccacaaggtgagttccggcaacagttggctgtagagcgcctgggtcataccgggcagttgacgtacttcttccagcacccgaaacggtgcctggccctgtttacgacgagcctcgagggccttgaccaattgttgggcctgggccggtgtggcaccgcaggccagggccaagcgcagcaggtcatcagtatgggcgttgaccaggtacagcttgccgcgctcactgcgcaggcgtacctgtaggcgggcatcatcgaaggtcagcgcgatagcacgaccatccgccacccaatgcccatcggccatgacctgggcgatcccggcttcggcagccagcagcgtctgagtgtgctggcgatgccacagcgcctggcgactttccagctgtacccaacccaccagaccgccaagcaacacgctgagcaaggccagcacccacagcaccagcaacagcgccgcaccgcgttggcgcctcattcctcaatactcgcgctggacaggttcaggcgcagggcaatcacctgggtcacccacggcaccggcccgttgacgctggcgtcgatgcgcaccgcagcgggcaaccgcttgggccagggccatgtgctcaaccagccggtgggctggcccaatggcgagacaccacgaaaactgaatcgcagcgcctcgacgttatgcagcagcacctggggatcgtcgcgcaggggatgtttgtgcgattccggctgcgagaacgccacctgcaggtcctgctcgacccgttgcagggtaaagcgctggatgccaccgccgagcacaccgggcaaggtcgacacaaactgcaagcgctctggcgtcgcgataaaaaacccatcggcctggctgtcgtcctcagtcacatccaacggcagcgcctcgctgatggcagtgcgcaagaactgttgggcggcgcgcatttcatccaggctggcggtgtagccctgggccttggccaccgcccggttggcccctagcaacgcaccgcccaccagcagcaccaataccgagagcaggctgagcaccacgaggatctccagcaaggtgaagccctgctcgcggcgcttcactggcgtgccttcaaggtgctgaaacgggcctggtgcgagccttcgcgcaggctcaggtcgaggcgaaacagacggggttgttgtcgcgtgctggtcaactgccaatggatgccatcgagttcgccctggcgggtgccctcggtcagcgggccggccgcttcctggtcgagcaccgtgagcgcggcatgggtgaggcggtcgctgtgggccacttgcgacaacgagcgcgcactctggccgaaggcaaccagcaacacactgctgcacaccgccattaacgtcagggcggcgagcatttccagcaaggtaaagccggcctgctgcttcatggcagcgccttggactgcacgctgcccgtgagccagccaatgtcgatacgccaacgccgcgtgccgttggccagcaacaggttgccgccggtggagctgccatcggggtagaacaccacggcggcgcccgccgcctcggcactgtgcaacgtcacctgcaactgggccggccagtgtagcggcgcacgccctggggcctggaaagtcaggccctggaggtcgaactcggtgcgtgccgcctggccgctgataatcgcccccgcccgcgtggtgcgcagtgcctcgaccatctgcccgaccacccggcgctcctgggccacctgcagcccctggcgcactccgaacgccagcaacccggctgcgacgccgatcaatacaagcaccaccagcatctccagcagggtaaagccgcgctgggtcatgggcgggttattcccagttgcccaggtcggcactgtagccctcaccgccgggctggccgtcctggccgtagaagaccaggtcgaaggcgccgtgctcaccggggaagcgatagccgaagccatggccgaacgggtctttcaattccgaaggcttggcataggggccagcccagctggacgcattggccggtttgtccagcagctgttgcaggctgttgggtggcgcacccacgtccagggcgtaactgtcgatcttcatgctcaagctggccagttgcgccttgcccgcgccgtatttgcctttgtccacattgccgccgacctggcgcaccacaatggtcgcgacgatacccagcagcacgatcaccgcgagcatttccaatagggtgaagccgcgttggcgatgcctggttttcattgattcaactccatgaagattcatatatggctggtaaggctcatcagcggcagcatgatcgcgagcatgatcaccgccaccagcacggccatgaccacggtcagggtcggtaccagcgccgcgagcagacgctcgattgcgcgcttggcttcgatgtcaaagatgtcggcgaccttgagcagcatgctgggcagttcaccggcttgttcgccgacctcaatcatttgcagggccaactccggaagaagcggctggctgccaaatgcatcggccagggtgccgccgcctttgacccgttgcgccgccagcgccacttgcgcctgcagtgcacggttgctgcagacctgccgggcgatgaccaacgccggcagcaacgccacaccattgctgagcaaggtgccgagggtgcgtgtcaggcgggcagcttgtacccgttgcaacagcgggccgattacgcgcacgcccaacagacgacggtcaaaacgttcgcgccgaccggggtcgcgcaggcgtgctgccagggtccatgcactaatcaacaagccggccagcaacaccaggccatgagcgcccagaaactcgccaagccccaggatcacctgggtaatcagcggaatcggcacgcccagatcctggaagatcggcacgaattgcggcaccacatacgccagcaacagcgccagcgaacccagtacgccgaccaccaggaacgccgggtagatcagtgcgttgatcacctcgccacgcagtaactggctgcgttccagataatcgctgagctggcgcagggtcgcttccagcgccccaccggcttcaccggcgcgcaccatgctcaggtacaacggggaaaacgtaccgccctcttcctccaacgcgaccgacagcggcttgccggccttgacctgctcgcgaatgcgctcgatcagcgcacgcacctggggttggccgggttgcttgagcagcaggcccagcgagcgctcaaggggctggccggcgccgagcaacgtggccagctgctgggtgaaactcaccagcgcagcgcccttcaatgttccacgtgttttatgcaacaaggggctgcccgccgtttcgatatgcagcagcaaccagccacgtttgtgtatggcggcgacggcggcggcctggtcagcggcgtgcagcgtaccgctctgggcaacaccctggctgtccagggcgcggaacttgaacagactcacgcgtgctctccacgggtcacgcgcagtacttcttccagggacgtgacgccagcgagtgcctggcgcaaaccgtcttcatacaaggtgcgcaaaccgcagcggcgcgccgcctgctcaagggtggcggcgtcggcgtggcgcatcagcaggctgcgcaattcgtcgttcatcaacagcaattcggtgagcgcgctacggccgtggtaatcgccgcggtagagcaggatcgggcgctgctcggtcaatcgatcgaggccatgttcctggatcaatgccggcggcgcttcgaaggctacccgcgtggccgggtccaggcgccgcaccaggcgctgggcgaggatgccgctgacggtggaggcaatcaggtaactctctacgcccatgtcgagcaaacgcgtgatgctcgcagcagcgctgttggtgtgcagggttgaaaggaccagatgcccagtgagggaggactgcacggcgatgcggcaggtttccaggtcgcggatttcgccgatcatgatcacatccgggtcttggcgcacgatggcgcgcagcactccggcaaagtccaggccgatggccggcttgacctggatctggttgatcccttcgagttggtattccaccgggtcttccacggtgatgatcttgcgttcgctggtgttgagccgcgacaaggcggtgtagagcgtggtggttttgccagaaccggtgggcccggtcaccagcaggatgccgtggggccgttcgagcaggtcgaggaaggccgccaggcgctggccgtcaaagcccaggctggggaagtcgaactgcacggtttgccgatccaacaggcgcatcaccaccgactcgccaaaactggtaggcaccgtggacacgcgcaggtccagttccttgccctggatgcgcagcatgatgcgcccgtcctggggcaggcgccgttcggcaatgtccaggcgcgccatgattttcacccgcgagatcaccgccgccgatgaactggcgggcggcgcttcggcctcgtgcagcacgccgtcgatgcgatagcgcaccttgaactggttttcgaagggctcgatatggatgtccgaagcgcgctgttccaccgcacgttgcaagatcaggttgaccaggcgaatcaccggcgcttcggacgccatgtccttgaggtgctcgatatcttcaagggcgccgtcctgctcgtcgaggttctcgatcagggtgcccatggcggaacggccctggccgtaatagcgctcgatcagtgtgtcgacttcattgcgcgggccgacggccagccacaccggcacctgacaggcataggccagggcctggaacggatacagctgcgccgggttggcggccagtacgcgcagtcctccttcgctccagcccatgggcaccacttggtagtgccgcataaagcgctcggtcaagaccggcagcgggtcaagcagcggcggcgcggcgtcggccagcagcaacggcgcattcagcagatcggcccaggcacgcgccagctcgacctcggagaccaagcccaggcgcgtcaataaccccagcaggtcgcgggggtcagtggataatcgctgggcgcgctccaggtcgagggatttgagcccggcatgctgcatcagccacgcgcacacctggtcggtgtgcgggataggcagcttgcaagcatcaatgagggctgacgacatcatctgggaatatctaagattgcgaaaagtatggctatttggaactaccgaacaatgccattagttcgccacagcccatacgggagttagccgggggtatcgactggaagttatagcgctagttccggattacgggggaattaaatacaaaacattgccaaatgcactgatatagagcgtaagaagccaatagccactagttgcaattagccatactttttattaattcaggcactttcccgttcaattaaccggcaatgcaagaagatcgtgtcgggcctgctggcttggcccatcagcgcatgggtatctacacaacttcaggtgcatcgcaggcccctgtgggaggggcggtgcgacgattcgacttgctcccgatggcggcctggcagcccacctggatgttggagttagcgactattgttttgtcgccaagacaaaacggtgcacgaggccaccagccactgcgccaagcaaaggcatcacccagaacacccacaactgggccatcgcccaatcgccctggaacagcgccacacccgtactgcgcgccgggttaaccgacgtgttgcttacaggaatactgatcaggtgaatcaagaccagggcaaacccgatggccagcggcgcaaaacccgccggcgcctgtttatcggtgacgcccaagatgatcagcaggaaaaacgccgtgagcacacactcggtgaccgctaccgacagcaacgagaagcccccgggtgaatgctcgccataaccattggtggcaaaccccgccgttacatcaaacccggccttgccgctggcgatcaggtacaacaccccggccgcagcaatcgcgcccagaacctgagtgaggatatagggcaccacatccttgccatcaatacgcccagcggcgagcaaacccaaggtgaccgccggattgaaatgcccgccgcaaatatggccgacggcgtaggccatggttaataccgtcaagccaaatgccaatgccacgcctacaaaaccaatgcccaactcaggaaatgcggcagccaacacggcactgccgcaaccacccagcaccaaccagaatgtgccgaagaactcggcggcgagacgttttgtcatcaggaaactccttgaagtaggtcaaagagttggagcctaacaaccgggtatcggggttggatgtgggaaatttccttggcgcatgtctatgcggtttccagcgccactgaggtggttgccgctttcggcgccctgccgagcatggacacgggaatggccaggatcagcccgccactgacgaacagacacagggccaacacataggtgccattgttgatgttgccccgacaggttgccgatggcgttgatcatgccgataccggctgcagccgctacgcccgacaacaaggtccccggcagggtccagaaaatcggcatcaggctgagaatcccggaggcggcgacgctcaggaagagtacggacaacaccaggttgtcggcgaagaaggcgctgaagatcaaaccgaccgcccagtgatggtagcgaaatacgccggtccgaggatctttaacgaccaaccgaagcggtcggctttgttcgcgtgttagcgccaactagcgagcaaaggggcggttaatctatttgccgcaccgtcgcgtacctctgaaaccgttaatacccaaacaatgacttgttctccaggtattcttcaaaccccaactcgccccactcccgcccattacccgactgcttgtagcctccaaacggcgctgcctggtcggcccgggcgccgttgagatggaccatgccggtgcgcaattgccgcgcaaccctacggctgcgttcaagactggccgaagtgacgtagcctgacaagccataagggctgtcgttcgcgatggctatcgcctcggcttcgctgtcgtacggtatgatcgccaggaccgggccgaagatttcttcccgcgccacgagcatgtccggggtgacgtcggcaaataccgtaggttgcacgtagtacccgcgctcaatcccccgtggtcgtcccagtcctccggcgatcaatcgcgaaccctcggcgatggcctgaacgatcatggcctgaacccgttcaaattgcagggcgttcgccacagggccgatggcgcaggtcggctgactgtcgtcgaaacacacctgcgccagcacttcccggacgatatcaatcacagcctgttgctgcgcgcgcggtactagcaagcgcgtcggcgcattgcacgactggccgctgttacggatgcacgcctgtaacccgtgacgcaccgcgctaggcagataggcgtcgtcgagcagaatattcgcggatttgccgcccagctcctgggacacacgcttgactgtatcggccgccgccttggccactgcgatgccggcgcgggtcgagccggtaaacgacaccatatccacctcggcatggctggccagcgcagcgccaaccaccggcccattaccgttgaccaggttgaacacccccttcggcaccccggcctcatgcaggatttgcgcgacgatatgcgccgacaacggcgcacactcacttggcttgagtacgacggtgcagcccaccgccagggcgggtgcgagcttgcaggtgagttgattgagtggccagttccaaggggtaatcagggcgcacacgccgataggctcacgcgccactagcgtctggcccatgcggcgttcgaagcggtaatcgcgtagcacttccagcgcctgcaccagatggcccaggcctgccggcacatgtgcactgcgggccagggacagcggcgcgcccatttccaggtgaaccgcttcgaccagcgcttcgctgtagagtttgtaggcctggataatgcgttgcagcaggtcgacacgcgcctcaagcgaacttgctgcgaacccggcaaacgcttgcctggccgcgccgactgcgcggtccacatcgtggctgtcgccaagggtgatgcgcgcaaccacctgctcggtggacggatttaccacgggctcaatggccgtgccgtgaggcttgacccaggcaccgtcaatgtagaactcaaacagatccgacataccttggactcccttcaggcgacgtgtttcagggcagtcgccagggtttcgaacacctgggcgatctcctgcgggctgatgaccagcggcggcgaaatcacaatggtgtcacccgagccgcgcaccagcacgccgttgtcgaagcaccactgcgcaacctcgctgccacgcgcgccggggaaacctgggcgcggctcgagctccaccgcacagagcaaaccgatcgcgcgaacgtccagcaccgcgccgatgccttgcagcgcgagtgcggtcgactgccacagcccactcaccgcgttgacgtgctggttgatgcccaattcacgatgcacctccagggtcgccaacccggccgcacacgccaatgggtgcgcggaataggtgtagccgtgcatcagttcgatgacattctgcggcccggccatgaacgcttcatacaccgcgccactgaccagcacgccgcccatgggcacggcgccgttggtcaggcccttggcggtggtgatcaggtccggcagcacgccgaaggcttgcgcggcaaagggcgcgccgacgcggccaaaaccggtgattacctcgtcgaaaatcaacagcacgccgtgccgtgtgcaaatctcgcgcaagcgttgcaaatagccttggggcggcgcataaaccccgccggagccggtcaccggctcgacaatcaccgcggccacggtgctcgggtcctggatatccagcagttgtgtcagcgcatcagcgtaactggcgccctgctgcggctgcccaacgctgaaacgcatgcccgcgtcatagggcaatggcaggtgcgagacctcccccagcagcgggccaaagtcacgtttctggcgaccgataccggataccgacagcccaccgaagcccatgccatggtagcctttggcacgcccgataaatttggtccgacggcaatcaccacgcgcctggtgatacgcccgcgcgatcttcaacgcagtatccaccgcttcagatccggagttggtgaagaacacctgctccataccggcggggctgatgtcgatcaggcgctcggccatttccagggcctggggatggctcatcttgaacgacgagacaaagtccaggcgccccgccgcttcgcgaatggcttcgactattttcggctggccatgcccggcgttcacgcaccacagccccgccattgcgtcgagtacgcggcgcccatcggtggtggtgtagtgcataccgtcggcgctggcgaacatcatcggttgttgctggaactggcgcatcggggtaaatggcgcccagaacgcgccgcgcgcggaaacagaagggttggaaaaatcgttcatggcgactcctgcaaagcgatgattggatggccggccagcgtcgggcgctgcaacgggcctgcgtttacgttgacgctgcggtccacgtacaaggtgccgtgttcgatacggcaggtgacccgatcacaaaacgccgtctcgacaaactgccaggtcatgctcaacacccggtcttcggtccagcgcgcctgcgccaccacgggggtgagttccggctggtattggtgatgcagatagtggccggtcatgctggtctgggtttcgatgccggcgctcaacccggcacggatgcaatgggtgccacgggggtcggtgaggtaaaagtcacaatactcaggcccgaactccaggcgcacttcgctgacctggtcttcgttggcctgcatggcaaacgtagtgctgaattcagcctggcgcggcgagctcgcggcgccagacatgactggccgttgttgatgggccagcagcgccgccagcgcggcatccgccgagccttcactgggtacgtccagcgccggcaaaagatgctcccagagcaggctgtgcaagcgccgctcgcccagggcgagtcccgcggtaaacgcaatcaccgcgttatggcgcggtagcacaatgcactgctggccaaacacgccggaggcgtaatacccaccgtgcagggtcatccaccactggtagccgtagccttcgcggcgcgtgacagccgcgccgctcgactcgtcgcgactcaggtagcgcttgccatcgaaggcgcccatccatacatcatcgacgtgcccacgggtcgcttcggccacccattctcgggacagcaattgctgcccctgccaattgccgtgttgcaagtgcaacacgccgaatttgagcaagtcttcggtgcggcaactgaggccattgccaccggtgttgaaaccgccaggagccaggtcccactcgatggggcccatgcccatgggttggaagatacgtgcgttgcacagctcgaacgccgtctggccactgactacgctgacaatcgccgagagcatgaagctcgacgcactgctatagataaaccggtgccctggcgggtcttcgaccggctcattgaggaataaccgcacccaactgtcactgcgcccgcgccaggcgccaccagaaatgccctggcgatggccggtgcgcatggtcagcaaatcccgcacggtcatggccgccaggttggcgctgatggatgccgggcaatcggcggcaaaaaaatccaccaccttggcgtccagcgacagcacgccgtcatccaccaacagcccgacggccatggacacccagctttttgtcgccgaatgctggacatgcaggcgttcggcgcaataaggcgcccaaaacgcttcggctaccaccgcgccatcgcggtacagcatgaagctgtgcaactccaggtccgcagcgttcaccgcttcgatgaaatcacttacgccacgcgccgatacgcgttgttgactgggcagtgcccgccgcaacagcaaactcgtcatctgatctatcccctctttccactgcttgggcgtgcaacaggctgttcctgctgcacgccattaccgctaccagagcgccacggtgtagcccaggatcactctgttttcgttggtgtcacgggcgaagttgctcgtcgcgctggcgttctgccaacgcagcgagacatccttgaacgtgccgctctgcaccacatagccgaggctcaagtccctctcccactcgcgtccttcgccgttgaagccgatgaccttggcgttgtcgcccttggcataacgcgtcgagaacagcaggcccggaatgcccagcgaggcgaagtcatagtcatagcgggcatgccacacgcgctcgccggtttgggagaagttggccagttgatactcggtgaacaggtaggtgttggtgccgtccacataggtgaacggcgtcgagccgtactgttcctggtaaccgccgctgaggttgtggccgtagaggccatagccgatgcgcgtactcaacgcccggttatccaccttgccggccaggcctgcagcgtcttcactggcgctgaaatagcggatatcggtcttgaacgtgcccgggcccaacttaaagctgtttttcaagcccaggtaatgctgttggtacaggctttccagttgcgcgaactggtaggtcacaaaggtcgtcggcgtgagtgcgtactcgccgccggcgtagcggaactcatcgctcttggcgctgcttttgtaggcgccgtactggctggtaagccccatatcctcgtagtgggttgagtcgcgctgcttgacctggtccagttggccggcggtcagggtcagcttgtcgatgtccttggaggtcactgcggtaccgctgaaactctgcgggaacaggcggctcaggttcggctgcagcgtcggcaggtcaggcaccatgtaacccacgcgcaactcgcttttggccaggcgcgctttgccggtgaggcccagttttgagtagttgtcatgggcgcggcgggcgtagctgggggagcctggctcggccatgctggagcgtgccagcagcccggtgccggagttgtccgggctcgaatcgagcttgatgcccaacatacccaccgcgtccaggccaaaacccacggtaccgccggtaaagcccgactcgagtttgaggataaaaccctgcgcccattcggcacgtttgttctgcccgctggactcgcggtagtcgcggttgaagtagtagttcttcaactccagcgccgctttgctgtcggcgacgaagtcggcctgggcaaacaagggcatgaaaccggcgctcatgacgctggcactagcgacaactttgttgatgcggttattcatgtgtaggttcctggcagacaggttgagtggggttgtttttgttttcttcggccatggcttcgcccgcttcgcaaatcgtcgatttgcgaagggctgggtttaatgccgtggcctggggtgcagcagtacctaaatcacactggcacggaggcgatagctgccgtccgcacgtttctccaaggggctggccgcggcgagtagccgacgggtgtaagggtgttgtggggcgtcgaaaatcgcgtcacgcgggcccatttcgaccacctcgccctggttcatcaccgccacacggtgggcgatgcgttccaccgctgagagatcgtgggaaatgaacaggcaggcaaagccgtattggcgttgcaagcgctcgaacagttcgaggatctgcttctggatggtcatgtccagtgccgaaatcggctcatcggcaattaccagcttgggccggcgcaccaacgcccggccaatcgccacgcgctggcgctgaccaccggagagttgatgggcaaaacgctcgcgatactgttcgggcaggcccacgtcgaccagggtgtcggtgacccgctggcgcttttgcgcggccgtcagggcgggttcatggcgcagcggttcggcgaggatctggccgacagtcatgcgcgggtcgagggacgaatacgggtcctggaagatcatctggcattgcaggcgatgtacccggttggcggctttgaggatatccacgccttggaacaggatcgccccggcacaggggttgaccaagccgacgaccgcacgcccgagggtggtcttgcccgaaccgctgccaccaaccagggccagggtctcgcccggcgcgatactcaggctcaccgagtgcaccacgcgcttgggcacgctgcgcccccagaagctgcgcggccccgggtgttcgatacacacatcccggacctgcaacaacgcgctgtcggccgccggcactggcaccagctccccgcgccggggcagcgcttcgagcaattgccgggtgtattcggccttgggcgcaaagaggatgtcttcgatacggccctgctctactgccttgcccgagcgcatcaccaccactttgtgggcataacgcgccaccagggacaggtcgtggctgataaacagaatcgcggtgccctgctcgcgagtcagttccagcatcaactcgatcacatccagttgcgccaggcaatccagggccgtggtgggttcgtcggcaatcagcagcgccgggcgcagcagcatcaccgaggccagcatgatgcgttggcgcatgccaccggagaattggtgcgggtaggacgccaggcacttttcggcgtccttgatgccgatgcgttgcagcatggcgatgcagcgctcatggatcgtcgccgcatccagcgtggtatgcagtttgagtgcctcgctcatctgccggccgatggtcagcgcggggttgagcgagaccatcggctcctggaacaccatgccgatccgtgcgccacgcacttcacgcatggccttggcattgctgctgtccagggcctggccctgaaagatgatgcgcccaccgcacacctgcatcggtgctggcagcaagccaatggcagcgcgcgcggccatggtcttgccgctgcccgactcgcccaccagtgcgacgatctcgccgggggccatggtgaagctgaagtcatcgacggccagcggaccgtccacgccgacgcgaatctgtagattttcaacggccaacaaaggcgcgggtacgctcatgctcatttcctcatgcgcgggtcgagacgatcacgcaaggcatcgccgaacagattgatagcaagcaacgtcaggctgataaagatgcccgggaagatccccagccacggcgcgttcgagatataggtgcggctcgccgagagcatgctgccccaggtcgcggccggtggtggcacgccaaggccgaggaagctcagcgcgctctccgagagcaacgcccagccgaacatgctggtggccagcacacacaacggcgcgaggcagttgggcgtgatgtggcggaacatggtgtatagctcggagttgccgatcacccgcgacgcctcgataaactccagctcacgcaatgacagcacactgccgcgcaccacccgcaccaccgaaggcgtgtaggcaatgcccagggcgagcacgatgccgtactggctggccccgacaatcgccatgatgcccagggccatgaggatgccggggaacgcgagcagcgcatcgttgagcatcatcaggatgcggtcggtccagccgcgcaggtaaccggcgagcatgccgatcagcgtgccgcagaccaccgccacactcaccgacagcaggctgatccacaggctggtgcgcgcaccgatgatcaagcggctgaacacatcccggccaaattcatcggtgcccagccagtgcacggcattcggtgcgtgcaggcgcgagagcaggtcgagcttgagcgggtcgtatggcgtccacaccacgccgagcaaggccaacaacaccagggctgcgagcaagccgccgccaatcagcgcattcagcggcgggtagcgtcggcgtcgacgcggcgggatcgccgctacgccgggcaaggcaggcgtcttcaagttcatagcttcacccttggatcgaacagcggatacagcagatccaccaacaggttgaccaacacatagatgcaggtgatcagcaacagacagccctgcaacaccgggtagtcgcgggagaagatcgcgtcgaccatcagccggccgataccgggcaaggtgaacacggtttccagcaccgcaatgccgccgagcaggttgccgaggatcaggccgatcagggtccaggtcggtgcgaaggcattgcgcagggcgtgtttccacagcaccgcgccctccgacaagcccttggcccgggcatgggcgatatattccaggcgcaacacttcaatggtgctggcccgtgccattcgggcgatggcgccgaactcaaccagggtcagggtcacgattggcagtaccacataagtcagcgctttcatcgggtcgctgccaaagccgacgtagccgatcaccggcagccagcccagctggataccgaacacgtagagcagcaacaagcccaaccagaagctcggcaccgacagcaacagcgtcgccgtcaccaccaggcccaggtccatcgcgctgttttgcttccaggccgcgagcagacccaccggcaccgccagcagggttgccaacagcaccgccaccagcaccactgtggcgctgacgctgaagcgttccaccagcaaatccaaaaccggctgacggctgctgatggacaccccgaggtcgccactgagcaccgactttatccagatcaggtactgggtcaccaccgagtggtccagccccaggctgctgcgcatatcggccaggctttgcgggtcggccatgtcgccgagcatcagcaaggccgggtcgccggggatcaggcggatcaaggcaaacacaatcaccgagatcagcaacagggtcggcaccgccatgccgagcctgtgtgagatgaatcgaaacatagcgctacgccttacttggaagtgtcggccagcttcacgccccacaggcgcggcttggcaacaggccaggaacgataaccctcgacacgcttacccatggcgccgatggcagtgccgttatagatgaccaccatcggtacatccttgagcatcagcctgtgcagttggtcgaacaggggccggcgcttggcgggatccacttcgcgctgggcctcacgcaggatcgccagggcctcggggttgtcccagactttgcgcggttccttgtccttgtcgccgatcaccgattcgtagctttgagccgcatcgaaacgtcccgaataggagaacgacatcatctggtagctaccggtctggtaacgctccaactgtgtgccccactccagggtttccatctcgatgttcagccctgccgcctgggtcatggcctggctgagcaaacccatgtcgaacatctgcgggtagcgtttgttgaccagcatgcggattttttcaccgcggtagccggcctccttcaacaggcgccgggcctcgtcgaggttgtaggtataaccctggtgcgcggtgctgtcgtagtacggactcgcagtgggaatgattgagttgttgaccatcgacaagccgtcggacaacgccgcgaccatctgcgagtaatccagggataacgccaccgcacggcggatgcgcacatccttgagcaacgggtcgcgggtctggaaaagcaggccgctgatggtcatgatcgggctgacctggacctgcagattcttcacctgcttgagttgcgcagcgtccatcgccgtgacatccggcagcaggtccacgccacccgacagcaacgcggccttggccgaggcggaatcggggatcacttcaaaccgcaccttgtcgacaaacgcctgcttgttgccggtgtagccgtccgccgtggcctcggcccgtgagctgtagtccttgaaacgctccagctcgacgtactggcccttctgccatttgcccagggtgaacggcccggtgccaatcggtgcgcgccaactgccatcggcagccagggagtccgggtgcaggatgccgctgccggcacaatccgggcgagccatggcggcgaggaacaagccgttggcctggtccagggtgaacaccacggtgtttgcgtcgggagcggcgacatcgacgatcttggccgcaccgcgcccatcgaactccgccaggcaacgccactgggtcttggggtcgaggtaacgctgccaagtccattgcacgtccttggcggtcagcaactggccattctggaagtgcacgccgtcgcgtagggtaaaggtgtagcgcaggccatccggcgacacggcgaccgcactggcgagcatcggcgcgacgctggtgtcttcgcggtacgccacaaggccttcgacgatatgcatcattaccgcatcggtattgtcatcacggttgacgcccgggtcggtgctgcggatatcaccgttgaggccaacgctgatgaccttgtcttgggcgacggccatggaaaacgtgcacgccgatagcgcgacggccagtgccgtctttacgtaattgttcacgggagaaagactccttgaaggaatgttccggccgttggcgtgggccaaggcaggaccggcatcagaatgagtgaatccttggttattgttatacggtctgttctgagtgcagcgtgcagcggtgaatcagcccaggctgcgcttgtggcgcaacaccttggcgaaaaaatcctgggccgccggcatggccttgatgccctggtgcgcgacgttgggcagcaggtcaaagtgcacctgcacaccagcggcctcgaagctggccttcaaggtagccagacgttccggtcgcgtacgcccggcagcgttggcaccggccatgtagtgcttgccgccttcacggtgggtaatttcccaggtttcgaggtctgaatcccctaccaccatatgcacgggcaatcgccgcaaagctggcaggttcaacggtttgccaaagcgtgtggcaaagtcccgcacgccgacccaccagtcctgattggcatcgagcagggtcaccgaacccggtgcgccgatggacgccgcccagagtttttcgggatgcaggtagcagaagcgatgggtgaattgcccaccaccggaatagccgaacagtgcaaaggtatcgaagctgcgaccgtagcgcttgccaacgctggcgatcatgtcgagcaacacttggtcgtaacggatatcgccttcgaccatctgcttgtagccatccccattgccgtcgcccaacacgccgaccgggaacagcggcgacaggatcacacaatcgttccagcggccaaattccgcgaaaccattgcgataaatctccatcgcgcgggtcgagccgtgcagcgaaaccaccaggtctaccggccgggtgcggtcctcgatgctttcaggcacgtaaagggtgtaggcaaaccggctgtcctcatagtgggagtacacggtggtggcgccgaggtgatacacgttttttgccgcacgtaatgctgcgctttcagggctgatatctggattgctcatttggaaagttcgccgagtcagttcggacttgagtattggtcgagcactataaaaagaaaaactaatttaactttaaccagagtaaacaaaagctttactatgccggcgtacccatgagcgcgggcctacccatgagcaacattcgtttcttcaagacgtttatcgccgtcgccgagtacggcagttttgccgccgccgccgaccgtgtggccctcaccaacgccgccgtcggccagcaaatgcgcgccctcgaagaagagatgcgccgaccgctgttcgaccgtagtcagcggcagatcaagctgagccgcgatggcgtgttgttgctgcccaaggccaagcgcctgttggcggactacgagcaaatgattgcagaggcgcccgatggcatggccatggaaggtgaagtgtccatcggcggcattacctccggcatgggcctgctcgccaattgcctggtgcaactgaaaaagctgcacccgcgcatatcggtcaacctgatgaccgcccgctccgacgaagtggtcaacctggtacaggttgccaagctcgacgcggcattgctgatcgagaccgcgcggcagaacttcgatggattgagctggaccctactctacaacgagcccatcgtcatgctcgccaatactgcgcaaaccgcaggcatcaatgacgctgtggaactgctcaggacccagccgttcattcgctatgaccgttccaccgccgtgggccgcaaggtgcagtcgatcatcaagagtgaatcggtcgaaccgctggaaatcctcgagctgaactcgatcatcggcatcgcagacctggtacgccagcaagtcggagttgctattgtgccgctgctgaaaaatttcgactggcacaaagacccaagcctgcgtgtactgccattgccgggagacttggcggtgcgccgagtggggatcttggagcaaggcaccaaaagtgcaattaccggggaaattcgcaagctgctgatgtcggctgtggcaacgtaatcatccccttttgcctgtagtacacagcccctgaaatcgcagacaaagaaaagcccgcgatggggcacgggctaagaggttttcaccaggagctggagtaaccataaacacatgaatgtgaagaggacgtgaaaggttgtactcagtacgccacgacgatcgctcgcgccaactgcatgtcagacattagcggcgagttgtaggtcgagcgatagtagcgagaagcctgctcaaactgcgcgccgcggatctcaccatcagagcctatgaatgcgagcgcatcgttcttggcttttttcatcaacgagggaccatacattgtaaatgccgttgttccaccgaggatcatggtcggaaacagcgtcgtgacggtcagcgcccgctctactggattttcgacataccacgccattacgtcagcactgatcgacaccgtgatgatggctgccaaggcgccaggacgaacgcccggtcgctgatggacccgacgtgatcggctttcaacttcaatccgcactcgcaccaaaggttacgcaatagtcttgtatgcctcctgcctaggcctgattggttagtttcagccaatcaatgacttacttgtcgaggcccttatgtcacttacccacaccgcctgcgtcctcctgtacctcctgttgctcggcactgtctggcccagccacgccagagacttggccgagggacttactgaacagtcgccttccgtggcacttgaaaataaaaaccaacggtacccgcaatggaccggcatcggctcactgaaaaacgccttaggccagacctgcaatgccgttctgctcgacacgcgcaaccgccagggtaaggccgtcggcccggcttatgtgctgaccgccgggcattgtgtgttctacagctacggtacagcgcgcgtgcgccaggcgtttaccgctgatgtcaccttcaattactttcatgacacgccagaacagcgtgtcacctatgccgtcaagacagcgcattggagcagcatggcgggcactgacctggccgtgctcgaactggatacatcactgggcgtgctggtggccggcgcgatcatgccactcaagctggcctcccaacggcagacgtcggatcgagacgtgatcaacgtgggagcgccgaccggattcctgaaaaaaggcctgcgcatgagtgcctgcgtagagtcgaccctcaacagttttgccgagcaccccggcgtgttccccagcgccttgcgcaaccgctgcaacggcctgcgtccaggcagctccggcagtccgatgctggaccgtaactccaatgaaatcaccagcatcatcagcaaagtcgcgtctgccattcagaaggacattctcaatagctgccagaacaactcggcgtgcgaagctgccaaattcaactacagctaccccgccaacgacttgtactactgctttgtagacggcgttttccgtaacgacaccccgacctgccagctcaaggccgttgaaatcacgctggacgaaccgtggaacctgaaaccctatgtgcatttacaacgtgacgccgccgacaaaattattcgtccgacctggaacctgaggttttcaatccaggaaccgttctaccgattcaaagccgtgaatgacatcagcgattgcgcacgcacgcacggttaccaagtggctgccgcctctgatgaggcctacatcaatcagcccatcggcccagagctggggccgcatgtgctgtgcatactcggggtgcaaaaggccgagcagccgctgaccgaagcgctgctgcgcaatgcgttcacccattcggtattcctgaccaacccggcaccggcaccgcagctcaagcaccgctatcacgtcgcctgggaaacccagtacaacggtttcagccagcattactactacagcgtgaatgcagcgatcagcaccatctgtggcgatattgacgacgatcgctacaccctggccatggatggcattttcattgacatagcagagctgccgatcatgttatgcagctatgcacgcaacaacggtgggcaaccgtcggccattcgcacggatgtgatcagaggcgcaacggttcgctcacagcgtcatgccaggtgatgcggcaatttttttccagcaacttctggtgtttagagggctttagcatggcagccacagccaagctggttgcgcttcgcgcaatgcggcatgcctggcgcaacattaaaaggccgcctaagcgggtcatgcggttcaagtcagttatgtttcagcaggaccgagacgtgctcgatcaatggcctcgtccagaaccatctcgagacgcgccatcttggtactgatcgaatagttagcgccgtgggtggttgcccggctactaaagtcgagattcgctgcctgcatagattcaactaacccctttgcctgctcaggttcctgttggcagaactcgatgaccctcaggttaattttcttgaatgtttcggccaaggcacgactgaatctgcccgcattctcattggtaaatgccacaaagtatttggcgatactacaatcgggggagttgagatggcactcagcgcacaagagaaagcaattgaacggcaaatgtgtaccgcccagggaatgcgcaattatgtgcgctacttcttggtaacccgtgacgccacagcaccagcaaattcgcaaatcttcatgatcgtcctcgatggcctctcggacatattcacaaaaaccatagtcgtctacccactgcaaattctgcagccatgcattacgcaccgtagtgcgagtgaccgtccgacgctttggtggaagctccattagctactttcctgccacccgactcagatgtgtcgatcatcgcaaacctgcccttccaaaagccagtggtgccaaacctttcatctgtacccaggcaagttgcgcgacgttgctattcaggcgcacccgccttggcgatcaactcacgcaaccgggaatccttaggctcaaacacatcgaggagcccgatcgccttaagagcgggtaaagattgaataatctctcgctcagccagcagttgatcatccatgctcgcgtccgaatcactccaaacccgtacgtttgccaaaaaggcacccaccgtccccttacgtacggtcactccttcaaatgttgcttcgtttgtgtcgtcggcgagaatatcttcggcacgcatatcagtctccgcagttgggttgctttaacttttcggcctttcggaaaagagcctcatgccgacaatagcgtaattattttgcgctggcatataaatgcaaacccggcgcttggccgggtccgttgatctgaatgctcagttgtcaggatgctcactggctactgaatcggcagcgtccacgtccgacatatcttcctcgaggggtgcctcgtcatccggtggcagcgggatatgatcctcatcgcgctttggatcatgaccggtctcattgtccgtgccacgcgttactgcctgctgtgaaatattgcctggggcgttctcgttgatttccatgctgtctctccgctgtaaaagcacgacaaatacgcacttaaaccattggagtaggcctgtagcagcgagtgccgggcattggacgaacggaggatcggaaggctgtgttggggcgtagggttggtagctgctttgcttaagcactcctacaatcaatccagcggttatctcctagggaatttgaaggcaagaaacggatagcgagcctgcgagggtgcctgtcttatgcgcagacacaaacgacaggagccgcacatgacttttcgtatttccggcctttctccagagccattcaaggcgctatttgggctatctgaccccgagctggactcacttaacatcaagcgctaccgcgtggacaccaggccaggattccctgatcgcatcgaaatgaaggaggccgagataggccagaacgtacttttgctgaaccatctctgtcagcccgcccacacgccttaccgtgcctcacacgctatattcatacgtgagggtgccagtcagcaatacagcgccatcgatcatgtgccgaatccgttcgaattcgcctcctgtcactgcgcgcttacagtgagagcggaatgatgattgatgctgatgtggtcgaaggggcaactgttgaggagggaatagctaggttgttcgctaacccggaagtcagctatatccacgctcataacgcaaaacgaggttgctactcctgtcggatagatcgcgtgtgagtgtcgttgtaggagagcactgattcgccagatacaagaagcccagcgctgggctgggcgtctctatttcattgatcgttttcgtctaaatcaagcatcaacgtatcctccgaaccggggatgaatgctattcagtttctcaatgaagcctgggcaatccctgctcagcttaattatggtattgctcgttcaagaccgggtagttttacgcaagtattgcgcggtttttgctcaggcacaaaaaagccgatctatctgatcggcttaagtgtctgattttactcaggaataatggtcgggacggagtgattcgaacactcgacccctagcaccccatgctagtgcgctaccggactgcgctacgccccgactaggcgtgttactgggttcgcttcttaacgaagcgaatcggaatataccgcaagcttttgaaatgtggaagtatttttaaagcttgaatcatttcttcagtaccaccagcacatcttccagttcggagatcatctggcggatcagttgcttgtactgggtggtgtcgtctttggcttcatcaccggacatacgctggcgtgcgccgctgatggtgaacccctggtcgtacagcaacgcgcggatctgtcggatcatcagcacatcctggcgctgataataccgacggttcccggtgcgtttgacggggttgagttgaggaaactcctgctcccaatagcgcagcacgtgtggttttaccgcacatagctcgctgacttcaccaatggtgaagtagcgtttgcctgggatgacgggtagctcgtcgttatgacttggttccagcataagcctcaactcgggcctttaacttctgccctggacgaaaggtgaccacacggcgagccgtgatcgggatttcttctcccgtttttggattgcggccaggccgctggcgtttgtcccgcaggtcaaaattgccgaaaccggacaacttgacctgttcgttgtcttccagagcgtggcggatctcttcaaaaaacagctcgaccaattccttggcctcgcgtttgttcagacccagctcttcgtacagacgttccgccatctcagctttcgtcaaagcccccatacgtcacttccttaacgtggcgtttaacctttgttcgagcgaggtgaggatattttgtgtcgtggtattcacctcatcgtcattaagagtgcgcgatggatgctgccaggtcaagccaactgcaaggctttttctatgcggatcaatgcctttaccctgatagacgtcaaatagcctgaggtctgtcagccattcccctgcattttcacggattacgtccaggacggcagtggcggcgacgtcacggtcggcgatcagggccaggtcacggcgcacttcagggaagcgcgacaactcgctgaatttaggcatcttgcccgtggcaacttcagccaggaccagctcaaaaacgaagactgggcgatccagccccagggttttcgacagttccggatgaatagcaccaacaaagcccaccaaacgaccttcgcgctcgatacgcgcagtctggcccggatgcaatgctgggtggctgcccggcacaaaggtgaaggcatccagcgcaccggcaaagcccagtaccgcttccacgtcagccttgacgtcgaagaagtctacgacctcgcggccctgcgcccagccttccggcaggcggctaccgcagacgacgccggccagcatcggttcctgtttaagaccatcgagctgacccacaaaacgcaggccgctttcgaacagacgcacgcggtcttgctggcggttcaagttgtgggaaagcgctttcaccagacccggccacagcgacgaacgcatggcggccatatcgttggagatcgggttggccagcaacagcggctcaacacctgggttaaacagctcgaactgctttgggtcgatgaagctgtaagtcacagcttcctgatagccgcgggctaccaacagacgacgcaactctggcagggccgcacgcgcctcggccttcggctgtggcgccaggcgcgcttgcgggtaacgaaccggcaggcggttgtagccgtacaggcgcgccagctcttcgatcaggtcgacttccaggctgatatcgaagcgatgacttggtacttcaacctgccactgcccttccccactcgaggaaatgcccaggccgagggccgacagcagttgctcgatttcagtcggctcgatcaccaggccaagcatttgctcgacgcttttggcgcgcagggtgatcggcgcaatcgacggcaggtactgttcgttgacggtttcggtgatcgggccggcttcgccgccagtgatgtccagcagcaggccagtggcgcgctccatggcttcacgggcaagcttccagtccacgccacgctcgtagcggtgcgacgcatcggtgtgcaggccgtaggaacgcgccttgccagcaatagcgatctggtcgaagaatgcgctttcaaggaacacgtcacgggtggtcgcggacacgccgctgtgctcgccacccattacgccggcaatcgccaaggcgcgggagtggtcagcgatgaccagggtatcggcacgcaggctgacttcctgaccatccaggagtaccagcttctcgccttcttcggccatgcgcacgcggatgccgccgttgatttcggcgagatcaaaagcgtgcagcggctggcccagctccaacattacgtagttggtgatgtcgacggcggcgtcgatactgcgcacgtctgcgcgacgcaaacgttccaccatccacagcggggttggcttggacaggtcgacgttacggatcacacgccccaggtaacgcgggcaggcatttggcgccagcacgtcaatcgagcgtacttcgtcgtgcactgccggcacggcagcgacgactggacgggcgacaggcgtgttgtacagcgcgcccacttcacgggccaggcccgccagggacaggcaatcgccgcggttcggggtcaggtcgacctcgatgctggcgtcttccagttccagatagacacgaatgtcctgacccactggcgcgtcggccggcagttccatcaggccatcgttgccctctcccacctgcaactcggcctgggaacacagcatgccgttggactcaacaccacgcagcttggccttcttgatcttgaagtcgcccggcagttgggcaccgatcatcgcgaacgggatcttcaggcccggacgcacgttaggcgctccgcacacgacctggaaggtttccgcgccattactgacctggcacacacgcaacttgtcggcatcgggatgctgctcggtgctcaacacctcgcccaccactacaccgctgaaaacaccggcggccggcgtaacgctatcgacctcaagaccggccatcgacagacgcgcaaccagctcgtcgcgacttacctgcgggcttacccagccacgcagccattgttcactgaatttcatcctgctctcctaaagattcgttacgactagcgaaattgcgcaaggaaccgcaagtcgttgtcgaagaacagacgcaagtcgttcacgccgtaacgcagcatggccagacgctcaacgcccatgccgaaggcaaagcccgaaaactcttccggatcaatcccggacatgcgcagcacgttggggtggaccatgccgcaacccataacttccagccaaccggtctgcttgcagacgcggcagcctttgccgctgcacatcacgcattccatgtcgacttcagccgatggttcggtgaaagggaagaacgagggacggaaacgcaccgccagctccttctcgaagaacacccgcaggaattcttcgatggtgcccttgaggtcggcgaagttgatgtcgcgatccaccagcaggccttcgacctggtggaacatcggcgagtgggtgatatccgagtcgctgcggtacacacggcctgggcagacgatgcggatcggcggcttgttcgcttccatggtgcggacctgtaccggcgaggtatgggtgcgcaacaacatgtttgcgttgaaatagaaggtgtcgtgcatcgaccgggccgggtgatggcctgggatgttgagcgcctcgaagttgtgatagtcgtcttcgacctcagggccttcggcaatgccgtagccgatgtgagtgaagaactgttcgatacgttccagagtccgggtgatcggatgcagaccgcccgaggcctggccacggccaggcaaggtaacatcaatggactcggcggcgagcttggccgcaagatcggcctcctcgagcgacgccttgcgcgcattgagaacctctgtgacacgctccttggcgacgttgatcagcgcaccgacttgcgggcgctcttcagctggcaaattccccagggtcttcatcacctgagtcaattcacccttcttgccaaggtagtgaacccggatttgctccagggcgtttacatcttcagcgctttgcacagcctcgagggcttgggcgacgagcgcgtccaggttttccatgtacagactccagatacaaaataggggaagagcttgaaggctcttcccctatttatgacgtttaacaccttgggctacaggagcagcccagggtgactgtcgggggtacttaagccaaggtggctttagctttctcgacaatcgcagcaaacgccgctttttcgttcactgccagatcagccagaaccttacggtcgatctcgatggacgcttttttcaggccagcgatgaaacggctgtaggacagaccgttaacacgtgcaccagcgttgatacgagcgatccacagagcgcggaactgacgttttttctgacgacggtcacggtaggcgtattggcctgccttgattaccgcttgcttggcaacacggaatacgcgtgagcgtgcgccatagtagcctttagcaagtttcagaatttttttgtgacgtttacgggcaatgacgccacgctttacacgagccatgagttacttcctctattcttgatccaaaaattaacgaaggcgcagcatgcgctcgacttttgccacgtcagacggatgcagcaagctgctaccgcgcagttgacgcttacgcttggtcgacattttggtcagaatgtggctcttgaaagcgtgcttgtgcttgataccgttagcagttttcagaaaccgcttagcagcaccacttttagtcttcatctttggcatgttcggatactccgcattcagttgataaacataatcagaaggcctgccgtgccctgttgattacttcttctttttcggggcgatgaccatgatcagctggcgtccttccatcttaggatgctgttcgaccgaaccgtactcgagcaggtcagcttcaacccgcttgaggagttccatccccagctcctggtgggccatctcacggccgcggaatcgcaaggataccttggccctgtccccatcactcaggaaacgtaccaggttgcgcagttttacctggtaatccccttcctccgtccctggacgaaacttgatttctttaacctggatctgcttctggtttttcttggctgcggcaatctgcttcttcttctcgaagatcgatttgccgtagtccatcagcttgcagacaggcggtacagcatcggcggaaatttccaccaaatcgagcttggcttcttcagccttaagaagcgcgtcttcaattgacacaatcccaagctgctcaccctcagccccaattaaccgaacctcgcgtgccgagatattctcgttgatcggggctttcggtgcagctcgtttatcttgtctcatttcacgcttaatagtaattactccgaatctgggcgaccacgccgggaaaccgcttgcgcgaggaactcagcgaactgggcgacgggcatcgagcccaggtcagcaccttcacgagtacgcacagcgacagtctgcatctcgacttcccgatctccgataaccaaaagatagggaaccttgagcaaagtatgctcgcggattttaaagccgatcttttcatttctcaagtcggacttggcacgaaatccgctttcattgagagttttttcaacttcagcggcaaaatctgcctgtttatcagtgatattcatgatcactgcctgggtcggagccaaccacgcagggaacgcgccctcgtagtgctcgatcaggatgccgacgaaccgctcgaacgagccgaggatcgcccggtgcagcataaccgggtgcttacggctgttgtcttcggagacgtattcggctcccagacggatcggcaggttaaaatcgagctgcagggtaccacactgccagacgcggccaaggcaatctttcagcgagaactcgatcttcggaccgtagaacgcgccctcgcccggttgcaggtcgtacgcaagccccgcactgtccagcgctgcggccagtgccgcttcggcgcggtcccacagctcgtcggaaccgacgcgtttttccggacgagtggacagtttcatctcgacttcggtaaagccgaaatcgcggtagacgtccatggtcagcttgatgaacgcggcggattcggcctgcatctgctcttcggtgcagaagatgtgggcatcgtcctgggtgaagccacgcacgcgcatgatgccgtgcagcgcacccgatggctcgttacggtggcaggcaccgaactcggccaggcgcatcggcaactcgcggtagctcttcaagccctggttgaacacctgcacgtggcatgggcagttcatcggcttgatggcgtagtcgcggttttccgactgggtggtgaacatgttgtcggcgtagttggcccagtgcccggatttctcccaaagactgcgatcaacgacctggggcgtcttgatctccaggtaaccgttttcgcgctgaaccttgcgcatgtactgctcgagcacctggtacagggtccagccgttcgggtgccagaacaccatgcccggcgcttcttcctgaaggtggaacaggttcaggcgcttcccgatcttgcgatggtcgcgcttttcggcttcttcgatgcgctggatataggcggccagctgcttcttgtcagcccaggccgtgccgtagatccgttgcagctgttcgttcttcgcatcgccgcgccagtaggcaccggacaatttggtcagcttgaacgatttcaggaagcgcgtattcggcacgtgcgggccgcggcacatgtcgacgtattcttcgtggtagtacaggcccatggcctgctcgtccggcatgtcttcgaccaggcgcagcttgtagtcctcgccacgcgcggtgaacacgtcgatcacttcggcacgcggggtgaccttcttgatgacgtcatagtctttttcgatcagcgcgtgcatgcgctgctcaatggccgccaggtcgtccggggtgaagggacgctcgtaggcgatatcgtaatagaagccttcttcgataaccgggccaatcaccatcttggcggtcggatacagctgcttcaccgcatgaccaatcaggtgtgcacaagagtggcgaatgatctccagcccctcttggtccttgggcgtgatgatttgcaggctggcgtcgctagtgatcaggtcgctggcgtcaaccagcttgccgtcgaccttaccggccacggtggccttagccaggccggcaccaatggatgcggcgacctcggcgacggaaaccgcatgatcgaatgaacgttgactgccatcgggaagagtaatagttggcatggcgcctcctctcctagtggtgacccctaccaaaggtcacgtgggttgggatgagccagtacaagatccaacaccaggccgttcaatgaagaacgcctgccttacagcggcaggagcctttcggccaaccgataatcgaaccagagtgactggagtgaacaaaatggacctggcaaggcggcaaatggcgcgccgggaaatagccaggcgaggatgctagcacagatgaacggtcgtcgcgccggcgaagctttgtgtaaacagcatttcaaggctttatagctgcaaaagtgaacttgagctgtacgccgggcctcaaacccactgagaatcgccgttcgtcctcgacccaaaggagcatcccatgatgcgtttcacctctaccctcgctgtcgccgctaccctgagcctcctttccctcggtgcacaggccgcagccccgtccaactggccagctggtgcccgtgacagcttcgtgagcgactgcagtgccgccgccagtcagaacgtagacgtcaagactgccaaagcccactgcgaatgtggcgccgacaagatcaatgccgaattgagctctgccgagatcaaggaactcatgaccaaccagaacgccagcccggagcttaaaaacaaagcagtcgcggctatttcgtcctgcaaagtcgtgaagaaaaagtaagattgaccactgatcagacggccatttcactgaaaaaacggcctcaaaactgctatttcgcacaaaatatgcaggttttacggctttttttaacagctgatatttcaccgcaaagccccgtagatcggggctttcagccggcccagggatcaaacgcaacgcgattgattagcaaacaatgccttgggggggctcccaagtcgaacatttcgactatgatagcccagtgtgcccagttggcctgagcagcacagcactactgaaaatatatgtttcttggagatacaccatgtctaatcgccaaaccggcaccgttaaatggttcaacgatgaaaaaggcttcggcttcatcactcctcaaggtggcggtgacgacctgttcgtacacttcaaagctatcgaaagcgacggtttcaaaagcctgaaagaaggccagaccgtttccttcgtggctgagaaaggccaaaagggtatgcaagctgcacaggttcgcggcgagtaattccccgctgagctaaaaaaaccccgtccatgtgacggggttttttatgggcgatgcaaaagccgcagggcaatcagccgcaattgacccgagtgatcaccaggttgttatcggtgttcaggttcaagcggtcggagcgatactccagcgtgatcatatcgttgggcttgagaatgcgtgcattctgcgcaccggcacgcgtacgggcctgctccagcaactggggcgaggctttctggccgattgcaaactcggcggccttcgactcacagcggctatgaccggcatcggtcgcggcggcgtctttgcctggctcagaggcacccggggtgctgcaacccgccaacgcgagtgctgccaacaaagtaccgaatgatgcgagcttccaaggcatgaagcctcctatgataaaaaatggacagagatcgtgcgacagcagtcaaagcgattggtttcagaacgttaaccgcctgcgcgcaagtctgcctcactcacagcaggcaagcgccctgtcaatcgtgactagatatgaacgcacctagtagatatcaatgtagtcagaagaaggtgtaggccaattctgcttcaacgcgttaaaaatctgcatgacccagacttcgtcgcttgccgcgacgatgccgacatacccggagccctttgcccaggtctccaggcgaaagagcaggccgtcgatgttaacgcctcccacggtccccgaagaaatgtaggcaataccctccttggtaacacgcagctgggtatgttcatcgtcactggcgctggcaagcagttcgcgcacggccgcctgggtcaggtcctcagggttgttcaaattgatctgcacgcgttgtttcccggctattggacaggctggcagtgtcgcacaccccctccttcatgcctaagtagcagtgccaaatgccgcgtaaaatgcttaactgcgccggctggaaccgcattccagcgcattgcccagtactttcagcccgtgagacgtccatgaccaccgtaacgatccaagccgacatcaaagccaaatggccccaagggcaaagctcctacagccccgcaagcccggaagaaatggcgatcattggtatcgacctgctggtcaaggagctgggcacccaagccgcacaagccttcatcggccaggtattcgagaaatacccggccgaccatatgggtgcacaagcgcacaagtaagaaccggccagcggacgctgaccggtaaacgccttacttcagacgcgccagacgctcggtcagcagatcgaagaagccctgggcgtcgccgttctccacccagaacacatttttctcctgcttgagtccgtcataccaatcgacgatggtctggccgaaagtcggaccttcgcggctgtctacgaccatattggcctgacgaccactgaacagcgaaggcttgagcaggtaggcaaccacggtcgcatcgtggaccgggccgcccggaatgccgtagtgctccatgtcacctttgacgtactcattcagaatgctgctgacgaccttgctcgcgttgttgttcaggtcggcgatctttttcaggcgcgcatcgctggtgaggactttatgggtcacgtccaacggcaggtaagtcaacttcacaccacttttcagcacgatctcagccgcgactggatcggcgaacaggttgaactcggccaccggcgtgatattgccgccgttgaagtgcgcaccacccatcaccaccacttccttgatgccttgtgtgatttccggcgcctgggtcagcgccagcgccaggttggtctgcggaccgagcatggcgatggtaatgctgtgcggcttggcgctgcccagggtcttgatcaggtagtcaacggcattgccttcggccaggccttttttcggctcgtgcacggtgacgccggaaatgccttccttgccatggatgttctcggcatagatcggcttgcgcaacagcggcgcgggtgcaccggcatacaccgggatgtcctcgcgccctgcccactcgcgcgccaggcgtgcattgcgggaggtcttgtccaggcgcacgttaccggcgacggtggtcagcgcacgaatgctcaactcctctggcgaagccatggcaaacaacagcgccaccacatcatcggcgcccggatcagtgtcgatgatcaggtcgattttttccgccgcctgggcgcttgctgctgtgagggcggacaaaagcaggacactccggaacaggtttttcagggtaggtagaccacgttgcataaagcactccttgtcataggggggacgctagaacgttacgccggacaccagcgcgatattgcagtaaggctggcattcgccggtgcgcacaaccgcgcgggcgttgcgactcagttgcttgaactgatcatggctgagcaggcgtcgctcacccaacgcagcctgctctgtgagtgtattgagttcggtcagcgccggcggttgcttaagcaggatttcttcggccagcacgtggctttctacctgcatttcgctcagcacaatgcgtaatgtgctgatgaaatccggaatgccctgggtcagcgccaggtcgatcagctccacaccgggaggtaccggcaggcctgcatcgccgatgaccaggatgtcaccatggcccagggacgcgatcacgcgtgacagggcgatattgagcaaaggtgtctttttcatgagggcacaaaaccttggacgtcgtgcagcgtaggaatggaaggctgagcgccgttacgggtgaccgacagcgctgccgcgacctggccaaaacgaatggcctcggactcgctcttgccggcagccagcgcagcggcgaagccaccgacgaaggtgtcgccggcggccgtggtgtccaccgccttgaccctcggcgcgaccagatgctcgaagcttttaccatccgcgaacagcgcaccctgggcgcccagggtgatgatgactttacccgcccccgccttgatcagcgccgtcgcggcgaccttggcgctgtcgagcgagtccaccgccacaccgctcagggcgctggcctcactttcattggggatcaggtagtcgatcgaggcataccactgcgcgggcaggggtccgcttgccggggccggattgaggatgaccgtcttgcccaactcacgaccgcgcttgagcgtatagccaacggtgtccatcggcacttcaagctggcagatgatcacctctgctgcctgcagcacagcgtcgcaggctttcagagactcgggcgtcagctcaccattgctacccgccacaatgacaattgcgttctggctgctgtcatccaccacgatcaacgccacaccactggaaccttctacggtgctcaccgcttggcaatcgatgccttccgccaccaacgcctcgcgcaattgactgccgtaggcgtcagtaccgatgcaaccaatcatcgcaacatcggcccccaggcgcgccgacgcgacggcctggttggcgcccttgcctccgggaacggtggaaaaactctggccgaccagggtttcaccggcacgcggcaagcgactggcgcgggtgaccaggtccatgttcaagctgcctactaccactacttttgctggcatacatcagtactcatcaattcggttcagcggtattgggcgaacacaccggccagtggcgccgttgactcacgcaaaacaatactcggcgtcacgatacgttgatcgatcggcagttggggtgttgctattcgttgcagtaacaactcggccgccgtctcgcccagttgcaggatcgactgcccgaccgtggtcagcgccgggtagacgtagcgacccatctggatgtcgtcgaagccgatcaccgacaactcgcctggcacgcggatattacgttcagcggcggcgcgcagcacgccaaaaccgatcatgtcgttgctggcgaagatcgcactgggggggttctccgatagcaactgcaccgccgcggcgtaacctccggtgctggtaaaatcgctttccaggatgcgattggccagcacctcgacgccggcctcacgcaatgcacgctggtagcccgcaagccgcatctgcgccacgcgggtatgccccgggccgccgatacaggcaatgtcccgatgccccaactccagcaagtgccgtgtcgcgaggtaagcgccctcttcgtgatcaatgcgcaccagatcgacatcgatgccatccagcgcccggtcgacaattaccatgggcgtgcgcaccgcactcaagccggcggcaaggccactgtcatcaccacctaccgacgtcacgatcaagccgtcgacgcgcttttccagcagtacgcgcaagtaactgcgctgcttttcagcgtcgtcatcggagttgcagaggatcacgcagtaaccattacgctcgcagtaatcctcgatgccgcgggccagctccgcaaaatacgggttgaggctgttgggcaccagcaagccgatggtggccgtggtcttggccttgagcgaacgtgctacggcgctgggcacgtagtccaattgcttgatcgccgcctccaccttaatgcgtaccggctcgctgaccgggcgcgtcttgttcaccacatgggacaccgtggtgtaggaaatgcctgcaagcgctgccacatccttgatcgttgccatggttcagccccgccgactggcgcgctggctgcggtaagtatcgaggacgacggcgatcacgatcactgcaccggtaatgatgcgtttcgtgggttccgttgcgccgatctgcgccaggccggcagccaggaccgaaatgatcaacaccccgaagaacgtactgatgaccgaaccgcgcccgcccatcaggctggtgccgccaatcaccacggcggcgatcacttgcagttccaggcccgaaccggcattcgggtccgccgcttccagacgcgaaatctggaacagcgccgccacgccggccagcaggcccatcaggctgaacaccaggatcttgtagggcttgggattgataccagccaggcgcaccgcctcttcgttggtgccgataccgatcaggtaacgcccgaatacagtacgggtcagcaccaactgggccgcaatgatcaccagcagcgcgatgatgaacgaaggggaaataccgaaggcaatcgggttggacagccaggcaaacgagtcaccgatataggcggtgcgcgaaccggtcatctggtaggccacgccgcgagccatctccagcacacctagggacacgataaatgacggaatgcgccaggccacggtgatagagccggtgatagtaccggccaatgcggcgcagcccatgcccagcaacgcggcgggcagcacgctccagccccaaccaagaatcgccacgctgacagccgacgccgccaatgccagcacggaacctaccgacagatcgatgccgccgatgatcaggatgaaggtcatgcctaccgccagcaccatcaggtccggaatctggttggccagggtgctgaaggtgtcataggacaggaagtggtcgctgagcacagagaacagcgcaatcatcgccagcaaagcacccgccaggcccaggtaagtacccaggccatagaagttgccgccagtcttagcgggggaaatgcttgttttcatggggtattcctaggcgctgcttcgttgagcagcgcatcacgtttctgatagccggcaaaggcggcggcgagcaattcgtcctgggtccagctgtcacgctcgaaagtctggatcaggcggccggcggacaacacaccgatgcggtcacagatcagcatcagttcgcgcaggtcactggacaccaccaccagcgccttgccctggcgcgtcagttcgccgagcaaggcataaatgtcgaacttggcgccgacgtcgatacctcgggtcggctcatcgaacagcatcaccgaacagtcgcgctccagccaacggccgatcaccaccttctgttggttgccccccgacagctcggagaccaattgcgccgggctggaactgcggatccgcatggcgtcgatctggcgcttggccaaggcagtttcatcgcggctattgaccaggccgccaccggagatttccggcatgttacccagggcgatattggcgctgatggactgggtcagcagcaggccctcgcctttgcggtcttcggtgatcagggcaatgccgtgaccgaccgcgtccaccggcgagcggatactcaccaccttggccggcgaacccagggccacggtgccgctgtcggccaggtcggcgccgaagatcaggcggagcaattcggtgcgaccggcgccgatcaagccggagatgccatagatctcgccagctcgcactgcaaatgagacgtcgcgaaccttgtccgagcggctcaggccggtcacggtcaaggccggggcaccgatcgtacgtggacccaggtcgatgtgttcgcctaactcgcgaccgaccatcaaggtcaccagctgctcgctgttgtaattggccatcggctcgacgcagaccagcttgccgtcgcgcaataccgcaatgcgctgggcgacacgggccagctcttccagccggtgcgaaatataaatgatcgccacgccccgggcctgcaggcgggtgatttgctcaaacagcatttcgacttcacgggcggtgagcatggccgtgggttcgtcgaggatcagcacatgacagtcgccaatcaggttacgggcaatctcgaccatttgctgatgaccaatgcccaggctgccaaccagcgtatccgggtcgatcgcgtccaggccgacctgggccatggcttcgatcgcagccttgcgcagttgtttgcggctgatccagccacagctgctcggcaggttgtccagaaacaggttttcagccaccgtcagcgtcggcaggaggttgagttcctgcatgaccatgcgtacgcccaaggcttcggcctgggtgcggctggcggggcagtaatcctgaccgttgaactgcatgtgcccggtagttggtgtgaccaggccgccgatgatcttcgacaaggtacttttgcctgcgccgttctcaccggtcagcgccagcacttccccgcgattgagcgtcagggtgatgtcggacagaaccggctgggcataggtcttaccgataccgctgaccgagaggacagcgttcggggcagaagatgacataggaaaatctccaggcgcccgctcaggacgagcgagcgctgttgggtaccgccaggattacttcttgaggacgagttcgaccggggtttcgatcacgccatctttggcatcgaccttttcacccttgaccagcttcagcgcgttctggataccgaacaccgcttgctgggctgcggcctggtcggcagtcgcgagcacacgcccgtcctgcagcatcggcttgatggcttcaatgttgtcgtagcctacgaccagcaccttgccggccttgcccgcggcacgtacggcagaaacggcgcccagggccatgttgtcgttaccggccaacagagccttgaggtcgggatgttcgctcagcatcgccgacgcaactttctggccctggtcgatttcccagttaccggattgggtggaaacgatcttcatgcctgcggcgtccattgcatccttgtagccagcggtacgctgctgggcgttggtagtggtcggtacgccttcgatgatgccaaccttgtcacccgcagaaagttgcttggccaggtagtcgcccaccagcttggagcctttgcggttgtccgggcctacgaaaggaatatcgaggtttttgcttttgagtacgtcagggtcaaggcggttgtcgatgttgacgaccttgatgccagcgtcagaggcttttttcagtacgttggccagcgctttggaatcggcgggcgcgatcacaatggcgttgaccttggaattgatcatttcattgacgatggcaatctgtgcgctggtgtcggtttcgttcttgataccgttggtaatcatgtcgaaatcggcggcgtgatctttctgataagcctttgcaccctcttgcatcgtgacgaagaattcattggcaagggatttcatcaccaggccgactttgggtttggcggcggcgtcttcagcaaatgcagaggagagaggtaaagcggcggatacggcagcaagcacagcgacagcaagaagacgtccagcaaatggcagcttcatgggttcactccgatcttatgattattgtgagcaacgcttgcgccgaagacccttcggtagcctcccacctgggtggccgatacgagttgtcacggtactcgaggagagtgctgtgaaacatctcgcaaacgtttgcgttgaacaaactatgagaaccttgtcgggatttgtcaacggtagaaaacaagcctttcatccagctctccagcactggctacttcaccgaagccactgatacgtttaagcaaagccctttaccgaataacccctgaaacgacagatgatgcttgccgaagccgtacgagtcgccaagataatccatacagctttcggacaaccgaacaccacagccctgcatcgttcggaaagccggacgaagcgtcgcaccagcaatcttaaattccgaaaaaatttgttctaaatcaatacgttaaattaaaacagcaggcaccatcagtctggtacgaatcctgctctttcccagcaccctgcggcgctcagaaccgcccgggtgttctagatgaacctgctacagcactcatcaaaaaccagagagaaaaataatgacatctgcactgaagaactttgtcccgggcgccctcgcgctcctgctgctgttcccccttgccgcccaggcaaaagaagttgaaaccaagactaaattgtccaacgtggtcatcctggccacaggcggcaccatcgccggcgccggcgccagtgccgccaatagcgctacctaccaggccgccaaggtcggcatcgaacaactgattgccggcgttcctgagcttggccagatcgccaatgtgcgcggcgagcaggtgatgcaaattgcctcggaaagcatcaacaacgaaaacctgctgcaactgggccgtcgcgtcgccgaactggccgacagcaaggacgtggatggtatcgtgatcacccacggcaccgacacccttgaagaaaccgcctacttcctgaacctggtggagaaaaccgacaagcctatcgtggtggtcggttccatgcgcccaggcaccgccatgtcggcggacggcatgctcaacctgtacaacgcggttgccgtcgccggcagcaaggatgcacggggcaaaggcgtactggtcaccatgaacgacgagatccaatcgggtcgcgacgtgagcaagatgatcaacatcaagacagaggcattcaagagcccatggggtccgctgggtatggttgttgaaggcaaatcctactggttccgcctgccggccaagcgtcacaccatggattccgaattcgatatcaagaccatcaagagcctgcccgatgtcgaaattgcctacggttatggcaacgtgagcgacaccgccgtcaaggcactggcccaggctggcgccaaggccatcatccatgccggtaccggcaatggctcggtatcggccaaggtggtccctgccctgcaggaactgcgcaagcaaggcgtgcagatcattcgctcttcccacgtgaatgccggcggtttcgtcctgcgcaacgcggaacaaccagacgacaaatatgactgggttgctgcccatgacctgaacccgcagaaagcccggatcctggcaatggtcgccctgaccaagacccaggacagcaaggaactgcaacggatgttctgggaatactgattcctgatgatctacctgtaggagcgagtttgctcctacagccctcctccctccgcacttcaacaaactcccttaatcgctgtcagaccaacttcttgaaatttaagcagttgcgaaatcgcctacatttaaatactgtatgtgcgtacagcctattaaggaatgctccgtggcaaagccctcgtccgcagtacccgcatcgcctgacgcctaccagcgcctggccattcgcgtgcaaaaaatcatcaattcgaccaacgcccagaaagccaaggcagccttgatcttccgtttacccgatgagccggaggacgagtggcagcgtcttctggaagaaattgctgaaaacgacaatgtcaccctggcctatcgggatgacggcggcgtgcagattttctgggttgtgccgaaggaagattgattgaatgagtgcccgctttattgccctgtgctgtctgttttttaccatcaccgcccacgcccaagcccctcgaaccttcagcgaagccaagaaaattgcctggaagctctacgccccgcaatccaccgagttctactgcgggtgtaagtacacgggtaatcgtgtggacctgaaagcctgtggctacatcccacgcaaaaacgccaaccgcgctgcgcgcatcgagtgggaacacatcgtgcctgcctggcaaatcgggcatcagcgccaatgttggcaaagtggcgggcgaaaaaactgcacgcgccacgacgaggtgttcaaacgcgccgaggctgacctgcacaacctggtgccgagcatcggcgaagtgaatggcgaccgtaacaacttcagctttggctggctgccgatacaaagcgggcagtacggctcatgcctgacccaggtggatttcaaggccaagaaggtcatgccgcgcccgtccattcgtggaatgatcgcacgcacgtatttttatatgagcaagcagtacggtctgcggctgtcgaagcaggaccggcaactgtatgaagcctggaacaggacctatccggtgcagacctgggagcgccagcgcaaccagacagtggcttgtgtgatgggacgcggcaacgagtttgtcggcccggtgaaccttaaggcctgcggctgaatgtgggcggggctgccgcccactcaggcccttactgcgcgaccttgtgttcgatgatctccgacaccgtatcggttttcttggccctcgccatcttttcgttaagcaacgcctgcctggcttctgcctccgctttggtggcgaacgggcccagccgcacttcatccttgccatcgaccttcacgatgtaaaaactgaaaccatgctccagcaaccaggcggtcaggtcagtgatcgcctgcagcttgtggtccggcgggccgacccatagatcccattcttgagcggcaatcgcaccggtttgtggcaggctttcggtcacggcaggcttggccttgggggcatcgaccgatttaccttcaccgcatccggccaacgccaacaccacaattgccatcgctactttacgcactgccctgctcctttgaggatcaaagaggcgactttaccattcactgtctattctggccgtcataaacgttggcttaaacaatgcgaatgatgtatcgcgacctgtatgatgccgccatgggaattaatgtcgcctctatgcgtcctaaaagaggcagtcacagggaagcgcttcgcagtaagctacacacatccgacacctgccctgtctgaaacatgtgtccttaaaagtaatcaaggagaagtccatgcttatactcacccgcaaagtcggtgaaagcataaacatcggtgatgacattacgatcaccatcctgggcgttagcggccagcaagtacgaatcggcatcaacgctcccaaggacgttgccgtgcatcgcgaggaaatttaccagcgcatccaggcgggcctgactgcgcccgacaaaaaccagacaccttgaaacgcctcagtagccagccttttcgttcactgtaacggctggcgaaaacccgatcggcctgctcgcgctttcctgcgtgaccagcgcgccctttgcatacctcttcgccgcaaaatgaaactgtcagcgtacctggaacttgtcgaactattcgcagcccaatttgtgacgctttttcctgccatccgagtgcattcaggagcacgtcgatgaggccagccgcgacgcccccacttgttacccgctcctggatgattgccctgctgatcggcttggttttcctcgcgctcgggtatgggctgaaagtggaagctgaacgggcctttcccgatgaccacggctggctggacttgacacttttgctgtttggctacttgctggtgttctgcctcaaacccatgcaaaaggttattttgcgcaagttgtgtcaacgcgcagctcaacgcgcacaccagcaaaccctgcgctgaacaccgctgcctgctatcggatcgccggtatttacagttgagcaacaagacctatgcttgggcatgcacggtcagtcaaaggtgcagaatcagatggacacgctcagcaaatcccaaatcgaaaaagccttggcagatcgcctgcccagctacacggttgagtgcaccctgcatgccgacggtaccttgtcagccgttctcagcggccccgaaaccgatcattttgcgattaccggaatcgtgcgggcgcatcatcgcggcactgatgccatcaaccggctcgccacagagatactcagggaaatggtgctgtcgcgtcagggaatgaaaagcagccggttgctagcagttgcctgcacagaaggccgagcccggtgaaggctcggcctttctgtgcattaaggtgtcaacggatgaacgcaaagcaagccatcatcgtcgcgtagcgcccgcaacttgctgtacccctcgatacaagcatgctcagtcaccatcggcgtcaggtgcgcagaggtcacgaccatgatatccgcccccgccgcttcccccgcccgaatgcccaccgtggcgtcctcgaataccaggcagtcttgcaccggcacgcccaggcgctgggcacccagcacataacaggccggatctggcttgccgctcgccacatcttcggccgtcacgaatacttccggcaccggaatgcctgccgcttgcagtcggcgcatcgccaacgcctttggagcagaggtgaccagcgcccattgatcgatgggcaagcccttcaaaaactctacagcgccaggaatcgcaacaaccccttccacgtcattcaactcagcctcggtgatccaccgggcttccacctcgggatcgacacccggcaacgcctggcgcttgatcgtatcaatcgcgcgggcgccatgaatggtgcccaggaacgcctccacgtccaggccatgacgttccgcccagatgctccatacccgctcggccgcagcgatggagttaagcagcgtcccgtccatgtcgaacaggaaggcgcgatagcgccgggtaaacacagtttgattcgggatggacactacgcgcttcctcatgagctggccccctgcaatctacggatcaccttcacgcttgtaaacgctgagccccctcaaaccgcccacgtatcggtctcacgtcaagaatgacgaacttgtcattatcctgttggttggctgttgggatcgcctggttaccgtgaactcactgccattgcggcagccaatccgtaacgagagataccaccatgaaactgtttaccctcgcttttgccgccctgctcaccaccggctcggcgtttgctgccgacacggtccctgcctccaacgtcattcatgacaagaccggcttcttcgtgcacctggatgtcgccaaggtagtgtcgagtaccgacacctacggccagtgcggggtcgtaccggcgcaattgcgttacctggatcaccagggacgcgaacacgtgctggattaccaggtccagggcgtcggttgcgccagtgacaattgatcgggctacactggcgccacttattgaagcaagggcatctgccatgaacatcctcgtagtcgaagacgaacccaaggccggcaattacctgctcaacggcctgcaggagctgggccactctgtaagcctggcccgcgatggcgtggatggtttgcaccaggccctggagacgcccttcgacgtgattgtgctggacgtgatgatgccgaagatggacggctgggaagtgttgcgccgcctgcgtaaagaagccgatacgccggtgctgttcctcaccgcccgggatgatattgccgaccgcatcaaaggcctggaactgggtgccgacgactacttgatcaagcccttctccttcgccgagctggtcgcacgcctgcgcaccctcaaccgccgcggccccagccgcgaggaagaacaactgcacatcgccgacctgcacattgacgtgctcaagcgtcgtgtcacccgtgccggcacgcgcattaccctgaccaacaaggaattcgccctgctgcacctgttcgccacgcaccaggaccaggtgctgtcccgctcgttgatcgcctcgcgggtctgggacatgaacttcgacagcgacaccaacgtagtggatgtggccgtcagacgcctgcgcctgaaaatcgacgacccgtttcagctcaagctgatccacagcgtgcggggcattggctaccgcttcgatacccagccatgaaccgtcaccgccactactccctgaccctgcgcctggcactgatcttcgccttgctcgccttcgccttgctggcaaccctgggcgtgacattgtaccgcgagctggagcgtgaactgatcaagcgtgacgacgccgcgctgatctcgcgcgccaaccaactgcgcaacctgcttaatgacggcaacaccctggagctgatcaaatccaagccggagctgttccagaacatgctgggcaacagtgagtcggtattgagcatcgccgcacccgggcagcaagcgttattgctggtgaaccctggcaacatccagattcccccggtgtcgcccgtgacgaaagaccatgcgctcggacttgccgatgtgcagcatttcctcgatgtgaacggcgtgccgttcgccaccgtagcggcgtccatcgataccggtgacctgggcagcctgcaagtcaccgtcgggcgcctgatggccgaacgcacgagcatgctcgcgcgttatcgcttgaacgtgttcatcctggccagcatcgcagcggtgatcctcgccttggtcggttatgtgctggtacaccgtgggttgctgccgttgcggcgcctggctagccatgcacagggcatcggcgtcagtaacctggccgaacgtctcgagagccacggcgctcccaaagaactgctgccgatgattgattccttcaacaccatgcttgaacggctggccaaaggttttatccagctgggccaggtctccaccgatatggcccacgagctgcgtacccccatcaacaacttgctcggtgaaacccaggtcgccctgcaacagagccgcagcatggagagttaccaacaactgctggcctctaacgtcgaagagctcgaacgcctggcgcggatgctcgataacatgttgttcctggcccgtaccgaccctgctagcgccttgcgccaacgccaggagctggacgcagcggatgaggtggaacgcatcgcagattatttcgaggggttggccggtgatgtgggcatgcacatcgttggcttgggcgaaggcgtgatctgggctgaaccgatgctactgcgccgggccctggcaaatctgtgtgccaatgccatcaaatatggcgcgccgaacaccgagcttaatattcaggcaattccgacgaccgaagggatccgccttagggtcagcaactacggccaaaccattgccgccgagcatttgcccaggttgttcgaacgcttttaccgggtggatgaatcccgcgggtgttcgtcccagtccaacgggttgggactgtcgattgtggcgaccatcatgcagctgcataacggccgctatggggtgaccagtgagggcggcgtgacgtgctttgaattgttttttccaaagcgcaacgcgtgacagctcgcccactcaatccaaggccccgttcagcacctcgtagatgataccggtggcaatggtcaccaagatcaagtcggttcccgcttgctgccattcataaccatcgtaatggggcaagcgtcccaacaggcggccgtcgagcttcttggcgataccgggtggcagcggcttgccacgcgccagattcttctggatacctggtggcaatgcaggccccgggctccagtaatcgcgatagccgcccaacacattcagtacgctccctcggtcaacgcttgggccatgaccacccgacgcgcccttgcctccgggtttgtcatagccctgtcctaccgggttattgcctttgttattgccctgccccttccctcccgggttattagccttgttattaccctgaccctgtcccccctggttattaccttggcccttgccattaccgggatcagccagggcaagaccgctacccgcaaacagcgcgagggacaacgcgacagacacgaacttcgggcacttgatcatgatggttttccaaggtagatacgcttgtgaactatagccgaagttgccccacctatatgcgcagcctagccgtcaactcacctgcccacctgtttccaccacatcggcctggatgagccaagccgtagagaccgccagccgcaagccttcaaccagggaaggctggcccgctggcggcaagctcggcacatggacaaacccactgcgcaccccggtgccggccagccgatgctgcaaaagataaaatacttggttgcacacgaaggtccccgccgtttgcgaaaccgctgcggcaacacccgcctcgcgcagcgccttgaccatggccttgatcggcaacgtcgagaagtacgcagccgggccatcgaccaccaccgccgtatcaatcggttgttgcccgaggttgtcagggatgcgcgcgtcgttgatattgatcgccacccgctcgatggacatctcactgcgcccaggtgccaggccggtagcaatcaccatcgccgggctcaactcctttatcagttgggccaggtacgtgcctgcggtggcaaatgcgcacggcaagcaacgcgcgacaatctgcacaccctcggccacttgcacgccatcgagctgtcgcgccgcctcccaggaggggttcaccaagtcgttatcaaagggctcgaagcccgtcagcagcaccgtttgcatatgagcctcacatcaacagataaagcagcacgatattgaccaccagcatcatcagcgccgtgggtatctgggccttgatcaccgcgtttttatcaggcagctccaataaggctgccggtacgatgttgaagttcgccgccatcggcgtcatcagcgtaccgcagtagccggaaaacatgccgatcgccgccatcaccgcggggttgccgccataaatccccaccagtaccggcacgccgacgccacctgtcattaccgggaacgccgcgaagccattacccatgatcacggtaaacaaggccatgcccagcacatacaccatcaccgccaccaacttgtaatccaggttgatataagtggtggtgacgtgggcgacagcggtgcccaccccggcttcattgaacagcaagccgagcatcgccagcatctgcggcagcaccatcgcccagcccagggcctcggtcaggcggcgcgattcgcgcaaggcttgtaccggcgtatcgcgggtcagccagcaggccaggccgagggcaatcaggcagccgatgccgagggacacaaaagtggtgttcttcgggtccagcagcggtacaccgccgatttcagtgtgcttgagcaataccgagccaatcaccgtggtcagcgggatcgccaatgccgggataaacaacttgtggcccaggcgtccggcactggcgcgggacgccttgtcgtgcaattcggcgtgctggccacgacccacaccgcccaggcccgcgatcaatgccatcaccaccacaccgaccccgatcaccaccgaaggcaggcgctcccccaccaggaacggtatggcgaacaacagccagaacagcgcgctggaccagcgcttgggatgggaacgatcgagcaggatcatgcccgcggtgatcagcaacagcacaccggccagccagtacaggtattgaatggaaatgatcattgagcagcctccaccggggcggtggccgggctcatctctcgggtcaggcgtcgatcaaaacgatgcaggcggatagcgtgaatgatgaaggcacagatcgccgtgggaatgccccataccgcaatgtgcaacggctccacatcaatgcccgagcccaacaggaaggtatgcatcaacgcaatggcaccgaaggcgacaaaaatgtcttctccaaaaaacagcccaacgttgtcggtggccgcgcacatggccaataccttatgccgcagcttgtccggcagcttgccgtagcgtttttccgcggcaccttcggccatcggcgccaacagcggtcgcaccatttgcggatgcccacccaggctggtcagccccatggcggccgtggattcacgcacaaacagataaatgatcagcaaacgcccaaccgtggcgcgctcgaagcgggcgatccagttctgcgcatgcaggcgcaggccatggcgctccaacaggccgatcaccgccagcggcagtaatagaatcaattgcagggcacgggtctggaggaagccatcgcccatggtggcgaaaattttttccagcgggaactgggcggcgaacccagtggcgatggcggccgcagtgaccaccaacagcggattgaagcgcaatacaaagccgaccacgatgacaagtacgccgatcaacggccataagttcacaactgtttgcatggcggagaggtcctttagtgcgcgctgcggcgccattacagcaggatgtgggcaaagggctcacagcttgaaagtggcgtgcagtcggctcggttttttattgttgacccggaaggtcgagcgtctgtggcggcaactttgctgcctggggacggggggtgtccaacaagaaaaattgttgctgcaaaccaataatttttgtgggggatggcaccgcgcaatcgggcgccatgggaaggttcaacccaggcttatagggaaaaggtcgcgtagatgatccgacgaggcactcaccatcggttcagccgtatgaattcccaaacaggatctatactccatgatgcagctgtgtgtacctgcagttcgttcacggtgttatgccgacaatgagggctcgcgctatgtatgccggacaaatgagtaacagggcaacaacgattggcgagatacgctgccagatggtcgcccagataatttgcctgctgtcggtggctacgctgttctgctgacccacccttcaaacctgaaagtgcgccgtgaggcgtctgagggtgcccattgcccaaattccaggcaacaaaaaagggcccacctttcggtgagcccttctagaccgcccagcagagcggattttgtttggtaggcgcgattggactcgaaccaacgacccccaccatgtcaaggtggtgctctaaccaactgagctacgtgcctgctgtgaggcggcattctacggaattccggaggggtgtcaacatcttttttgcagctaagcctatgaatatgcgaattttttatttgcgccgggcacgcctgtgattttccggtggctggcaggcaattttcaactcaggtaggatcgccgcactcgtaaaaaatataaaacagaggttccaggatggcgaacaccccctacccccagtcgtattacgccgcttccgccaatgcagttccacctcgcccgacactgcaaggtgaagtcgaaaccgatgtgtgcgtgattggtgccggctataccgggctttcgagcgcgctgttcctgctggagaacggctttcgcgtgacagtcctggaagcagccaaggtcggctttggtgcctcaggccgtaatggtgggcagatcgtcaacagctacagccgcgatatcgatgtgatcgagcgcagtgtcggccctaagcaagcgcaactgctcgggcagatggcttttgaaggcggcaggatcattcgcgagcgcgtagccaagtaccagatccagtgcgacttgaaggacggcggtgtgttcgccgcactcaacagtaagcacatgggacacctggagtcgcagaagcgcctgtgggagcgctacggccatacgcaactggagttgctggacgaacgccgcatccgcgaggttgtggcctgtgacaactatgtcggcggcttgctggatatgagcggcgggcacatccacccgctcaacctggcgctcggcgaagccgcagccgttgagtccctgggcggtacgatctatgagcaatcggctgcggtgcgcatcgagcgcggtgccaaccccgtggtgcacaccgccgaaggcagggtcagggccaaattcatcatcgtcgcaggcaacgcttacctggggaacctggtgccggagctggcggccaaatcgatgccgtgtggcacgcaggtgatcaccaccgcaccactgggcgacgaattggccaagaccttgttgccgcaggattactgcgtcgaggactgcaactacctgctcgactactaccgcctcaccagcgacaagcgcctgatcttcggcggcggcgtggtgtatggcgctagggacccggccaatatcgaagcaatcatccgaccgaaaatgctcaaggcgttcccgcagttgaaggatgtgaagatcgattacgcctggaccggcaacttcctgctgacgctgtcgcgactgccgcaggtcggccgccttggcgacaacatctattattcacaaggctgcagcggccacggcgtgacgtacacgcacctggcaggcaaggtgctggcagaagcgctaagaggtcaggcagagcgttttgatgcgtttgccgacctgccgcactacccgttcccaggtgggcagctgttgcgcacgccatttgcggcgctgggggcttggtattacggactgcgtgataagttcggaatgtagacacacatccagtgtgagagcgacttgctcgctcccacactggctgagcgctttctacgctggcgtcaatgcgccctgtgttcgacggacggcgcctgggcttgcagcttctgcacatcgctgacggccagctcagccgattggccgccccaaccctgacgcaggtagttgagcagatcggtgagctgttgcgcactgagctttccggcgaaccccggcatcggttgcatgtgctcgaagccggaaaacttctgctcgccaataccgtcctcgatcacccgcagcaggttgcgcgggtcttccagacgcagcgtggtgttgccgcgcatggccaccgcgatgtggggtttgccttcaccacccgcagcatggcaacccgcgcagacgttcaggtattcctgacgaccgcgctgagcgctcgggctgagtttatccatcggtacttcgaccagcgctttggctgccggcggtttatcgcccagcaggaacgtcgccatcgctgccagatccagatcgctcaagccctgggtgctgttatggaacaccgggaacatctcgttgaacatcgtgccttgggcactcatgccgtgcttgaggaatgtggccaggtcctgctcattccagccgcgagccgccaggtcagtggcgagcaggctcggcgccagataaccattgagaatgccgccggtcaggcgcttgtccaattgcatcgcacccggcaggccgcgaggtgtgtggcattcgccgcaatggccgagtacctcgaccatgtactggccgcgtttccaggcgtcgctcttgccttcggctggctccagttccagggctttgccgtacagcaggttccagccgatcaggcccaggcgtacgttgaatggaaagctcaggcgggtctctggcgctgcgcgttctatgggctcgatagttttcaggtacgcatgaatcgcgtccgattcttcacggggcatcaggtggtacgaggtgtatggcatcgccggatacaaatgcgcaccgtcgcgacgcttgccttcggtcagcgccgcaaagaactcgtcatcgttgtacaaaccgatgccgtgctctttgctcggcgtgatattggtgccatagatcgtgccgaacggcgagacgatcggcaggccacccgcatacggcgcgccgcccggtgccgtgtggcacgccatgcagtcagctgcgcgggcgaggtattcaccgcgcttgacctgatcatcggcatgggcaaacaacaccggcgcagccaggccgaccgccagggtcaggcgggtcagaaatagcttcatgtctaaccctccttgaccaggccgagatcgttcagcacgttgcgggtggcgttgtagtaacgcacgtacccggtgcaccggcagatgtgatgtcccaggctgtcttcgataacctgctccagctggctttgcacaatcggctggcgttgcagcttttccaccagcaccgttgccgcgttgacgaagcccggtgcgcagtagctgcactggaacgcgaactcatcgacgaagcgctgctggatcggattcagctctgtgacctgccccgactcgtcgcgcttggcgtgagattcgatggtgcgcactttcttgccttcgaagtaatgcgcgccagtgatgcaagtacgcacttcttcgctggtgccgtccgggttgtcgacgatcaccacgcaagcgtggcaaataccctggccgcagcctagacgcgagccggtgaggtttttgtattcgtgcaggtaatcgatcatcggcaggtcatcagggatgtccaccgggccgacggattgaccattgaggatcagttgaagcggacggtcagccattgagggcctccttgatgcgcgcagccgtaattggcaggtcgcgaacacgtttaccgatggcatgcgccacggcattaccgatggccccgacgatcgggatcatcaccacttcagcgatccccttggacgggtcgcttggcgacagcgccggcagaatctccgacgtttgcttccacacggctacgtgacgcgccatcggcagacggtaacggttgaagttccagtcgccctcccccggcccgccttcgtacagcggcatttcttccatcaacgcatgaccgatgcccatggcgacaccgccctcaagctgacctttgaccaactcctcaaccaacacgcgaccgcactcgatccacgaatggtgattgagcacttccacctgcgccgagcccttgttgaccttcaactcgaccaatgtggccaccgggctgtagtaagtcacggcagcgttgttcaactgcgtcgcggggtagctgatgttctggcgatccaacaggtggaaaccggcgctgctcatcagcgcttgcttggctttcggtgcaccgtcgccgtacttcaccgccaaaccgtcgaggggcaggcgctcgcgcacgccgtcgatgctgtattcagcctctgcccagctccagcggttgaacccgtgaaccgtggcagcggtgaccaggccacgctcgtgggcgtgcttggccaacacctcaaagctcaacggctgcatgccgttggcggtgagcttgccgtcgacccaatgcgcatcttcacggcgtaccacataggggttggcctggccgccgaacggcccctgccgccagatctccagcgccgccggccacaaaccgtggttgaacagcacgcgtgccgcttcacgggtggcgtggctgaagtagtacgccgagttggtggccgaagacgccgaagcgagcttgccaacccaccgcgggttacgcagcaggttgtcctgctcggcctggctcatgatgtaagggttgccgctggtgatcagctgcatctccttccattcggtttcgccggtcttcacctcgtgtgccgggctgccgaggaaatcagcgaccaccagcgactgcgaggtagacatgccggtgccgatttcgataccgatatggcgcaggctgatgcgaccgtctgcgttgaattcgatactggccatcggcgcttcggaaccggtgccgaagtctttctggcagatggcgaaaccgacgccgtaccagttgtccgggtcagcggcttcgcgttgtttcttgatcgcgtcacggctcttccacacgtcgtgcacagcggccttgtcgagaatttcgtgcaggcgcaaggcaccggcaggaatggcgccctgggtgttcttcatgcccgaacgcagggcattcttgcgacgcaactcgatggcatccacaccgaggcgaccggcgatttcgtcgaccatcatttccgtcgcggccatgctctgcagagtgccgtacccccgcatcgaaccggcttcaacgccccgcgagtgataggcggtgacttgcagatcgttctgcggcatgtagtagatcgattgcgcagccgtggcgcctactgcggcgactgatgggctgtagttaatccgcccaccgccgtcgacgctcatgtcagccaggaagatcttgaagctgtggtcgttcttgtcgacagccaactggtagcggatgtcgaacgagtgacgcttgatgccgctctggaactgctcgtaacggtcattggccagacgcaccggcacaccaccgccatacaatgcggcgagggcggcgtagtagacaaaaatattgtggtcttttgagccgtaacccacggtataaccggggtgcatgttcaggttgtccaggccgaagcgcgacggcgagatcatttttgcggtctcggtcgcaacttccaatgggcactgggtggccactacgaagtgcagggtcttggtcgctggatcgtaccaaccgttgccgttatccggctccatggcggccggttcgatagacggggttttgtagcgctcgtcgaacaccagccagttatccggcggcgtgttgatctggctcttcatgcggtcggcgtagaacagaccacgctcggtcaggttgccgtgcaggttcggctgggaattccacaccgggcgccggtttttcagcatcgggaacaggatcgaatccttgaggctggcgaattcatcctcatcggccgaggtcgggccgccaacgcgcacatagcggaagctcccgtacgggtcgccttcgtaatacggcactttggcgccgtaacgaatcgccttgtcattgaacttgagtttgttttttgcctgacggaaccgctcgaaatcgttccagatcaggatcgccaccggatgaccgatgaacatcggcaccttgccttctggcaacagtggatccggagcatgttcttccgggaacacgataccgtcgttgtccaggtcggcagcggtaacaacacggtccggctgcaggtcggcgccgagccacgccaggtcgtagcccgcatagatatggtcggccttggtagtcttaagcagcatggcgtgaccttgctgcgcaggccagccgggcatgtccttggaacgaatgtcgcgagcgaagactttgctgccgcagactttcgacaaggcatcgttacgctggcgcgccttgccgttattgcccagccacttttcggagggcacggtgacgctgttttccatcaaggctgccagcgcctgggtgctgagcggcgtgagcgtgacgctcacgcccgccaccagcccgccctggaggaacgagcgccgggttatttcacggttggacatggatcatcctctgagcggttatacatccgcccttatggttaagtgcagctaatctggagacttgcagaagcctttctggacgaactaaaaggccatgatgacagtgcaaagttgaccgaagggttaactttaaaggtttctgcgcctgcggcaaataaccacatggaaattttttgacacaacaatgcaaaacggccgacaagatcgatacgatctgtcggccgtttgcctgttaatgcgagatattggcgtagctcaagagattgggcgttcgctgctgcgaacacgatggtgaggttttacaaacgccagacacaaaaaaccccggtctttcgaccagggtctttgctatcggatcaagtcagccggtggctttcttgtgcttcaaggcgttcagtgggccttgaggcagatatggcgcagcggacgggactcgaacccgcgacccccggcgtgacaggccggtattctaaccgactgaactaccgctgcgtatcgcttggctgattgagcgtaaagcctcaaccacctttaaacatctgatcgatcaacctgggttgttcaatctcaagcccgatacatcgaacctggaaaatatggcgcagcggacgggactcgaacccgcgacccccggcgtgacaggccggtattctaaccgactgaactaccgctgcgcgtcggtgcaaccttaacgttgcgtcttaccctggagcaaaactctcaagaagtggtgggtgatgacgggatcgaaccgccgaccctctgcttgtaaggcagatgctctcccagctgagctaatcaccctttgcttcgttgaggccgcgaaatttacgcaggtagcggacctaagtcaatagcctgcttgaagtttttctgaaaaagacaaaatcacttcaagacagctaaccgccctactcgctgtaaatcatcttcttgctcatgccaccgtccaccacaaactcttgcccggtgacaaacccggcctgacgcgacaacaaccaggctaccatcgccgccacgtcctctaccgtgcccaccctgcccgcagggtgctgggcatgatcggcgtcggtgagcggctcggcacggcgcgcagcaggatcacgcgcatcgatccagccggggctgaccgcattgacccgcacttccgggcccaggctcatggccaaggcgtgagtcagggccagcaggccacccttgctcgccgcataggcttcggtgtccggctccgattgacgggcccgggtcgacgccaggttgacgatggcaccgccgtgggcgcgcaggtaaggtgcacaatgcttggccagcagcatcggcccgctgaggttcaccgccagtacgcgattccagtgggccagatcgaggctttccagggtgatattgcgcggatcggccactgccgcattgcataccagcgcatccaggcgcccgaactgccccagcacctcggcgacaccctgggcgacttgcttctcgtcggccacatccatggtgatgaaccaggcattctcgcccagcaccttggacaccttggaaccgcgctcgcggtccaggtcagtcaataccacctgccagccttcgctgatcagccacgcggcaataccgaggccaatgccgcgcgccgcccccgttaccagcgcaacgcgcccgttagtggccgctgcagcctccatagaccactcgatcacaaggccgccaacccgcgggccaggtctgcctgcaagtcagcgacatcttccaggcccaccgcgatgcggatcaggctgtcacggataccggcggcttcacgctcctgcggcgccaggcgcccgtgggaggtggtgctcgggtgagtgatggtggtcttgctgtcgcccaggttggcagtgatggaaatcaggcgcgtcgcatcgataaagcgccaggcgccgtctttgccgcccttcacttcaaagctcactaccgcgccgaaaccacgctgctggcgttgggccaatgcatgttgcggatggctcttgagcccggcgtagtgcactttctcgataccgtcctgctgctccagccactcggccagggcctgagcattggcgcaatgggctttcatgcgcaggctgagggtttccaggcccttgaggaagatccaggcgttgaacgggctcagggtcgggccggcggtgcgcaggaagcccaccacttctttcatctgctcgctgcggccagccaccacgccgcccatgcaacgaccctggccgtcgatgaacttggtcgccgaatgcaccacgatgtccgcacccagcttcaacggctgctgcaaggccggggtgcagaagcagttgtcgacgatcagcatagcgcccttggcgtgggcgatctcggccagcgcggcgatatctaccagctcggcaagcgggttggaaggcgactcgacgaacaacagcttggtgttggccttgatggccgcatcccaaccggacagatctgccaggggcacgtagtccacttcgatgccgaagcgcttgaaatacttttcgaacaggctgatggtcgagccaaacacgctgcgcgataccagtacatggtcgccagcgctgcacaggctcatcaccaccgccaggatggcggccatgccggtggcggtcgccacggcctgctcagcgccttccagggccgcgatgcgctcttcgaacgcacgcacagtcgggttggtgtagcgcgaatacacgttacccggcacttcgccggcaaaccgcgcagcagcgtcagcggcggtacggaacacgtagctggaggtgaagaacatcgggtcgccgtgctcaccttccggggtacggtgctggccggcgcgcacagccagggtatcgaaagctacgccatcgaggtcgctgtccaaccgaccggcatcccattcctgactcatgctgcgactccttactcaatactttatttaagatacaaaaccggcccctcagggccggctgttactcagttgttatacaggtcgatgatcgcgctgaccgcctgggtcttgatcttcgacgagtcgttgcgcgcctgctcgatcttgttcaggtaagcctcgtcgacatcgccggtcacgtacctgccgtcgaacactgcacagtcgaactggtcgatcttgatcttgccaccgccgaccgcttcgatcaggtctggcaggtcctggtagatcagccagtcggcgccgatcaggtcggccacgtcctgggtcgaacgattgtgtgcgatcagctcatgggcgctcggcatgtcgataccgtacacgttcgggtaacgcaccgcaggcgctgcggagcagaagtacacgttcttcgccccggcttcgcgggccatctggatgatctgcttgcaggtggtgccacgcacgatggagtcgtccaccagcatcacgttcttgccacggaactcaagctcaatggcgttgagcttctggcgcaccgacttcttgcgtgcagcctggccaggcatgatgaaggtacggccaatgtagcggttcttgacgaagccttcgcggaacttgacgcccaaatggttggccagttccagggcagcggtacggctggtgtccggaatcggaatgaccacgtcgatatcatgctcaggacgctcgcgcaggatcttctcggcaagcttctcgcccatgcgcaggcgcgccttgtagaccgaaacgccgtcgatgatcgaatccggacgcgccaggtagacgtgctcgaagatgcacggggtgagcttcggcgccacggcgcactggcgggtgtgcagcttgccgtcttcggtgatgtagacagcctcgcccggtgccaggtcgcggatcagggtgaagcccagtacatccagggacacgctttcggacgcaatcatgtactcgacgccttcgtcggtgtgacgctggccaaacacgatcggacggatgccgtgggggtcgcggaaaccgacgatgccataaccggtgaccatggccactaccgcatagccaccgacgcaacggttgtgcacgtcagtcacggcggcgaatacatcttcttcggtcggctgcagcttgccgcgctgggccagctcgtgggcgaacacgttgagcagcacttccgagtcggaactggtgttgacgtggcgcaggtcagattcgtaaatctccttggccaattgttcaacgttggtcaggttgccgttgtgcgccaaggtaatgccgtaaggcgagttgacgtagaacggttgagcctcggccgaggtcgagcttccggcagtcgggtagcgcacatggccaatgcccatgtgcccgacgaggcgctgcatgtgacgctgatggaacacgtcacgcaccaggccattgtccttgcgcaggaataaccggccgtcgtggctggtcacaataccggcagcgtcctggccgcggtgctggaggacggttagcgcgtcatacagcgcctgattgacgttcgacttaccgacgataccgacgatgccacacatgcgacgcaacccctacttaatgaatcttgactgaacacagcttactgaggcgtttgcgccggcaagaggcgttccttgaacggaagatcagcgggtacgctgattccgctggccagccactgactgctccaccccaggatgaggttcttggaccaatctgcaaccaatagaaattttggcacgagtaccgactcctgccaccacgaatcctgctgtaccggccccaggctcaacagcccgaccgccacgaccaccagcaacgcgccacgcgcagcgccgaaggccatgccgagaaatcgatcggtcccggagaggccggtgacacgtatcaactcgccaataagataattgaccattgcccccaccagcagcgtggcgatgaacatgatggcgcagcccgcgatgacgcgagccgaaggtgtctctatgtatccagccaggtagaccgacagtgaaccaccgaacatccaggctacgactcctgcgatgatccaggtcagcaacgacagtgcttcttttacgaagccgcggctcagactgatcaaagcggagatggcgacgatggcaacaatcgcccaatcaacccaggtaaatggcacagtgcagcctacgtacggataaggcggcgcattttagcagagcgccgggcgatgggtaagctgtgattgcgggtgctttgcaaatcaatagattgggcggtatgaacgccatttcaagcccagcataaaccactgtgggagggggcttgctcccgatagcgatggatcagtcaatacaactgacactgacccaccgctatcgggagcaagccccctcccacatttagattgcattactgcctgcttgaatcagccgcgctcaggctggaagcgcaccacaaacccattgaggttctgctggcgccccaacaagtcccgcaggcgatcagcctcggcacgctcgatcagcggcccgacaaacacgcgattcttgccatcagcactacggatataagcgttatagccttgggcacgcagctttttctgcagagcatcggcactttcgcgattggccaggctggccagctggatcgaccagctgatcggcaggccattggggtcgatgcggctctggcccacgtccggcttacccggtgcggcaggctgcggcgctaccggcttgggcgccggtgcaggcgcagctggtttggcggcgactgtcggggccggtgtcggcttgaccaccggcacactcggctgcaccggcatcgaaggcgcctcttgcgcggcgacctcctcgtcagtcggcacgggttcttcctctggcaaagcctgcggttcaggcaccaccaccggctcgacctgaacctgaggcaccacgggcgcctggggtgcagcaggcgcctcaaccacgacctggcgctgctcatcctggcgggagaacagcatcggcaggaaaatcactgccaatgccaccaacaccagggctccgaccattcgctgcttgtatgcgctatccagtaatgccatgtgcagcttcctccgtggagcgccgggccaaccattcgagcgcctcggcgacacaataaaatgatccgaacaacaggatttcgtcgtcggcggtcgctaccgcacactgagcctcgagggcagcggtgacgcttgcatacgacgccacaagcgcgccaaggttctgcaacgcaacttccagctcaaccgccgggcggctacgcggcgtatccagcggcgcaacggcccaagactgaacgctgcccagcaacggcgcaaccacgccgtcgaggtccttgtcggccaacaacccgaacacggcaaggcgacgaccggccggtggcgtgcgcgacagacgctgcgccaggtagtgggcagcatgggggttatgccccacatccaacaacaggttcaggcgtttgcctgcccagtcgaaggcgcgacgatccaggcgcccgaccactttcgtggcttgcagcgtctgggcaatctgcgcggcatcccaacgcaggtccagcagcaaatacgcttgcagcgccagcgcggcgttttccatcggcaggttcagcagcggcagatccagcagctctaccgccttgccacgcgcatcacgcccgcgccattgccaatgggaagcaccgatttcaagattgaattcgcgaccgcgcaggtagaatgggcactccagttcgcgcaccttgtccagcaagggttgcggcggatccaggtcgccacacagcgccggcctaccctggcggaagatcccggccttttcatacgacaccgactcacgggtatcgcccaggtagtcggcgtggtcgacaccaatgctggtgaccaacgccaggtcggcatccaccacattgaccgtgtccaggcgcccgccgaggccgacttccagcaccaccacatccagttgcgcacgctcgaacagccagaacgccgccagggtgcccatctcgaaatacgtcagggaaatatcgccacgcccggcatccagggcagcgaaggcttcgcataactgttcgtcggtggcttcgacaccattgagctgcacgcgctcgttgtagcgcagcaggtgcggcgagctgtacacgccgactttcaggccctgggcctgcaacagcgcggcgacaaaggcacaggtggagcccttgccgttggtgccggtcaccgtgatcacacgcggtgccggctgacccaacccaaggcgggccgctacctgttgcgagcgctccaggcccatgtcgatggcggacggatgcaactgctcaaggtaggcgagccattcgcccagggtacgctgggtcataggtttgcaggcaccggcggcacgacgattggctcgactttaggcgcgacgtacacaggggtcggcaggcccatcatttgcgccagcaggttgcccaggcgtgggcgcagttcgccacgtggaatgatcaagtcgattgcgccatgctccagcaagaattcgctgcgctggaagccttccggcagtttctcccgcacggtttgctcaatcactcgcgggccggcaaaaccgatcagcgccttgggctcgccgacgatcacatcacccaacatcgccaggctggcggaaacgccgccgtagaccgggtcggtcagtacggagatgaacgggatgccctcttcacgcagacgcgccaataccgccgaggtcttggccatttgcatcagggagatcaaggcttcctgcatacgcgcaccaccggaggcggcgaagcagatcatcgggcagcggttttccagggcgtagttggcagcgcgtacgaagcgctcgccgacgatggcgcccatggaaccgcccatgaaggagaactcgaaggccgagaccaccacgggcatgcccagcagcttgccgctgaccgagatcagcgcgtctttctcaccggtctgcttctgcgcagcggtcaggcggtccttgtatttcttgccatcgcggaacttgaggcggtcgaccggctccaggtcagcgcccagttcgttgcggccgtcggcatccaaaaagatgtcgatgcgcgcgcgcgcgccgatacgcatgtggtggttgcacttggggcaaacgtccagggtcttttccagttccgggcggtacagcaccgcgtcgcaggatgggcacttgtgccacagaccttcaggaaccgagcttttcttcacctcggaacgcatgatcgaagggatcagtttgtctactaaccagttgctcatgctttctttctccagtaccggtggcttgaacacagccccgcgtatgcccttgagctaaattcatatgtggcgatgatacctgcgggacggggtcagacgttcgacctgccatttcctgccgtatcctcagccttccagacaacctgccagcgcagggttgccacttcatttccggcccaccacaggcggcgccgggctgttttacacagtggtagttatggacggcggcagactgccagccgtcacatcccaccactgctgttgcgcacggcctgcacaaatgcgcgaatcttgccatggtccttgacgcccttggcctgctctaccccgccgctgacatccaccgcatagggtcggacctgggcgattgccgccgcgacattggccggattgagcccgccggcaaggatgatcggcttgctcaggcccgcaggaatcagcgaccaatcgaacgcctcgcccgtgccgcccggtacgccttcgacgtaggtgtccagcaggatcccgcgagcaccggcataggctgcgcacgcagcggcgatatcgtcgccggccttgacccgcagcgccttgatgtaagggcgctgatagctgtcacactcctctggcgtttcatcaccgtgaaactgcagcatgtcgagcggcacggcatccagggtttcgttgagctcgcaacggctggcattgacgaacaagcccaccgtggtcacgaatggcggcagcgcggcgatgattgcccgcgcctgcaacacattcaccgcccgcgggctcctggcataaaacactaaaccgatggcatccgcccccgcctcgactgccgcgagcgcgtcttctatgcgggtaatcccgcaaatcttgctgcgaacggctggcatatcgtaggaacctcagggtttggaccgtgaaagtcccggatggtaacaaaagcttttccaggcgtcagccgccaagttcgctgaaacctgtgaggaagtgtggaccgataaagcgttccggcaattggaactcgtcgcggtactccacatccaccagatacaggccaaacggatgtgccgtaacgccgcccgtgcgacgaatgcggctttccagcacttccttggcccactccaccgggcgctcgccggtaccgatggtcatcagtacgccggcaatgttgcgcaccatatgatgcaggaaggccccggcgcggatatccagcacgatcatcttgccgtgccgggtgacccgcaggtggtggacctccttgattggcgacttggcctggcactggccggcgcggaaggcgctgaagtcatgcacacccaccagatgctgcgcggcctcggccatgcgctcggcatccagcgggcgatggttccaggtgatttcttcgttgaggtgcgccgggcggatctgatcgttgtagatcacgtagcggtaacgccgggcgatggccttgaagcgtgcatgaaagtgcgccggcatgaccttggcccagctcacactgacgtcatggggcaaattgatattggcgcccatcacccatgccttcattgaacgctcggcctgggtgtcgaaatgcaccacctggccacaggcgtggacacccgcatcggtacgcccggcacacatcagcgacaccggcgaatcagcgactttggacagggcgttttccagggtttcctgcaccgttggcacgccagaagcctggcgctgccagccgcgatagcgcgagcctttgtattccacgcccagggcgatgcggtaaaagcctgcggccgccatttcggcggccgcgttatctatatttgccaagaactgagagcctgatgagttgcgcaaaggcgggcattataaaggcgccggatgcgtggcgggcgttttgttatggatcgatgccaaacaaatgagggagggggcttgctcccgatagtggagtatcagtcaacaggttcattgactgagccaccgctatcgggaacaagccccctcccacactgttacagcgcctggcgttagatgcggccgagcatttccttggcttcgctacgctgaccttcatcaccctcggtcaacacttcagacaggatgtcctttgcaccgtccgcatcacccatgtcgatgtacgcctgggccaggtccagcttggtggcgacctcattggtgcccgagaggaagtcgaattccggctcatcaccgcccagcgccgcatcttctgcggtgaaggaaggctcgatgggcggatgttccaggctctgggacaagcggtccagttcggcgttgacatcatccagctccgacgaaaaggtgtcgggcttggctgcgggggcgttcggttcatctgccagagacaggtcgaagtcttccggcagttcgaattcgtccagtgcggcgggtgtcagtgtgggtggatctaccggcggcacatccgccacctgcccttcgagccccgaaaggaaatcgtcatcggactgcgacgccggcggctccaactgcaggtccaggtcgaagtccgacaggtcctgcgcatcaggcttggctgcggtctgttgctgcaacagcgcctcaaaggtttgctggtcttgcgcgatctcggccggtgaagcggcctccagatcatccaggctcaggtcgaaatcggtatcgagcgcggccgcatccgcctgaggcgtcggagccggcttatcgtcgagcaggtccttgacgtattgcgcatccaaggctgcggcggccactgcggcactgacacccgcggccaacacggccatggccgggaagcgcgccttcagctgctcgacttgggcatggttctcaccgttggccaccaattggcgctcctgggtgacgaaaccgtccttgtcgttctgcaggccgtagacttccatcagcttcaagcgcaggtcgctgcgcttgggctcgtgcttgatggcttgctcgagcacatcagccgcctggttcaggtgaccacggtcgatatgggactgggcttgcgccagggcatcgctggagttctcctgggccacggccacagccagcggcgcgagcacagaggcaacagtcggcacgactacgggctcaaccaccggggcaggcgctggagcggtcgccagcttgacgctcggcggcggtacttcaaggccttcgaaactgtcgggcggcaggtcctggtcaatgttggaggtgaactcaggctcttcggccaacgcccgagccatgcgcaggtgtttttcttcttcgcggcgggcattgcgatggcgcgcccacagcagcaagagcagcagcaccaccaggatggctgcgccgccaatgatgccaagcacaatcgggttggtcagcaggtcgttgaacttgccttcggtgctggcaggcgctgcagccggcttgaccggttcagggtcaggttcaggtgccggagccgccacgggcgccgcaggtgttgccggcgctgcctcgggctcgccggccagctgcgcaggcatagccgccgtcgccggctcacctttttcagcctgcaagcgggcgagctggtcattcttcagttgaatcagcttttgcagcttgtccaactggctctgcaagtcggcggcgcggcttttcagttcttcgttatcgcggcgcgtggtgtccagctcttcctgggtcatcgccagtttgtcgctcagggcgcggctgtcagcggccttgcccttcacgcctttcttggcggactcggccgagaccaggctcaagttgtcctgggccgaggtgctcgacggcgcattgccggcctgggtgcgtttggtcgcatccaactgcgccttgccggccacttggccttgaggggtacggcggccttggcgccaggcggcgttctgcgcgcttacttcggcaatcgcttgcggttgcgccagcgcagtgctttgtgtggcatccggcaggcgcaggacccggccagttttcagacggttgatattgccgtcgacaaaggcatcaggattgagcgcctgaatggccagcatcgtctgctggatcgaggcaccattgcgattcttcgccgcaatttcccacaaggtgtcgcgggaggtggtggtgtgctgggccggctggctgaccgcgggcgcagtgctggccggcgcgctggcagtcggggccggctggtcgaacttggccgggtcgagcagcacgctgtagtcacgcatcaggcggccgttgggccattgcacctgcatcaggaaacgcacataggaatcgggcagcggcttgctggaggtcacccgcacgacgctgcgaccttcggggttgatcaccggcgtgaacgtcaggtcatcgagaaacgcctggcggtcgacacccgcatccacgaaagcctgggccgaagccaggcttggcgtgatctcggaagccgtgaggccgccgacgtcgcgcaattcgatttccacggacagcggctggttcaacttcgacttgagggtcatctccccaagttgcagcgcctgcgccataccggaggtcagcgccgaggcggccgctattgctaacaccagtttgcgaacttgaaccatagcctcatcctttgtttgaacactccccgccctgcgagaaggttggtaaccgctgccataaggcatggcgagccgataggttaccgacgcgcttgtgttccacttggggccaagcatagcgcctggctagaatcaatctacaaattgccgccaagtatcttttacgcaaggccttttatcaacaactgcgccaattccacggcgttcagggccgagcccttgcgtacgttatctgacgtcagccacagatttagttccgcggggtcgtctacacctgcgcggactcgtcctacgtatacaacgtcctggccgacggcgtcgcctacagccgttggataatcgccctcctcgaccagctcgatagctggcgccgcctcgagggcgcggttcaccgcgaccagatcgaccggcgcggccaattgcaacgacacagtcaggctatcgccaaaaaacaccggggcttgaacgcaggttgcggaaatctttagcaaaggtgtttccagcacggcacgcaactcatgtacgagacgtttctccagctctgtatgaccctgggcatctggggtaccgacttgtgccaacagattgaaagccatttgccggtcgaagaacttcggctccagcggacgcacgttcaacagctcggcagtctggcgggccaactcgctgacggcttcgcggccctgggcggagaccgccaggttggcggtgacactgacctgctggatgtccaccaagccacgcagcggcgccagcaccgtcgcaaggtaagtggcgcaagggcttgggctgccgagctggaacggctttttcaaaccctccagcacatgggcgttagcctgcggtacaacttgcggcgcctgctcggccggcagtgcgccggacaagtcaatcaccgaacagccggcggccgtggcacgcggggcgaagctcagggtcaccgctgggcccgccgcaaagaacgcaagctgcgccttgctgaagtcgaactcgtcgacctccttgacccgcacgttcttgccacgaaacggcaccgaagcccccgccgagttactgcccgccagcaaatacaaggtgcccaccgggaaattcagctcttcaaggatctgcaccagggtttcgccaacggtgccggtggcgccgatcacggcgatttcaaaggtctgggtcatgggggttgcctcgggcgttacgggggagcggcactttaccgggtggttgggggtgaggcaattagcctgggccttgtggtgtggctgatggcccaatcgggggcttgcccccgattgggcccgaaagaccaacaaaaaacccgcgcctgtcaccagaacgcgggtttctcttactaccttaagcttaagcgatcaacgttccagcaagatccgcaacatgcgacgcaacggctcagccgcgccccacagcagttggtcgccgacggtgaacgcgccaaggaactggctgcccatgttcagcttgcgcaagcggcccaccggcacattcagggtgccggtgaccttggtcgggctcagctcctgcatgctgatatcgcggttgttcggcaccagcttgacccaagggttgtgctggctgatcagcccttcgatatcggcgatcggcacgtctttgttcagcttgatggtcagcgcctggctgtggcaacgcatggcgccgatgcgtacgcagatgccgtccaccgggatcgggttcttgaagcgcccgaggatcttgttggtctcggcctgggccttccactcttcgcggctctggccgttgggcagttccttgtcgatccacgggatcaggctgccggccaatggcacaccgaagttctcggtcgggtaagcatcgctgcgcatggcttcggccacacggcggtcgatgtcaaggatcgcactggccgggtcggccagttgatcggcgaccgcagcgtgggtcgcgcccatctgcttgatcagctcgcgcatattctgcgcgccggcgccggaggccgcctgataggtcatggcgctcatccactcgaccaaaccggcctcgaacaagccgcccaggcccatcagcatcaggctgacggtgcagttgccgccgacgtagttcttggtgccggcatccagttgctggtcgatgaccttgcggttgaccgggtccaggatgatcactgcgtcgtcctgcatgcgcaggctcgaggcggcatcgatccagtaaccctgccagccggcttcgcgcagcttggggaagacttcgctggtgtagtcgccaccctggcacgtcaggatcacgtcgagggtcttcaactcttcaatgctgtaggcatccttgagcggggcgatatccttgcccacggacggcccttggccacctacgttcgaagtggtgaaaaacaccggctcaataagatcgaaatcctgctcttccagcatccgctgcatgagcacggaaccgaccataccgcgccaaccgatcagacctacacgtttcatcgcaactacaccttgttaaaaagtgggccgccttgcagcaacaactgcaagcgggcccgagagattacagattccgcagcgcggcgactactgcgtcgcccatttcttgcgtaccgaccttggtgcaaccctgtgaccagatgtcaccggtacgcaggccctggtcaagcaccaggctgacggctttctcgatcgcgtccgccgcatcagccaggttgaagctgtaacgcagcatcatcgataccgacaaaatggtcgccaacgggttggcaatgccaaggcctgcgatatccggcgccgaaccgtggcacggctcgtacatgcccttgttgttggtgtccagggacgccgacggcagcatgccgatggaaccggtgagcatcgaggcctggtcggacaggatgtcgccgaacaggttgtcggtgacgatcacgtcgaattgcttgggcgcgcgcaccagctgcatggcggcgttgtcgacatacatgtggctcagttcgacgtccgggtagtccttggcgacctcctcgacgatttcgcgccacagttggctggaggccagtacgttggccttatccaccgaacagaccttcttgccacgcacgcgggccatgtcgaaaccgactcgggcaatacggcggatttcgctctcgctgtacggcaaggtgtcgtaggcctggcgttcgccattttccaactcacgcacacctcgtggcgagccgaaatagataccaccggtcagctcacgcacgatgaggatatccaggcctgccaccacttccggcttgaggctcgaggcgtcggccagctgcggatagaggatcgccgggcgcaggttgccgaacaggcccagttgcgcacggattttcagcaggccgcgctcggggcggatgtcacggtcgatcttgtcccatttcggcccgcccacggcgccgagcagcacggcgtcggccgcacgggcgcggtccagggtttcgtcagccaggggcacgccgtgcttgtcgatggcggcgccgccgattacgtcgtggctcagctcgaagcccaggctgtatttgctgttggccaattccaggaccttgaccgcttcggccatgatttccgggccaataccgtcgccagggagaatcagaatctgcttgctcatgtgttcctcatttcatcaagcgacccgcccgcgggcaggtcgggaaaaatccaatcagcgttcggcaaacaccaccagcacgtcggtgctgaaggtgccgtcggcctgtatttcgtagtattcacgcacttcctggcccatcgcctgttgcagctcaaggattgccgtgcgcaacacctctggcgtgcgcatgcgctcaacccacgaggtgtattccagacgcagacgctggcggctgctgttgcgcacatgcagaccggactcgctgagttgctgcatccactcggcggcggagtaatcacgcacgtgactggtgtcgcgcagcacttcgacggtttgcaggtaagtgtccagcaatgggctgcccggtgacaagacatcgacaaacgccgccacgccacccggcctgagcactcggcgtacttcgcgcagggccaggcccaggtcgctccagtggtgggccgaataacggctgaacacgaagtcgaactcgccatcggcaaagggcaggcgttcggcggcgccgtgtacggtacggatattgtccaggccgcggtcaaccgcagccgcggcaaccacatcgagcatttgctgggacaggtcgtaggccaccacttcgttgaccaaaggtgcgacatggaagctcacatgaccggcaccgcagcccaggtccagcagtcgtgcagcgccctgcccggccagctcggcctggagcagcgcgaattcggtgccctgggcgtgtacggcactgctcaggtaggccgaggcttgttcgccgaattgcttttgcacgacttgggtgtgggcggtggtggtcatgggggattcctcaatggaccttgtggtgtttgttctggccctatcgggagcaagccccctcccacatttgatcgcatttcaaactggaggaactgggtcaaatgtgggagggggcttgctcccgatagcggcggccctgcctacatcaatctatgcatcgcgaaacaaccaaggctggctcgcccgatgcctggcttcaaacgccgcaatcgcatcgccgtcctgcaaggtcaggccgatatcatccaggccgttgatcaggcagtgtttacggaacgcatccacctcaaagtgatacaccttgccatccgggcgagtcacggtctgtgcggccaggtcgacggtcaattggtagcccacagtggcttccacctgatggaacagctcatccacttcggcgtcgctcaagatgatcggcaacaggccgttcttgaagctgttattgaagaagatgtcggcatagctcggcgcgataatgctgcgaaagccgtattcctccagggcccacggcgcgtgctcacggctggagccgcagccgaagttttcccgggccagcaatacgctggcgccctggtaacgctccgcgttgagcacaaagtctttgttcagcgggcgcttggagttgtcttggtaggcatagcccacgtccaggtagcgccactcgtcaaacaggttggggccaaacccggtgcgcttgatcgacttcaagaactgcttggggatgatctggtcggtgtccacgttggcacggtccaacggcgcgacaaggcctgtgtgttgggtaaaagctctcatcgggtattcctcagatcaattcgcgaacgtcgatgaaacgaccgttgacggccgccgcggcagccatggccgggctgaccaagtgggtacgcccgccagcgccctgacgcccttcgaagttacggttggaagtggacgcgcaatgctcgcccgactccaggcggtcggggttcatcgccaggcacatcgagcagcccggctcacgccattcaaaaccggcttcgaggaagatcttgtccaggccttcagcttcggcctgggccttgaccaggcctgaacctggcaccacgatggcttgcttgatggtcgaggcgactttgcggcctttggcgatcactgccgcggcgcgcaggtcttcgatccgcgagttggtgcaggagccgatgaatacgcgatccaactggatgtcggtaatcgcctgattggctttcaagcccatgtacttcaaggcgcgctcgatggaaccacgcttgaccaggtcagcctctttcgccgggtccggcacgttctggtcaaccgccaagaccatttccggcgaagtgccccaactgacctgtggcttgatctgcgcggcgtccagctcgaccacggtgtcgaacaccgcatcggcgtcggacaccaggtccttccaggcttccacggcggcatcccaatcggcgccttgcggggcaaatgggcggcctttgacgtactcgacggttttctcgtccgccgccaccatgcccacgcgcgcaccggcctcgatggacatgttgcagatggtcatgcgaccttcgatggacaggtcgcgaatcgcgctgccggcaaactcgatggcgtggccgttgccgccagcggtgccgatcttgccgatcacggccagtacgatgtccttggcggtcacgccaaacggcaaggtgccttcgacgcgcaccagcatgttcttcatcttcttggccaccaggcactgggtggcgaacacatgttccacctcggaagtgccgatgccatgggccagggcgccgaatgcaccgtgggtggaggtatgagagtcgccgcagaccacggtcatgcccggcaaggtcgcaccctgctccgggccgatgacgtgaacgatgccctgacgcacatcattcatcttgaattcggtgatgccatattcgtcacagtagtcgtcgagggtctgtacctgcaaacgcgagacctgatcggcaatggcttcgataccgcccttgcgctcaggcgtggtcggcacgttgtggtccggagtggcgatgatcgagtcgacgcgccagggcttgcgcccagccagtcgcaggccttcgaacgcttggggcgaggtcacttcatggatgatgtgacggtcgatatagatcagcgacgatccatcatcgcgacgtttcacttcatgggaatcccaaagcttgtcgtaaagcgttttgccggccatcagtcggtcctcatcagcggtgcttctatacgccgggcttttcaataaccctttggcttgtgaggctgatggtatggcgctacattaaataactcaaattcatattttttatgctttggattaccaactggaatatcaccatggacctggccaacctcaacgcctttattgccatcgctgaaaccggcagtttctcaggtgccggcgaacgcctgcacctgacccaaccggccatcagcaaacgcatcgctggcctggaacaacaactgaaggtgcgtctgttcgatcgcctgggccgtgaagtgggtttgaccgaagccgggcgagccttgctgcctcgtgcctatcagatcctcaatgtgctggacgacacccgtcgcgccctgaccaaccttaccggcgaagtcagcgggcgactcactctggccaccagccaccatataggcctgcaccgcctgccaccggtcctgcgcacgttcactcggcaatacccgaacgtggcattggatattcagttcctcgattcggaagtggcctacgaagaaatcctccacggtcgtgccgaagtggcggtgattaccctggcgcccgagccccacaacctggtgcgcgccacgccggtatgggatgacccgctggatttcgtggtagcgcccgaacacagcttgatcagcaatggctccatcagcctggccgatatcgccgcgcacccggcagtgttccctgggggcaataccttcacccaccacattgtcagccggttgttcgaggcccagggccttgcgccgaatatcgccatgagcaccaattacctggaaaccatcaagatgatggtctccatcggcctggcctggagcgtgttgccgcgcaccatgctcgatgaccaggtggcaagtatcgctttgccgggcatacagctcagtcgccagctaggctatatcgtgcacaccgaaaggacgctgtcgaacgctgcgcgggccttcatgagcctattggatgcacaggtcgatctgccagggttaccggcatgacaccgtgcggccccgggctctaactactaccgcgctgttttcccaacgagccaaggccctttgataatgcgcaatcccgtcgacccgatacctcccctgccccgcatctacgccctggacccacaagcggcggaacagagctgggacagcgccccgcaattgctggcggccctcaatgccgcccggctgggtgcctggtgctgggaaatcgatacgggaaaaatcagttggtcccggggcacccaggcgctatttggctttgatcctcgccagccgctgcccaaagacctcgactatctcgatctgctcgcaccggaagaccgaacccgcgtgatacgcggttttcacgcggtactcgccggggagccattcgagcgcgccatgcaccaccgcatccagtggcccgatggcagcctgcactggctggagatcagcggcagcctggcgcccgacaaagcgggtcgccgccgcatgatcggagtgattcgtgagatcactcaccagcgcgaacgcgaatacgccctcagtcattcagaaaagcgcttcgccacgctgttccacttgtgcccgaacatggtgctgctgacgcgccaggccgacggtttgatcagcgaggccaaccagtacttcgaaatgctgttcggctggccggtggccgacgccatcggccgcaccaccctggagctgggcttgtggcgcgaccctgaacaacgcgcactgctggtcaaggccacccagcgcaaaggcgagcccatgaccatggaggtgcagttctgcgccagcaacggccagatccacgacggcaccctcagcgctcagaaagtcgagctggacggcgaggcctacctgatcagcacgttcctcgacactacagagcgcaaaaatgccgaacaagcgctcaaggacagccaggaacgcctggacctggccctggattcggcacagctgggcacctgggactggcacatacccagcggcatgctttacggctcggcccgcgccgcccaattgcacggcctggaccccgcaccgttccacgagtccttcgacgcgtttttcgaaggcatgtccgatgaagatcgcgagggcatgcgcaacgcctaccgcagcttgcgcgaagggccgggtggcaactatcagttgacgtatcgcgtgctgatggaggacggcagcccacgctacctggaaagccgtgcccgcctgtatcgcgacgaggctggccaccccttgcgcatggccggtacgttgctggatatcaccgaccaggtcgagcgcgaacaacggctcacagcctccgaagaaaaattcgccagcttgttccaggccagtcccgacccgatctgcgtgaccgacctggacagcggcgcctttattgagatcaaccccgcattcacccagaccttcggctttaccgccgccgaagtgatcgacaaaagcgccgaacagatcggcctgtgggacgagtccagcaagcgcctgcaacgcatcgagcaggtgattcgcgaacaggccctgagcaatgtggccgtcgtggtgcatcacaagaacggccaaagcctgacctgcgtgatttccagccgcttgatcaaggtcagcgaccagtcatgcatcgtcaccacactgcgcgatatcacccagcagcaacgctcggaagccgcgctcaaggccagtgaagagaaattcgccaaggcattccactccagccccgacgcgatttccatcaccgagcgcgacagcggccgttatgtggaggtcaatgatggtttttgccgcctgaccggttaccgcaccgaggaagtgatcggcctgaccctctaccagatcggcatctgggccgatgaaaaccagcgcgccgccctactggccgagttgcaggtcaagggccgcattcatcatctggaaatgctctggcacaacaaacgtggcgaggtgttggcggtggaggtttcggttgagccgatcaccttgaatgaaaccccatgcctgctgctaaccgcacgggacgtcagcctgttgaaaaacgcccaggcgcagatccgtcacctggcgtaccacgacccgctcaccaacctgcccaaccgtgcgctgctgatggatcgcctgagccagcagatcgccttgctcaagcgccacaacctgcgcggcgccctgctgtttcttgacctcgaccacttcaagcacatcaacgactccctcggccatccggtgggcgacaccgtactaaaaattgtcaccgcacgcctggaagccagcgtacgcatggaagacaccgtggcacgcctgggcggcgatgagttcgtggtgctgctcagcggcctggagggttcgcgccaggccgtcagcagccaggtgcaagcattggccgacactcttcgcgagttactttcggaaccgatgttcctcgacggccatcggctgcaggtcacgccgagcatcggcgtggcgctgattcccgaccatggcagcacaccggccgacctgctcaagcgcgctgacatcgccctgtaccgcgccaaggattcaggacgcaataccacacagatgttccacaacagcatgcaaaaaaccgccagcgagcgcctgcgcatggaaaccgacctgcgcctggccttgtcacgcggcgagttcagcgtgcattaccagcctcaagtagacgcgcgcggcaacaggattgtcggtgccgaggccctggtgcgctggcagcatccgcaactgggcgcgcagtcgccaacggaatttatcaaggttttggaagacagcggcctgatcctggaagtcggcacctggattctcgacgaagcctgcggcgccttcgcacaattgattgccgacggcctggtggacccgctcaatttcagcctgtgcgtgaacatcagcccgcggcagtttcgccaaaatgattttgtggagcgggtggaacgcagcctcgaacagcaccaactacccttcagcctgctgaaactggagatcaccgaaggcattgtcatccagaaccttgacgataccgtggcgaagatgcgccgcctgaaaaagctaggcgtgagcttcgcaatggatgatttcggcaccggctactcatccctgacctacctcaagcgcctgccggtggatgcattgaaaattgaccagtcgttcgtacgcgatgcgacccacgacccgaatgatgcggaaatcatccgcgccatcgtagccatggcgcgcagcttgaacctggaggtgattgccgagggcgtggaaaccccggaacaactggcgttcctgcagcagctgggctgccatttattccagggttatttgcacagccggccgttaccgatagaggggttcaggcgactgctggagtagcgatcacatcagcgctacggcctgacctcgcgtgggggccgaaccttggcgcccccataattcttcgcggccattgatgaccgccaccgaatgcatggcccggttacacatacccagttgcccgttagcaaggtcgcgtacagaaacctttttcatatgcttcttcaaccccagccgcatgaacccttcacccggcccggtctcgtcctcgccattattcaaactgcggatcgccgcctggaagcttcggcccgccgtacgatcattgttttccatctgcgcacgcttggcactgaccgcaaacaaaaactgcgcatccttgagcatccccttgtccgcgccgacaaaccgcgcgcttcgtgccccttcggcgagctcacggtcggtcagggtgagcttgaagtcgtcacgcatgaccacctggtagccgccactggttttgatcacttccttgaaaatatccgtggggctctggccaaatcgatacatcgccgccttgatggccgataccgtcacacagttgccatcggggccttggcgaaacccgctccagatgttgtcaggcttggcgccatttcgcttgctggaaagcccctggatttccagtgcagcgcctggtttgggggcgacaggttctggcgtcacctgcggggtaacttctacggaaggagcaggtgcatcaggacgtacctgggcccgtctatctcttcgatcagatatcaatgcttgtaactgaaaagaaattgaacgcaacgcagtaagaacttccggcaacttgtcagtttcggttttgctttccgacaccgtgctggcaggaacgtttacatcgcgcttaataccctcactgccagaccacagcgctgggcttgacttattactcgcctcagccagatcaccgaacttattgaaatctacaatacgcgcaatattgtttattgaatggatagacatatacttctccacacacaggcatcccacgaatacacacgtcgccgaaggtgcctgcttttcttaaaattttaaaccagcccgcgcatacacagcctcggggcgctcttccgcccctgattcagtgcgggtattgatttgatttttatgaactggaaacaacagcgtcacccagtccacctattcgtggagaattcgcctatcgagttcccgaaatcgtttctcatataaccacacctacacgtactcaaggacgccacttcttgtctgcgcccgttgagcccttgcaccacgcggctgccgacaaagctcgatccttacatacgttaataaactgcttacatgtaaatagccgataatattcgagcaacttcaagctgagtttttatggtatttcgcgcacgagaaagatagggctccactggagccctatcaggtaaatttaaaacttaattaatgattcaatccaacgtgacggggtgctgcatgcccaacaggcgactgacctgctccaattgcgtctcacggcgcagggccgtgaacagctccaccgcctccgggtaattgcgtgtcagcatcgccagccattgcttcaagcggccgggcgcctgcttttcagtcagttgcgccaccgattggcgccagaattcctgcagcatcggctgcatctgcgcccaggtcatttcgaccacgtcctcgcccgccttcgcggctacgatctgccgcgccaagtcagggcgcgccaccaagccacggcccagcatgatgtcttcggcaccactgatttcgcggcaacgcttccagtcttcgacgctccagatatcgccattggcaaatacaggcaccttgaccacgtcctgcacccgcgggatccactcccaatgggccggcggcttgtagccatcggccttggtgcgcgcatgcaccacgatatgcgcagcaccgccctcggccagggccgtggcgcacaccaacgccccgtccgggctgtcgaagcccaggcgcatcttggcggtgaccggaatatgagcgggtacggcgcggcgcacgtgttcgacaatctggttgagcaattccggctccttgagcagcaccgcgccaccacgggatttgttcaccgtcttggccgggcaaccgaagttcaagtcgatgacttgcgagcccaactcgcaggccagtgcggcattttccgccaggcataccgggtcggaaccgagcagttgtacacgcagtggcacgcctgccgccgtgtgggcaccgtgcagcagttccggagcgagcttatggaaataggcaggggtgagcaggcggtcgttgacgcggatgaactcggtcacgcaccaatcaataccgcccacgcgggtcaacacgtcccgcaggatgttgtcgaccaacccctccatgggcgccaaggcaatttgcatggaaaacactcaacaaaaatcgtggcgcagtttactgggtttcctgcggtaaccgttaacccccggtcagggcggggccataaccttcaataaactcggcgggcatacgcttgggcttgccgctggacagctcgatgcacacaaaggtggtttgtgcacgcagcagggtcgcgccatcacgggggcgtaccagctggaaacgacgggtcattttcaggcgctggtcccaatcgacgatccaggtggccagttgcaactcatcgccttcatagccggccgccaggtaatcgatctcgtggcgcaccacggccatggcacgatccaggcgccggtattcggtgaggtccagccccaggcgctgggaatggcgccaggcacaacgctccagccaggacacgtacactgcgttattggcgtgcccgaggccgtcgatgtcctcaggcgcgacctgcagatcgatgataaacggcgttgccaggtcccagcccatgccttgctccagtcgattaatgtcggcggggcagtgtatcaggcgatttgccgttcctgtaggcggccagccaacagcacgagtaccgcatcgatcacccttgggtcggccagcactttctgatgcccgccggcctccaggcgcagcagacggctgtcgaaccatgcctcatggatggcttgcgacgccttgaccggcacaaaggtgtcgtcttcggcatgcacgatcaggccgggaatattcatctggtagtgagccacatccaggtgcttgaggggcatgccgaacgtcagttccacttcctggatgaacgccgcccgcgcacgcgccggcaggccgaccatctgggtgaagccgcgcaacacatccagaaaacgcgacggcgcggcaatactcaccaacgcctcggtacgcagccccagctgcaccgccagcatcgcactggcaccgcccatggaatggccaactaccgcatgcagcggcggtaactcggcagcggcctcaagcatggcgcgggcaaacagcagcacatgggcttcacgccccggcgaacgaccatgggcaggaccatcgagggcaatcactgaataaccgttgtccaccaacgcagtgatcaggctggcgaactgggtgggccgaccttcccagccgtgcatcaacagcaccgccgggccctggccccagcgcagggcggacaagccaaagcgcaaagtaatgcgctccgactgcgccaacagcggcagctcccaggctcgtggcggcaggtcacgcggcgtcatgaacacacgtcgcatcctgttggccacggtttgcggcgccagatgccccagggtgccgttgaagcgacgagtccaggttaacgtgcccatcttccagccctcttctagcgtacggccgacttggcagcgcgcagcacacggtcagacaactcacccgggccaagggcacgcgccagggccaggccgccgatcatcagcgccatgtccgccagggctttgtcagtgtcctcagggctggccgccagctgcgcagccatcagctcacagtgctcattcagcgcctggcggaattcatcgggcaggcggctcatctcgcccaccgtcgccgggatcgggcaagcctgggtggtagagtcgcgatgcttgcgcgacagataaaacgccgccaccagcgccctgcgttcttcaccggtcagttgggagtccatgtcgtcaatggacgcgcgacgcttggccaacagctgcgtgaacgcctcgagcatcaaggcgtccttgctttcaaagtgcgcatagaaaccaccgaccgtcagccccgccgcacccatgacttcgcccacgcttggctcagccgggccacgctggatcaacgccgcgctggcagcctgcagaatacgctcgcgggtctgggcttttttatcgctcatacttgcctccgtctctcatgggttgaatattattaccataataatatttggcaagcgaccggcatgaccattggtcagtacacaggaatggggttggggagaggattggccaaacgccagacaaacaaaagggccattcaataattgaatgacccttaaaaatcccgcaaagcgggtaatcgtggcgtcccctaggggactcgaacccctgttaccgccgtgaaagggcggtgtcctaggccactagacgaaggggacacaaaccttctgtacaactgatcagggctgagacctgatcgattcaaggccggtgtggccagaccttgaacctgtagattggtggagctaaacgggatcgaaccgttgacctcttgcatgccatgcaagcgctctcccagctgagctatagcccctcatcggtgaggacggggcgaatcttaatggcggtttggaaaggtgtcaaatttattttcaacattttccaaaattttttgccgggataacaatcacttaccgacaaaaccccggaaaaccggggttttgtcactgcaacggcctgattacacgatggcgcccagcagcttttcccattccttgttttctttcttcgacacaccaccaagcaaatcaagggcttggcgcagacggaaacgggtcaagtccggcccaaggatttccatcgcatcgagcaccgacaccgaactggcttgcccggtgatcgcggcaaacatcaggggcatggcgtcgcgcagtttcaactcaagggattccaccaccgcctggatcgtcgcggtgatggcgtccttctcccactggcgcaggctttcgagcttccacaggatcaactgcatcagttggcgaacctggtcagccgaaagcttcttcgactcaaacaacttggcatccgggttcacgcccccggcgaagaagaaactggccaacggtgcgacctggctgaaggtctctaccctgccctgcaccaatggcgcgatcttcatcatgtactcagggttcaacgcccactgctgcacacggctggcgaactcttccaccggcaggtcacgcagccactggccattgagccacgacagcttctcgatatcgaagatcggcccgcccagggagacgcgggacaggtcgaagttgtcgaccatttcctgcagcgagaacttctcacgctcgtccggcatcgaccaacccatgcggcccagatagttgagcatcgcttcaggcataaagcccatgcgctcatagaaggttaccgacgtcgggttcttgcgcttggacagcttgctcttgtccgggttacgcagcagcggcatgtagcacagctgcggttgttcccagccaaagtactcgtagagcaggatcagcttcggcgccgagggcagccactcttcgccacgcaatacgtgggtgatgcccatcaggtgatcgtcgaccacgttggccaggaagtacgtcggcaggccgtcggtcttcatcagcacctgcatgtccatgcggtcccacgggatctcgacatcgccgcgcagcatgtccggcaccacgcacacgccttcgcttggcaccttcatgcggatcacgtgaggttcgccagctgccaggcgtgcggccacttcttctttggacagcaacaacgcacggccatcgtagcgtggggtttcgccacgggcctgctgctcagcgcgcatctggtccagctcttcggcggtgcagaagcacgggaaggcgtggcccatgtcgaccagttgctgggtgtactgcttgtagatgtcgctgcgctcgctctggcggtacgggccatgggggccgccgacgtccgggccttcggcccaggtaatgcccaaccagcgcaaggcgtcgaaaatctgctgctccgactcacgggtggaacgcagttggtcggtatcttcgatccgcaggatgaattcaccgccgtgctgcttggcaaagcagtagttgaacaaggcgatgtaggcagtaccgacgtggggatccccagtaggcgatggcgcaatgcgcgtgcggacggtggtcatggcaggtctcgaatgggcgataaaactgaaaattgaagcaaggggcgaatggtaacagcctgggggatttctggaaaaccgcggcgcggccatcgggggcaagccccctcccacatttgaccgagttcacacataacagtgtgggagggggcttgcccccgatgaggccagtaaagccagcgcaaatcagaccgtcagcaaccgctcacgcaacttgccaatctcatcgcgcgtctgtgccgccgcctcgaactcaagatcgcgcgccaactggtacatcttctcttccagttgtcgaatgcgcttggtgatttcactcggcgaacgcagttcgttctcgtacttggcgctttcctcggcggccttggccatgcccttgcgcttcttgctgcgcgagccgggcacggtggcgccttccatgatgtcggcaacgtccttgaacacgcctttggggatgatgccgttttccaggttgaacgcgatctgcttgtcgcgacgccgctgggtttcgccaatcgcccgctccatggagccggtaatgcggtccgcgtagagaatcgcgcggccattgaggttacgcgccgcacggccgatggtctggatcagagagcgttcggagcgcaggaagccctccttgtccgcatccagaatcgccaccagcgacacttccggcatgtccaggccttcgcgcagcaggttgatccccaccagcacatcgaaggtacccaggcgcaggtcgcggataatctctacccgctccacggtgtcgatgtccgagtgcagatagcgcacgcgcacgccatggtcggccaggtagtcggtcaagtcttcggacatacgcttggtcagggtggtgaccaatacgcgctcctccagggcgacacgcttgttgatctccgaaagcaagtcatcgacctgggtcagcgccgggcggatttcgatttccgggtccaccaggccagtcggacgcaccagctgctcgatgacgcggccggcatgctcggcttcatagttaccgggcgtggcggacacaaagatggtctgcgggctgatggcctcccattcatcgaagcgcatcggccggttgtccagtgccgacggcaggcggaaaccgtattccaccagggtctctttacgcgaacggtcgcccttatacatggcgcccacctgcggcacgctgacgtgggactcgtcgatcaccagcaaggcgtccggcggcaggtaatcgtagagggttggcggcggcgcaccggactcgcgacccgaaaggtagcgcgagtagttttcgatgccgttgcagtagcccagctccaggatcatctccaggtcgaagcgggtgcgctgctccaggcgctgggcttccaccagcttgttgttggaacgcaggtattccaggcgctcggccaactcgaccttgataccctcgatggcgcccatcagggtttcccgcggggtcacgtagtggcttttcgggtagaacgtgaagcgtggcaacttgcggatcacttcgccggtcaacgggtcgaaggccgacaggctttcgacttcatcgtcgaacagctcgatgcgaatcgcttccaggtcggattccgccgggtagatatcgatcacatcgccgcgcacccgaaaggtagcgcgggcgaagtccatgtcgttgcgggtgtactgcaggctcgccaggcgccgcagcagttcgcgctggtcgagtttgtcgccgcggtcgacgtgcagcaccatcttcagataggtttccgggctgcccaggccgtagatgcacgacaccgtggtgacgatgatcgcgtccttgcgctccagcaaggccttggtcgctgacagccgcatctgttcaatatggtcgttgatcgatgcatccttctcgataaaggtatcggaggacggcacgtaggcttcgggctggtagtagtcgtagtaggaaacgaagtactccaccgcgttgttcgggaagaacgccttgaactcgccatacagctgcgcggccagggtcttgttcggcgccagcaccagggtcgggcggttgatctgggcgatcacgttggcgatgctgaaggtcttgcctgaaccggtcaccccgagcagcgtctgatgggacagaccggcctcgatgccttcgaccatcaggcgaatggcttccggctgatcgccggcgggttcaaaacgggtgacgagctggaaatccgacataacgtacctcgtgtagtcaccccagactcaacaccgccagggacgaaatagctcagcaacccgcgattaatcatcgcaggttgcaggaaaaaaccatgatagctgtagaagtggtgacgaatgtgatgggtttcaaggctatcctcctacaagacctttcccttcaatgttgcaataagactaacggtcaacaaataaaccgaaaaacatcgccgaaaagccgtttcggttgtcgccctcagccgtgatggcctctatactagctccccgtttgtgcaccgctctagtgcattcggctggagcgcgacacgtccctcccttcccccatagagctgccgcaaaaatgagcctgttttccgctgtcgaaatggcaccacgcgatccaatcctgggcctcaacgaagcattcaacgccgacacacgaaccaccaaggtcaaccttggcgtgggcgtttactgcaacgaggaggggaaaattccactcttgcgtgccgttgccgaagcggaagccattcgcgtggcgcaacacgccgcccgaggctacttgccgatcgacggcatcgtggcctacgaccaggccgtgcaaaagctgttgtttggtgctgaatcccccctgctgagcgctggccgcgtgatcaccgcccaagcggtaggtggcactggcgcgctgaaaatcggcgctgacttcctcaagcaattgctgcccaatgcagtggtcgccatcagcgatccgagctgggaaaaccaccaggcgctgttcgaaaaagccggtttcccggtgcagacctaccgctactacgacgctgcaacccacgacgtcaaccgcgccggcctgctcgaagacctcaacgctttgcccccgcaatccatcgtggtgctgcacgcctgctgccataacccgaccggcgtcgacctgagcccggccgactggcaaaacgtgctggaggtggtcaaggccaagaacctggtgccgttcctcgacatggcctatcagggctttggtgatggcatccacgaagacgccgctgccgtacgtctgttcgctgaatcgggcctgactttctttgtgtccagctcgttctccaagtcgttctccctgtacggtgaacgcgtaggcgcgctgtcgatcgtcagcgagtccaaggaagaaagcgcgcgcatcctgtcccaggtcaagcgcgtgatccgcaccaactactccaacccgccgacccacggcgcggccatcgttgcagctgtgctgaacaaccctgaactgcgtgcccagtgggaagccgaactggctgaaatgcgcttgcgcatccgcggcatgcgcgaacagatggtggctgagctggccaaggcggctccaggccatgatttcagcttcgtcggtcgccagcgcgggatgttctcctactctggcctgaccgttgagcaagtcacccgcctgcgcaccgagtttggcatctacgccctggacaccgggcgtatctgtgtggcggcgctgaaccagtcgaacattggtgcggtcacacaagcaatcgttcaggtgctgtaaacctgctggcgttgcacagaagggggaagccatggcttccccttttttgtgtccagcccctagactgaaccttgaccgcccctttgctgtgagagccctatgagaaacgacgacctggacctgcgtgccgaccgcgacgaattgcacgattacgccccacgtgcaccgcaagccaaacgccagaagagcctggtgctgcaagtggcgctgggggtgttcctcggtggtttggcgttgtggctggtgcaactgggtgcgacggcgatcatggccaaactggccatgggcaccttccaattcggcggctgatgaagaacaaaatgtgggaggggcggtgcgacgattcgacttgctcccgattgcagtctttcagccaagtattcgttagctgaaacatcgctatcgggagcaagccccctcccacattgaactcaggcggctgccaggccgcgttcttccagcagttttacgaaactgttcaggctctgtgacacagtgccccggcgccagatcagccaggtattcagtaagcggaagctgtccgtcaacggccacacactcaccgccgcacaccccggcatactctcaagcatgctgcgcggcatcagcgccagcccggccccggcgctgacgcaggcaagcatgccgtggtaggactcgatctcgaagatcttgcccggcatcgcgccatcctgtgagaaccagcgctcgaagtggtgccggtacgaacagttggagcgaaacgtatagatgttttcgccattcacatcctgcccgcgggtgatcggcgcgtgatgcagcggcgcaaccaccaccatctcctcttcgaacaccgccacgccttccagggtggaatgcagcaccggtccgtcaacgaaagccgcagtcagccgcccggacaacacgccttcaatcatggtgcccgacggtcccgtgctcaggtccagctcgaccttggtgtactgctggttatacgccgccaacaaggcggggatgcgcaccgctgccgtgctctccagggagcccagggcaaacgcaccttggggctcctcccccgccaccgtagcgcgggcctcttgcaccaggtcgagaatacgccgcgtataaccgaggaaattccaaccggccggggacaggcgcaaacggcttttctcgcggataaacaactccacgcccaggtcctgttccaattgcttgatgcgcgtggtgaggtttgacggcacccgatgaatcagctgcgcggcagcgctgatgctgccttgctcggcaacggccttgaaaatttccagctgcaccagatccacttcattctccaatcgtgaatgtattgcttaatattattcagtttccagaaaagatacagccccgtacgctggccccattccacttattcagccggacggtgccatgaacgcaatgacccaccagacccacgccttgtcgatcaaccccgccaatggcgaaacagtcgccagctatgcctatgaaaccgcggcacagttggacgccgccctcaccctttcggccagcgcgttccgcacttggcgccgccagccggtcagccaacgcgcagaattgctgctggccctggccgccgccttgcgcgggcaagccgaagccatggcgcaaatgatcaccctggaaatgggcaagcccatcgcccaggcccgcgccgagatcgaaaaatgcgcgcaactcagcgagtggtacgccgctcatggtccggccatgctcgcccctgagccgaccctggtagacaaaggcagcgcccggatcgaataccgcccgctgggcccgatcctcgcggtgatgccgtggaacttcccggtctggcaggtgctgcgcggcgccgtgccgaccttgctcgccggcaacacctacgtgctcaaacacgcgccgaacgtgatgggcagcgcctacctgatccagcaagcgttgcgcacagccggtttcgctgaaggcgtattcgaagtgatcaacgtgacccaggacggcgtgtccagcgccatcgctgacccacgtatcgccgccgtgaccctcaccggcagcgtgcgcgccggtatcgccattggctcccaggccggcgccgcgctgaagaaatgcgtgctggaactgggcggctccgacccgtttatcgtgctcaacgacgctgacctcgacgctgctgtgcaagcggccgtgatcggccgtttccagaatagcggccaagtctgcgccgccgccaagcgcctgatcattgaagctggggtggtagaagccttcaccgccaaattccttgaggccagccgcgccctggtgatgggcgacccgacattgaacactacctatatcggccccatggcccgcttcgacctgcgcgacgaactgcacggccaggtccaggcgaccctggaagaaggcgcgaccctgctgctgggcggcaacaaagtcccaggcgcgggcaattactatgaaccgaccgtgctggccggcgtcaccgatcagatgacctcgttcaagcaggaattgttcggacccgtggcgtcgatcattaccgcccgcgatgccgagcatgctgtggccctggccaatgacagcgagtttggcctcaccgccagcatcttcaccaccgactcagccaaggcccgcgatattgccgagcaactggacaccggcgggatattcgtcaacgcgttcagcgtgtcagaccctcgggtggcgtttggcggtgtgaagaaaagcgggttcggccgcgagctgtcgcacttcggcgtacgcgagttctgcaatgcgcagacagtatggctggaccgcaaatagccagacaggggcgactgcgctggctgcgcagcaaccccagtcgtgcatcaactgcggatatgacggcgcacgcactgcaccaacccttccaacgcctgcgacttcaccggcgcgagcacacagaccgtgtgctcacgctcgccctccgccactgtcagggtgtagtgcactcggccggggtttccggcttcgggaacggtgctttgtggcaactgaaaaaaatccgaagcttcgatcagttgccgcaattcctgctggtccggctcgggtagcttctccagctctaccgtacgcggcttggccagccccggaaaatacgccgccccgccgctttccttgattgagattcgcatagctgttcctcgccgcccaagcggctggtcaaacgttgatgcccacggctttccacccctccttgaccgctttctgttcatccttgttcgcgccgtaaagacgcccggctacatcataggtaatacgcgcaaaacgcaggaaccccgagttcggtctcagccgcgcatcccgcagtgcgtcataccagatgcgccctgcacgctcccaggcgaacccgccaatcttggtcgccacctgatagaacgcgtggttgggaatgccggaattgatatgcaccccgccattgtcctcgtatgtctgtacaaaatcatccatgtgacccggctgcgggtccttgcccagcagcttgtcatcaaacgcagtgcctggcgccttcatcgagcgcagggccgtgcccttgatctttttggtaaacagccctttgccaatcagccaatcagcctcctcggcggtttgcttcaacgcatactgcttgatcagtgagccgaacacgtcggacagcgactcgttcaacgcgccggactggttgaagtacatcagcttggcctcatcctcggtaacgccatgggccaactcatggccaatcacgtcgagcgccacggtaaagcgattgaataactgctggtcaccgtcgccgaagaccatctgggtcgaattccagaacgcgttgttatagtcctggccgaagtgcaccgtggcgtccagggccatgccggcatcgtcgatggaattgcggtcgaacacctggtcaaaaaaatcgaaggtggcgcccaagccgtcataggcttcgtccactgcggcatcgccgctggcaggttgcccttcgccgcggatcaacttgccaggcaggctgtcggtgttttcagcgctgtagatcgagcgctgtttctcggcgcccatgaccaacgccatgcgggctgggcccttggcaggtacggcgaccatgcgcaacgagcggaacgtgctgtccttggcgcgagtgcgtaatgcgacttcccgttgggctttatccccgtggcgggcgatctggtcgagcatatagggtgggatcagacagaaaatcgggttgcgcggctggcgaacacacataagctggctcctttttggcgtgtgatgaacgtccggtagcggtttcaggatagacctgtgttcgccacctgggccaaattgtcatgagtttgtgttgcagtggtgtttatccgaggcccataaggaacatgcccatgcccgcccgcacagccaaaatcgacctttcccaccgccccaggctttccgacctgcgcccattggtcgcgctcagccccaccctgctggaagccagaaccgcgacaccgcgcgtcaccgccgccaaggacctcaaaaaccgcgcaggctatgcccatgacttcctcagcgacttcgtggtgccatggcctacggtcggcgagccactgtcgagcgacgtgcaacccaagcgcctggactacacgcatttctccatcactatgtcgcgttcccgacgactggcgctctacgtgggggtgaatatcgacggctcaaagcatgtggacatcacgcgcagcaacgacacttgggcctacgatggtcgcctgcccctggatgcgcaggtaggtgaagacctctacgccagcaatggcctggaccgcggccacctggtgcggcgccaggaccccaactggggcgacgaggccaacaccgccaacttcgacaccttccatttcaccaactgctcgccgcaaatgagcggcttcaaccagaagacctggctggaactcgaagactacattcttgacaacacccagcgctggaaagctcgggccacggtgtttaccggcccggtattcgccgatgacgaccgactttatcgtggggtgaaaatccccaaggcgttctggaaagtcgtggcttacctcagcgacgacggcaaaccctccgccagcgcctacatgatcgaccaaagccgtgagctggggcagctcgacctggtgttcggcccgcttcgtacctaccagcgcagtgtgattgcgatcgaacaattgaccggcatccgcttcgccaatctggccgactatgacgggttcagcaatgaagaacgtgcgacaggtacgcggatcgaagcgctgatccgcggcccccaagacatacgactctgagagcggcccattgtaggagcgagcttgctcgcgaagcacctgagagcgctgcggcgtatcaggtttcccgcgttatcgttgacgaccttcgcgagcaagctcgctcctacagggggtgatcgcttaccataccgccgccggttcccgtatgggactaatagggaattcgaaacgccgcccgcgacgtcaatcgaaactgcccccgcaactgtaggtgccgagcctgctccccactgccactggaccctgtccgggaaggcgggagcgaggcaacgacgcatcagtcaggagacctgccggcccagcaaaaccactaaccggcggggtgtccgggaaggacatccttgcctgcctgatcgcagcgttcgaggctgtatttccgagccgtaccgcccctgctgcactcggagatcaccccatgctgccacgcgttaccgccttgatcgcaggcttgggtgcctgtgcaatggcccaggccacgcccacccattacccgctgaccctggaaaactgcggcagtaccctgaccttccagcacgcgcctgcacgcagcgtaaccatcggccaggccgccaccgagatgctctacgccttgggcgtgggcgataaagtggttggcacttcgctgtggttcaacaacgtgttggcgcagtacaaggcacaggacgccaccgtcgagcgcctggccaacaacgagccgagcttcgaagcggtgatcgccaagcgcccgcaactggtggccgccgagctggaatgggtggtggggccccaaggcgtggtcggcacccgcgagcaattccatgagctgcagatccccacctacctgctgccctcggactgcgaaggcaaggacaacctggtgggtgccgacggcacgcggctggagccgttccgcatcgacacgatttataaaagcatccgccaactggcgcagattttcgacgtccaggatcgcggccagcagctcaacgacgaactacaggcgcgcctggccaagtccatcgccaccgcgcaaggcaaaggcttgaagcaagccagcgcgctggtgtggttctccagcgccgaaatggccagcgatccctacgtggccgggcacaagggtattccgcagttcatgctgcaaaccctcggcctgcgcaatgtggtgcagtccgatgaagaatggcccgccgtcggctgggaaaccatcgccaaggccaacccgacgttcctggtgatcgcacgcatggatcggcgccgctaccccgccgacgaccacgagaagaaactcgctttcctgcgcagcgacccggtgacccgcaacatggacgcggtgaaaaacaaccgcatcatcatcctcgatgccctggcgctgcaggccagcctgcgtaccttcgatggcctggaacaactggccgccgccatcgacggctatgacctgccgaaatgatacggaccctgcttgctctcacactgctattgctcgccctgctcgccggcgtggccatcggcgaaaccgccatctcgccacaggtggtgctccaggtgctcgccaacaagctgtgggccgcaggcttcgtgctcgaccccatcgatgaaggcgtggtgtggaactatcgcctgacccgcgccctggtggccgctgcctgcggtgcagggttggcgacctgtggcgtgatcctgcaatcgttgctgcgtaacccgctggctgatccttacttgctcggcatcagtgccggcgcgtcgaccggcgcggtcctcgtcgccttgattggcgtgggcggcgggctggtgtcgctgtcggcgggggcgtttgtgggggccatggcggcgtttgcgctggtgatcctgctggcgcgggccagtggctcgtccagcggcaccgggcagatcatcctcgcgggcatcgccggctcgcaacttttcaatgccttgaccgcgttcctgatcaccaagtcggccagctccgagcaagcccgcggcattatgttctggctgctgggcaacctcagcggcgtgcgctggccgtcggtgtggctggcggtgccggtggcgatcgttgggctggcggtgtgcctgtggcatcgtcgcgcattggatgcctttaccttcggcagcgactcggcggcgtcccttggcatcccggtgcgccgcgtgcaatttgtgctggtggcctgcgctgcgctggtgacggcggtgatggtgtccatcgttggctccatcggttttgtcggcctggtgataccccatgcggtgcgcctgctgttgggcactgggcattcgcggttgctgccggcgagcgctcttggcggcgcgttgttcttgattgcggccgatgtgctgtcgcgcaccttgatcaagggccaggtgattcccgtcggtgtggtcacggcgttggtgggcgcaccggtgtttgcgctgatcctgattggccgcaggaacgcgcgatgagtgtgctcagttgcaccggcctgggtttcaaggtgcgtgacgctgagttgctgcgcgatattcacctggacgtgcagcaaggggaaaccctcggcatcgtcgggccgaacggctcgggcaaatccaccctgctcaaattgctcgccggcttgcgcatcccggccagtggtgaagtacgcctgggcgccaagcgcctgggtgagttgtcgcgccgcgccatcgcgcaacagctggcggtagtggaacagcaggccgacaccgacgacgctatccgcgtattcgacgccgtggccctgggccgcacgccatggctgtcggcgctgagcccgtggtctcgcgaagacgacgccattgtccgccaggccttgcacgacgtggacgctactcacctgagccaccgcgcctggcgcagcctctccggcggcgaacgccagcgcgtacacatcgcccgagccctggcgcaacggccgcagattttattgctcgacgagccgaccaatcacctggacatccagcatcaactggcgatcttgaaaggcgtgcaaggcttgccggtgactactttgatcgccctgcatgacctgaaccaggcgctgacctgtgatcgcctggccgtgctggatcgcggacgattggtagcgctgggcacgccgttggaagtgctgacgccagagcgcttgcaagagacattcggggtacaggggcattacctcacggacccgttcgacggcgcgcaaatactgcgcctgcgccctagctgacacacctcccacatttgatctacagagaccggtgcatatgggtggtctgccataccgggtcagcttccacatccaccacctcgaagccctgccggatccagaaatcaatcgccccgggcagaaacgggtgggtatgcaggtaaaccacctccaccccgtccgcccgcgccagcgcctccagggaacggtatagctcacccgccagaccgcagcgacgaaatgccggatgtacgtacaggcgcaccacctccactgtcttgcagccctggtagttcaactgtgcaaagcggccgtcatacggcaggtaacccaccgccgcaacaatccggccttcggaacgagcaatcagaaactgcccgtcgccctgcaggtaaatggcttcgaactgcgccaggtcatccggtatcccggttgcgctgagctttgggaacagctcatcacgcgcctgcaacgcgaagctgagtacttcgggcagagccgccggggtgacgacctggatttgtggcttcataccacctcgatccgggtgatccccaccacctgcgcctgctccaggacctcttccggcgttgcatctgccgccggcatgatcaggccgttttccgcatcgccgaaatgcaatgccagcaaatgcatcgccgcctcatgcttgggcaattcaagctgcttgaggtcgaagctgtgagtgcgaggctcatcattgaaaaggtagttcagggtgtaggcacgcatgcgggaatccttgtaagggaagaaggcgcaactgattaacctgactcagcgatcagttttttagttcccacttgatgcagatgctgcgttatccatttgcgactgtaggccaacacgttgtctgccatcgccactggaaaatgaatgaaaccatgggccgcctccggcagcagatgcgcttctgccccgccccagcgctcggcgatcagtagcgtgtcgtctttgagcgggtccaactcacccacgaacatcagcgctggtggcaaccccgcgaagtccccgtacaacggcgacaacggcggctgccgacgcgcctcatcggtgatgcccggcgtcagcaggcgcagcgcctcgaccatacccggcccgtccagcaacaaggtgtccggccctgccgtgcgcacgctcggcgtgccggtcaagtcgtagacgccgtaatacaacaccgcgccgcttacccgttcgagcaactccggccactgcttgagcgccagcaacgtggccgccgccaagtgcccgccggccgactcgccgacgacgaacaccggcaggttggcaaactccgggcaatcccccaggagccagcgtgcagcggtgagacagtcttccagcagcccttctatcggcgtgtccaccgccagccgataatccaccgacaccaccgctacgccgcaggcgttgaccatgccgaggttgaggtcgtcatccatttgcgcattgccgatcacccagccgccaccgtggatatccagcactacgcctttgggcttgccgctgggccgcaggatgcgcaccggcaccgagcccacctttttgcgttctgccacgggcgccttcttcagcgtttgactgacgcgcaacaacgcctggatcagacgcggcgtgacgcggttgcggattttaaagcgcggcatccacccaagctcctgattgaagcggcgcatctgggcccgttcaggctcgctggcgggccaatgttggtaagccatcagcgattgttccgcaggatcgagaagttcaacgccgcggctacgcacaaccaggcgaggtaagggaacaggatcaaaccggtgatcaggtccaggcgcacggccagcaccaccatcgccgccacggtgagccacagcagcacgataatcaccatcccggccagcagtcggtgggcgccgaagaacaccggtgtccacaaggtattcagggcaatctgcgccgcccacagcgccagcaccatttggctgccggggatcaggctcaagcggtaaccagcccaggccagcagcagatagatgattgtccatgccaccggaaacagccagttgggcggcgtgaagctgggcttgaccagggattcgtaccaggcgccgggcttgaagatcacgccggtactggcggcggcggcgcaggccaggaggaagataaaaaaggtcatggtcagtccttgaggtcgagtgggtagaaagcaacgctatgcttgaatgactcaaacacctgcgcataaattcaatgcattcgccaaaaaataccctctcttctgcgcgtcatgaaaattgggtagggtctgcaaaataacggctacgcctaccccaccagcagagcacccgaccttggccaactcacctaccgatcgccctgacagcccctggtcggtgttcctgatcttcctgcgcctgggcctgacctccttcggcgggccgattgcgcacctgggctatttccgcgaagcgttcgtcactcggcggcaatggttgagcgagcgcagctatgccgaactggtcgccttgtgccaattcctccccggcccggccagcagccaggtcggcattgccctgggcttgtcccgcgccggctacggcggcgccgcagcggcctgggccgggtttaccttgccgtcggccatcgccttgattctctttgccgtcggcctctcgcactacggcaccgccatccccggtggcgccttgcatggcctcaaagtcgtcgccgtggccgtcgtcgcccaggccgtgtggggcatggcgcgcaacctatgccgaggtgcagtgaaggtcacgctgatgctgatcgccgcatgcatcgtgctgctggcgccgtccgcctggagccaggtcgggataatcaccgccgggggcgtggccggcctgctgctgttcaagccccaaacccataccgagcccgacagcctgcccatcgccatcagccgccgcgccggggccatatggctggcgctgttcgtggtgctattggtgggcttgccaatcctggccgacgggctgcccaatccagtcctcgccctggtggacgccttctaccgcaccggcgccctggtgttcggcggcggccacgtggtgctgccgctgctgcaagctgaagtggtgccgccgcagtgggtgagcaatgacgtattcctcaccggctacggcgccacccaagccgtgcccggcccgctgttcaccttcgccgccttcctcggcgcctcgatgacccacgcccccagcggttggctcggcggcatgatcgccctgctggcaatcttcgccccgtcgttcctgctgatctgcggcgccttgcccttctgggccagcctgcgcacaagcccgcgcacccaggcggcactggccggggtgaatgcggcggtggttgggctgttgctggcggcgctgtaccggccggtgtggaccagcgcgattttcagcgggtatgactttgccctggccgtactcgcattggtcgcgctgatggtctggaagctgccgccctggctggtggtgataagttgcggtgtagtgggcggcttacttggctaagcctggctcgacgatcctgagccaaggccagcgcgcctgataacttctggccttgtgcaaaaacagctgcggttcgggatgcagtgggttgatgcgcagcacaccctgctccacatcttctagcccatagggtgcatacacctcgccggtggtgatatccaacgcgatgcaagtgcccgccaccaggtaacgatcaaccccctgcctggccgagtgcaattgcagatagggccggccgaatcgatcagggtaccaaaggtgtacccgcgcctgattcctgacctccacattcacccccaggtcctggaacagcccctgcgccgcacgaatcaccgcgtcttccgcctcgtaggacaggtctgtgtcgaagtaaaaaacatcgtagtccttcacgccctgatcagccggcagattcgcctgatgattccacaccgcctggaacaggcaacccgcggtgagcatgcactgctgcaccccaaggtccggcaggcgcgccgtgatttgggcattgagcgggttagccatggccaattcaatcaaggtgtcgacagtcaatgtcatgttcagtcctccatcgtctggcgcaaccataccaccccaacatgtcactcctgtaggagcgagcttgctcgcgaaaaccccaaacaatcgcgcagcgcctgaaggcaaaatccgatttccaagccacgccgcgcggcgatactgcttatccctacctttagtcggatatatctgagggtactgacgcaacggctagccttcagcctagcgtcagggataacgctgaacattcggtccatgaagggccagtacgcctcatcgtcccgacgctttacctgctgaggagacgataatgaaaataaccttgaaacggttggcgtgcctgggtgcaagcttcaccagcgcgctcgccatggccgatgcggccggcccgccagtgctgtcccctgcgatacccttcgacgtcaccgccaaccctcccttcaccctggacaacctgcaacacgatttcgacgtgctttcgtggcagaccttcgtcgccctgaactggcccgcaaaggccgacggcagcgccgacacctcggtgaaaatcggcgcgccggggcagacggtttgggagtcgtggaaggagagctacgcgattttcctgccccaaggccagaagccgctcgcctgggaccaggccacgccgccgcccgccgcctgccaaggcaaaggtaacctgcccgtactgcaacagatgggcaaggtcgccggtgtgctcgacgaattcatccagccgttcaagaccggcccgctggtggaccaggacggcacctacacgcgcaacgcgatcatggtcaaccagccgatgttcaacgatatcgtcaacaatggtctctacagccaggaaggccagcaggctttcttcaccaaggccgacaaccgcattgccttctcctgcggcacgaaggagacccagcaggtcggcgcgatcatggtcaagtcggcctggaaggtactcggcggcaacgacaacccgcaggacttccacgccgtcgacgccttggtctacaccccaggcaacaccgacccgaacacgggcgcggtaatccccgagtcgtgcagcgcgcagaaggtcgggctggtcggcctacatatcgtgcacaagaccaaagatgcgccgcagtgggtatggtcgacctttgagcacgtgcgcaacgtgccggaaaagaccacgccgatgaacgagcgcaagggcccctacctgttctacgacgcccaggccagcgaccgcccgataaacgagccgccaccgcggccatgggacccgtcgaagaaagccacgccgtcgcagatcgtgcgggaaataccgctcaccgtcgcgacccaccagctcaacgcgcagtggcaaggcgcgctgaagggcacggtctgggccaactaccagctgatcagcacccagtggccgaccgcccccgccgatgactgccaactgccgtcgccaaccaacccgctgggcacacctgccccgtccttcctggccaacgccaccctggaaacctacaaccagggcaccacgccacaggcctcgtccagctgtatggaatgccacaacaacgcgaccacccgggtgacccagtccccgcgcaccagcttcgccgatttcaccttcctgcttgaacgtgcccaatccactggcgccaaggagtgatgccatgagcgacccgaacctgcaagacttcatcgacctgtccgctgtgctcactggcctgtcagccaaactgctggcgccttcccccgacccgatcaaactgccgccgctgttcttcgccacggcccagcagggcatgggcgctgctgcgttcagcaacctgctggggctgtacgccagcatcaagggccaaccgcctgcgcaaatcgccagcgccgtgctcggcaactcggacccgcagatcgcccagggcgcccgctcgatcatgaagctgtggctgcttggcagctggtaccagccttataaccaaggcaccgcccacaagggtgacacccgcgtggtctccgaccaggcctacaaggaaagctgggcgtggaagatcgcccaatcccaccccatgggctacagccagtaccacttcggctactgggccgagcagccaccgaccctcaagcaattcaccggtgtcgacgccaaggaagggcagcagccatgagcactctacacacccagaacatcgaaaccgccgatgtgatcgtcgtgggcgccggcatggccggcagcgtcatggcctatcagttgggcctggccggcttgaaagtgctggtgctcgagtcgggcccggcgataccgcctaaccgcagcgagtacctggagcgtttctacactgccgtgttcaagtcgcccgagtcgccctacccaccggagcagaccgagcagaccccggccaaacagttcgccccgcgagcgactatccaggacttgatcactgccggcagcgacgacccggacaaggtgcagaagagctatctggtacaaaaggggccgcacctgttcgcaagcacctacgagcgggtaggcggcggcaccatgtggcactggatgggcacggccctgcgcctgttgcccaacgactttcgcatgcgcactgcgtacaacgtcggggtcgactggccgatcagctacgacgacctgcaaaccgcctactgccgcgccgagcaagagattggcgtctccgccgatgtcgcgtcgcagacctacctgggcgtgaccttccctcagggctatcaatacagcatgcacggcatcccgccgtcgttggtcgaccagggcctgggcaaagccatcaatggcacgcagtacctgggcatcaccctcaacgtgcggcagactccggccgggcgcaactcgcagaacgacaacggccgccgggtgtgcgccggcaacaccagctgcacgccgatctgcccgatccaggccaagtacgatgccaccgtgaccatggccaaggcactggataccggcaacgtacgtatcctctaccaggccgtggcgagccaggtgcaggtcgatgccaacggggtcacgggtatcgatttcatccagtaccagaacaacggcacgcaccagaacggcacggcccagggcaagcgctacgtgatcgccgcccacgcgatcgaaacgccgaagctgctgctcaactccatcggcccgcacagccctaaaggggtcgccaacagcagcggccaggtcggccaggcgttggccgatcacccggtgtacctggcctggggcctgatgcccgaaggcaagccgctgttcccgttccgcgggccgttgtccagctcggggatcgaggacatgcgcgatggcccgttccgcagccagcgtgccgcctggcgtatcgagatcggcaacgagggttggaactggtcggtaaacgacccctacacctcggtctgcgatttcatcgacggcaccaaccatggcggcgccaaccccaataaccaggcgttgtccggcgtggcgctggtgcagcagctcaacagcgtgctgacccgccagttccgcctgggcttcttgatcgagcaggtcgagaaagacccagacaaagcgctgtgccgggtagagagggccgaggggttcaccgacggtttgggcctgaccaggccacagatcacctacgaactgtccgattacaccaaggagggcttcaagcaggcgcgcctggccgccacgcatatcatcaccaagctgatgggcgccaccgagctgaccgacctgaaccctgagctcaagcccggctcgcaaacggtgttcaagtacgacggccagaactacgcgttcttcggcgctggccacctgatgggcacctaccgcatgggctcggaccgcaccaagtcagtggtgaacaaggaccagcgcagttgggaccaccccaacctgttcctggtcggcgacggcgtgttccccaccaccggcactgccaacccgaccttgaccatcaccgcgctgaccttccaggccgccgacgtggtcgccagcgacctgctcaagcgtaccgtgcaggtgcaagccaaccaggcctggcagggcaccggcgtgcaggtcaacgggcatagctggcaactggcggtgtgcaccggtgggcagtggacggccaacccaggcaccggcatggtcggcgcggcgggcaactcaaggttgaccgccaagcccggctataccttgcccggtcaagcggaaggcgcgttgatcgggcgtatcggcaacagcggcgcgccgtttttggtcggcaaccaggcgcaattgccgcgtggccagcagggggagttgcagttgtgcatcaatgacgacctgaccggacgttacggggctggcctgagcgataacaggggcagcctgtcggtggaggtgcgtttcgggacggtgtaagcgctggcatagcaaccccacagtgctgcggtattgtggggttgctctctgtcggcaagttggcttctgaggaagtgggacgcccggttaccgtgcggttgccggcaactcctggcaccacttgatagaacgcagcgcttcctcggcaggcacaagcgcgtagcgcgagtaaaacattgttccaccgaaactaccctcgtcgacttcacccaaggtctgcccgtccttgtaggcagagatgctgagttggtcggcgatgtaatacaccttgccattctcgacgttgatatcgaaacgtttgttcaccataccgctgatgatcggtggcgaggtggaggcgatgctgtgcttgccggcgggcatgccggccttgaaaaaactaccggaaggcaagctgccgacagcgcggccatcgacctgaatggtcggggccaccccgtcaccgatgctggccgccgtgcgatagaagtacaccgtggcctcatccgcacggggctctgccggtgatgtgaagaatggttggcctttgaggtccggaccgctgatgcaaccggtcagtgaggccagggctgcgaacaggccggcccagagtagcgtagagcgcttcatgcatgaattccttgaacgtggatcaatgggcgtcggggttgatgactgtcaccgttaccggattcagatcgtgcacagccctttaccgaagtcagtggcatcagaactcggccaaggcgcaaaaccactcttcggcgtcagattcacgatgttgcggtccttgagcatcgggtacttgcgcttgagcgcctgcaccgtgtcctcggcattgttgacgttggacaagcaaaaacgcagggcatcggcgcgcagatcgccgatatagagggtttccccggccttcaccgagaaaaccgcaggcacagggcgcgccatcgattttcccgcgtaatacacgtaatgccactgcgtgtactcatactcacccggcggcacttcatacatgaagtaatggcccagcacagagggtgatggctgatcatcttcattgcccaaggtcgtcagccgtattgcggtgccgggtgcgccctgttggtcgatttcaaccaccagcccatgggcctgcatcatcggaaagctctcaccaatcgaacccacaatgatcgccttactcgggtccggcgcgtgcttgccgtcgtagcgtgacgtagcgcacccggacagaagggttgcgcagagcgcgaccgcgccccagacgagatatttactgctgactttccctagcattggtctttttttccgatcagtaattttgcagtttgtagagcccagccgagcgaaccaaacgttcgcacatctggtgcttcgttgctggctcgtcggcatctattgtccagctacccgcaccttgataacaacccactcttgacccactcctgtaggagcgagcttgctcgcgaaaaacccaaacgataacgcagcgcctgaaggcaaaatccgattccctcgccacggcttgctccattgcctacgcgtgcgtcagaatccgccggcttgtgcgctggggtggccgtctctaaggtggctcggtcgctgaattgttcagtgattcgggtttagtagcctgaatttgggtatctataagtgcatgagcgtcaccaatcagacagtgcgtctgtgcttgatggtggctgtgcgtagggcgtcttcgggcgcgccggctttagatatccaccggtctactaacctgcgtacagctgccacccaccgtttagtagcggaaaggtggtggcatcactcaggatgtctactcatgtcaaaagcagattcaagtgccctcttaaacgttgcccccaacgccagcaacgaaagcctcatcaccaacagctacgaaaccttcaccagcgtcagcaccctgctgctcgatctgtccgaagacctcaacggcaaacaacgcgacatcgccctggccatccaccaactgagcgaactgggcgtactcctcaccgccagacttcttgaccgcgaagtgccctgcgctggctgatgatcagctcttcaactcattagcccgatgattcgccgcgtcgtcgtaagccacgtacgacggctcggcgagttggcttttgatggttttggtgcattcagcctcagcacaaagccctctgcgatgaggagagcggcgactgctctcggcccagagtgtgtaaatacttagcaggagcgtgcggcactgaggtaaagctagtctgtagatctgaaaccgaagggatgcccgcgaatgacgggatcttctagaaccagtgttcgtgcattttcgaaagaaatacaggggtaatcggcagactggatgctgaaccgatgaccgagtcgatcccgcacttcggacacagagcggtgctatctagatcaacccactcagtgatttctgagggcgaaaacacacttaaacagtaaaaacagccacagtgatcgcttgcttcaatttgagtacggtgatttgtagaaaataggtgcgctgaaatcacatccatgggcaggtccttaagctccaaatttactagcattactttcttgcatcagagtacatcaagagccttccaacgttgctacgattgcccaaagtgataacgcaggattgcctatgaaacgtttcatccaaggtaactatcgcggacaaagcaccctgcttcccgaagccttgacgactacgtcagtgataccaatccggttcgcgtagtcgacgtctttgtcgacgagcgggccggttagcgacggtctaacttcgaccgtcgctatgcatggtcaaacctcagttccgccatctccagggcgtcatcgacctcaatcccctagtatcgaacagtgctctccagcttcgtatggccgagcaacaactgaaccgcccgcagattcttcgtcctgcgatagttcagtgatgccttcgtacgtctcattgtgtgtgccatacatggctggatcaaggcccacggctttcacccagtctttgacgatacgagcgtattaacgagtagatagatggtctgaagtatgcagccggccaggaaaaaggtaatcctcgctgcgtagctgggcccgatgtatccaggccccgagagcagattgtgtttgatcagtgatctcaaactgcacaggccgctgcgttttctgctgcgtcaccatggctcgtgatgataagtgctcgccatgagcaacatcgcagaaaaaggggacaattttatttctactgctctaattttctagcgaataggaattttaagtttggaaaataaacctatccttttttcggtccaaaagtgctactgaatctggaggtatcattccattcctgatgataagtgcggatccatgagctgcggtgaaccccctgcgatgcgcttcggtaaccgcaaaatttcccctaatgcaggtcaggctacgagccgtaggcaactctctggaagttcagtaatattgaattgtgctcggccatgtctgaagcgtaatgaacgtgattcgtgagtaattacttgcggtcatcgggtttttttgaccttaacgtccagccaatgagccgggcttttcattcgatggagcagcgatgaagctggtagtgaacgaagagcaagtagcagaaaaccttgctgagctggaccgtgcgcgttgttctgccggggctgatcgacagatctatctcgacctcgtcaaacatgggaagtgctatctgccctacctaaatgaatcgggtatctcttttgctccatcacgctttatcggttacgaaaaaaacaagacccgagtccatggttccaatcaggacaaacacggtagcagaactaacgctgcccttaacaggatctatggttcataccctgtccagaatggaagtttgcagctggagttcgaacgtttctgcatctcaattggtgttaagccaagccgcaatggaagctttggtgctactcgaaaatattggctaaccgaggatgtggctgaggtcatcgcaaaggggcaagagcagcagattctggctgacacgatgctcactgaaacagaaaaaactcagataatactcgcgcgagtcggtcagggcgctttccgcaagaaactggtagagctttggggcaaatgctccgccacgggctgctcgcaaatcgacattctcaaagcctctcacatcaaaccttggcgtgagtcgagcaacgcagaacggctcgacgtatacaacgggttgctgctgaacccaagcctcgacaccctttttgacaatggctatgtttcgtttgacgatgaggggcacatcctaatctcgacgtacctgtctgacagtgaccggaaaatcctgaattgctcagtagatttgaacgtgaagctatcgcctcaacacctcaaatatctcgcatggcaccgggaacatctgttttgggcttgaccaaaaaggggacagatttaggctcactagtcgcccgagaacagcatacagggccacctgctatagcgtttacgccagacaacaaaaaaggaaacgcaccatttccatggacacttcagaaatcaaacaatgcctggtacgccccgccgtaaaattcagtgccggcggctttcgtcctttaggcaccgacgaagaaagctggctgggcaatgtcttcctgttccgtcccgacgaaggcgtgcccaccaatcaggcagggcaacagctgctcccctatgcacagttttacctgcccacccttcccttcatcagccctcggctgaaaggggttcgtgttctgacggtgtttatttcaaacccgtttcccgagcattttgagcccatgggcaataactgggtaatccgcgaatatgggccgcaggatgtgttggtgcgtaaagcgctgccggcagacgattcatttctcaaagccttcccgctaaaagcccaggcagtgccggaggactttcctctgtgggatggcggtggcgtgccggcggatgttgaacaagcaatactcaaactggaacgtgcgggcgagatacagagctattacgacctgatcacccatacctacgaacacaagatcggcggctacccgtcgttctgccaggcgggagtggatccaggtgaaggttttgagtttgtctttcaaatttcgtcagacgcaaagatcggcctgaatgtgatcgacagcggcagcctgatgttctggaagcacatcgaaaccggcgaatgggcgctttactatgacttttactaagttttagagcgctcaatgcatgaaaaggggacatttcctagaagtaaatcagtccccttttccactcttccactaaagagttcaatgccgactccttcaatgtcgggcgatgcctttgtggcttcattgcatcgactcacaggccttcaacggttccctggtgcgcaatgcacagacgtcgaaaccgtcacgccgggtatagccccctcgcttcatacacacaaatcgctgtgccctctcctggaagctggcattaggatcgatgccggagccattcttctcaccgcaagccagcatgaacgccaaaacatccttgctgctcgctcccggcttctcccataagtcagcgtcagctgccgggggctgaaaaggctcgctgaaacatgcggtgacgagggggcaaatcaacagcgcaaatgccacatttttgagccacatgaccaatctccttattccctggtgccgacaggcacctgcacaggcttgcgtaccactcccataacagctgtgcatggtcatgataccgatgaagacattgcctaagtccttgagcaagccgccgccctcaggtatcacgctgaactgccacaagttttgtagggacaattgaccgctattggccgattactgcctatgatcaaaggcgagaatcgacccaaagctgccttctagcatccaggtcagatattgtaattactggggagacagcagatctcagcctgtcatacaggcggaaagtcttcatacgattttgggaagtatccccaaattctcagaacgtcggcgcgcacgtcaaactcgaatccaatttgtgcaaccaccttcgatatttcgtctgtatggtcaatggttgtacgtgcaagcagccgtccttttgaggggactgcttccgacaagccaatgtcgaaccattcgacggacgcaaatggaaacggtaaatggtaaaaccactcgacatcccactctgagacatatcctgtgacgcacttggatcggtaggatggacgccacccctgaagctcgcggaaatgattgatcagctcatcccacttggtattgtttgatgcgcttgccaagtttctcgcagccacggcagcatggattttattccgtgttgcatcatcatggcccgcgccggccctcggtagttcgctcatattcagtcctatcgattttttggtgttcaagaatgaatgatcgcttctggccgattgtacccgttgcgaatgcctgcaatggggctgttgaattaccttttagaaagccgccgcatcgttgatagccgcctcatatgcatgcttctaaaatgtgaaggggccaacaccgtctatgatttgaggctcttcatagccgttctcgtaagcgaaggaatcccatgtgaaacagtcatcgttttggtgaacatatactgagtaggcgccacaccctatgtcgccgcactcggggcagatgtaaaggaggatacgaccactttctgtttcagagtgttcgcgtaaaagtaggcgagagttagataggctgtttggctccgggaagcccttgacgaaacagcccatgaaatctgaatgaccaccatcagctaagacgagagcattgagcaacgaacgtccgttaatcagaaaatcgatggagaatcgttcggccacggtgcagccatttgaggagtttcccggacgaaacaactgttgaaatgtgagggaactggtgtccattcctgcgaaccattttatgcactgaatgtgcgtgggattacatacaacattgaaggggggggcaaggcaagcttcatcgggtgattgaccgcttttggccgatatcagccggtcacgaggggcagtcctcggccaaaggcaggcatccggacaacctgattcccagggttaaaccaccggtatccggtacacaaccgaatcatatttctccgccatccgcctctcgatgacgactccccccaaagcttcggcaatacgtcgactcgcacggttctgcgtcgcaacaggatagatgaagtgctttgccgccacccgcttgctagcccactgaacaatcgcccgcaccgcttcaccaccaaagccgagcccgtgtctatcttcacggatccagacacccaactccggtgtttcactgccggtatggtgcagcccgaccaagccggtaaaacgagcattcaccagttccctgaccgtgaacacgatgtcgctgccatccgctatcgcaggcagccactgcccccagacttgcgcgtattcctctagagaggcaggcggttcccaggacatgtagcgagtcagagacggtgtgaggcaagggaaggactcagcggcgtcctgctcacaaaagggctcaatgctaaggcgttgcgagagaatgcggattgggtgggtgtctactggcattgcaatttccttcttggggggccgttactccatttatgccgtgaacataccatgcgggtcgcttcatcagtatcaggctctctatactgggcccccaggatggtagttggagcacaccatatgcccgtcgcagccaatcaaaattcccccatcattttggtccccgctcaagaaagtgacttggataatcttgtagccattcgaattgaggccatgcgcgaaagtctggagcgtgttgggcggtttgatccggtccgtgcgcgggagcggtttcttagcggctttgaagctcgcaacacacgctacatcgaggcagctggagagcgggtgggtttcgtagtggttaaacacaaccacaatgaactcttgctcgaccacttgtatgtaaggccgagcgcgcaaggatcaggggtagggtctgctgttctcacgcagattttcaaagaggcggatgcagctgcgcttcctattaaagtgggcgctctcaaagaaagcgcttccaatcgcttttatacccgccatggcttccagttcatcgaaagcagtgaattcgacaattattatgttcgtcagaatgttccggcgattggcccagcttgctagctggatatgctgcacctcgacgtacgcaaagctctgccttttcaacaggctcgttttcagcttggccagccgggttcaagcgctacaacgcgaccaggcactgggccaccgctcaacagaagctgttcatagtgctgaaccgcctttggggtgaagcggaaggtttggtggcagggttagcggcagtggtaaagactctcgctgcgcagttcctcgccactgtggtgatagccggtagcggcaaccaggaccactgcgcaagttattgaaattgaagggttgcaggctggatatgtgttagttcctgcaggttgtgaaatcgttattcatccgatgtgtcaaaaacaacaacccttggcttaaagaattctggttacctgccgctatagaggttgagtcttgctgtcttttctatacaagacgacgcgcaaggacaagagtcatagtgattatcaaattaaagggatatttatgagattcgctaaactgttcggggcagcaactttattcgtctctatgattgcatctgcccaggcaggcataatcgtcaccgtgaaggtgaagaactctacgaccggtccagccgcctacactttcgagtacttttcagggagtgtagccccctcccccagtacgattctgccgtcttcaacgacaacatttgccctgaccagtgtcgcggatacggtttcaggaatgcggttcgtctatacgtcaggtaataagcaatgtcgttttgcagcaagccaccaagtcaatccaacgactaaaacccctagctggactaaaatgggcactagcactggttccgacaaggctacttgcaatgccaatatcacagcaattcaatcggcgcccccctataactacactgtcgaatttgaaatcaaataatccgacatttgtataggcaccctagctggagatagctctcgatctatcgccagcgtatggagtatcaccatggatatttcgattaaatcgtatcaagcaagcacacaggcaaaggttactacacaagagaagcctccttcgtccaaccctgcaaatttaccttcaggggatgccgccctcaagacgacggagaccgtcacaatctccgattctgcacgggcactgtacgcattaagtagcgctgatgataaacaagcctctatgtccaatagggatttaaaaggacaatatgcaaaaggtcagagcgatatgtacagtttcgggcagcggattgctggggggaattttaataatgaggatctacttcccaaaacagacgaccctgtccgtttggcgttaggtcaacggtcactggattacgcaattgggctttctaaactccccccggaaaaacttccaaacccatttgaaggtatggcccgaaacgggctaagcaatattgtttatgatgactcaggaacctatacggatgcagaacgatatgccgcttatggggagcttagtaagcaggatgaaacctatttttccaagttgtacgccaatataacgaacggcggtgacaacagtgaaatcttcaaaggcatcatggactatttcgatgatcttccagcggtcgagaaagcggcataccctgatggcttcagggacagtataaaaagtctttaccaagagcagttagaacaatcggggccgctcgccctcctcaggcaatcgactgaaaacgactctgataaattgtcaccgagcgtcttcaacaaggcacaatcaccggagaagatgttacaagccgttttagaaaaagcgattgctctttcgacggcctgatcagtccaaagcaaccaatgtgtcactgcacggatcaatcaggaacgtcagcatggtgggatatccgacagtatcagctgcttgcttgggtacgccacagcacaggccaatacagctgatccagccccatgcacgggatcatttcagccgcatgcgtcagcgtgaaacccttaccatcgtaacgccaacgcagcgcagtgccacaattacccatactcatcgcccttacctgactgctaagttcacccgtggccggatcaaactctacgaagccctgggggtctctttccggcagatttggcacttcggcgatcagcgctgcacgcgcctgctccgggtggtccagaggcgcttggtaaatattgtagaaacagttgtaggccccacagccggtttcgatgatcactagcgcttgatctgaactcaatgcgtacgctttggtttttggcgcggctccttcatctagatcttcttgccatgccctacgcgtggcaaccaccacggcatccgtgatctcttttgctttgtccagagtgagcgcggcaggtgcctgccaactgggcgctatcgcagcggcagaggcttgcggcacgctgctagcgggcgccggccccttggcgatcagtgcgtcctgggtgccgacccggccctgaaccgagtccatcagcaacagcgccgcactcatcccgcttagcgatgcgtacgacttgccctcctcgagcggcagcaccaggtagttcccgtcgcgcaactcggtgatcagggcttgggccgacttaccgttcagcgcaaacacctcgggggtatcgccttctttcagttcgccaggctcaaattgagacttcagcggtttgtcatcaagtgttggctggccgcggggttttgtatagctgaacaccccgacatgcaaggcgccctgagggccggcttcacgtgtgactcgtacgctgaaggttgaaaagccagtgtcatcgcgctgctgcacggcactgatagccgtgcatgttcgcgtgttatcgcagccgataatccagtccttgatttcgcgcgccaacgggaccttctcggcagcgtgcacgcagccaatgcctgcagccaaaaggaatatgaaagtgcttcgtatcatcaggcgacgcctttgaacaagtaaaagccgatttcccatcgtggtctgaccccgttttttactggcgcagcgcatcgagatgttgttgtgcgcgggctgctttgcaataggcgttgaggatgtctgcgatctggtcgcaatccagggtaacgccctcatgcatcaggccggcagattggatgcggatctgcggctggggctttttcagggccagggcctggttgccgaacagctgtcgcgcggagcgatgaacaggcaggggcgcatcgggacgcaacatcagtttctgcaccgtcagccagccttcctcactgacggagacgtcgacaatgtccaccagatccaagggtgcgctcagggtgtccgcaaacagctgacggcgggtcaagcgcataaacgcgtgttgcccggcggtgcggtgctgccaagtgatcaatccacacaccaccgctatcaccgccgcacagacggtcaggccggtgcccccgcgattcaaggcgagccccagcaaacccagggcaatcagaaaaaacagcgggccgcgcaccttgtaccggcgcgagttggtgaattcggtctgctcgggtacgcgctggataacttgctcgagttcggcgatcgcacgctcgcgctgggcgtcgcgggagtcggcatattcttggctgagtgtgctggcgagatccgatagcggatcgaagggttgggtcatgggtcattctccttggacggttggtattggcggtgattcgggctgcgtggcagccggcgacgccgtacgggtgagttggctaaaccagtgccggtcgtgttcggtgggcacacgggtggcctcggccagcagcgtctgatccagggttacgcccagttgctggagccgtaatgccgtcggcgggtgtgtatcgaaagggtgcgcgatggcgtagtccagtgccgcctcgttcaggcgcagcggcgtgtggctcaggtggtcggccaaggcctggatcaggttggagtgacgctcggcgagcagcgtgttgatttcaccgtccaacgcgatcacccgtaacagcgcctggcagaacaggcgctcaccgccgatgttgccacccacccgatccgcgaccaattcctgagcgcggccccagtgatgcaccgccagttgaaagtaatgcaggaaacgttgcgtcatccagatcgccgggcgctcgatccaggccgggtcggcatcctcagtacggataaacgcaaagtgcaggcacatcaggctgaactgcgcacttatctcgctgccccgctcggtgtcgcggcggctgaaatggcccagctcatgaccgatgatcgacgcggtctcggcctggctcagggtcgagaggtaggtcagcggcaggtaaagggtacgcccgcagagcaagtcgcaggccggttgcaggaccacatcgacgctggtgacgaaaaacgattggtcgatgcccaccactatatggtcgggtaccggcgcgcaggtggctgtggccagttgctcaatccatgcccacaaggccggggccttgtcacgcccgatcctttgccccagaagcgtcgaggacgggctggccatcgcatcccattgctggcgcagacgcccgatcaacaaacatcccgcccacagcacggcaaccagcggcaccgccaccagcagcatggaccagccaccggccttgaagtggctccagccccagttcagttcatacaacaggctcagggccaacgcgcccatcaacaatccggtatacgccaccagccaatgccccaaggcgtgccagcagaggaataggcggtcgtagagaaaatccctggacttcagcgcgcgccaagcatccagcctcagcttgagccatgtcgcaggcccggccaccaacgcggcaagggccagccagtaggccaacccagccagcacctgacgcacgcggagccaggcgtagtcgctgccgatactctgtgcttggcgcagcacgtcatcgacgcgcccgctttgcacactggcccagcccatcagtaccagcggcagcagccacatcgtcagcggccacgaccaccgcgcgaatcggcccatggctcagttggcctgcaaataatcggtcaaaaaagcctgtgcattgccttggctggacaggaactcgtcatagccgacgttcagcgcctgcgattcgccaggcaggtatagctcgccccaaccttgttgcagcaccagcaccacgaatttttggccgtccacggtggtggaatagcgggtgtctttgctggtcttttccacggccatcttctggatcttcatgttccagtcatggtccacgccctctacttgcaccagcgcctgattgtcaccgcgcgcgccgatgcgcagggtccagactttcacgccgctttcgccggtataggccagcactttttccgcgacttccgggcggttgtcagcatgggcgactcccgcgatcacagccagaaccaagcccagcagcgctgcccacttgcgatacatcaacatttatggcttcctcgacagttcaaagccaaccattgaaatcaaagctgcggcgcctgccaagcggtccggccgtggcgcacaacaataaggccgtgactcacaacaactgatcgggccgcccgatgtcgatatcatgcaacgctgcccaccagctctgacggacgcttttgccaatgcatcgccgcaacccctatatggacacccacttctgcttcgatcacccagaggccctggaccaggccggtgtattcgatgccagcgcgcggcaggtcatgggcagcgcgatcggccattaccgcgcgcagacggtgcggtcacacctgcagtatttcgactgcgatttgcagttccccgaaccgttacgcatccacaaggtgctgcccgacagcatgtgcatcgtgcaggtactgggtgggcaatggcagcatcgggtagacggtcggctaaatgaatacacgctcggcgcacctcatgtgctgggcttgagcgaaagcatggaagccatggaccagatgcctgccggcagccgtgcgcgcatggccgggctgcgcatcggcggcgagtatctacgcgaattggccgaagaagacccgtcactccaatcgctggccaggctgctcgacgatggcatgcacttttcggaactgcacggctgtcgtatcgtcgggcgtttgttcgagcgcctttatcactcgccctaccaggggacgttggaacgactgaatcaggaaagcctgagcctggccgtgctggtcgagctggcgacgcatctggcgccacagccggccaaacctgtggccgcgttgcgcagccatgcggacctggcacacgaagcgcgcttcaagctcgacgccgacctgatgaacccacccggcactctggcgctggcacgggaactgggcgtgggtgaaaccactttgagacgtgcgttcagccgggtatacggccagtcgatgctcgattacgtacgccaacagagcttggaactggcgcgcaatctgctgcgccagggcaaatggcacgtggcacagattgcccaccgtatgggctacgccaaccctgccaacttcaaccatgcctataaggcgtatttcggccatacgccaggggcagaatcctgacgttcgctacgactactctgccgccttacgcatcagcacgcctaaaagctcaccgctcgacgggctttagaggctaagcgagctgacaaagctgcgtctgtccggtagccacaggctactaccgacccaaagcggtcatcccaccgaagtcagtacctatgtgaactcctttatgccggacgaggtgaatctggggagtaagggtgatggagcttgtactcctggctcaacccaccatagccgtaggcactggcacggcagtcgatcacatggatgtttgagtgcgcatgtacatttcctatttctgttgccaacagttcgaaagcctcgcgcagaaagcgtgccttctgggccttggtattggtttcatctgtgatggtgacctccagacggaaggagttaagcccttgttgggccagcgaacgactgtcgatgaaccactgcgcatgaggaaggaactgcaccattaccaatgtctgatccggtcgtttttccagtagttcacaggtcagagtggtgagtttggggacgatgctatggatcaggtcaaggtttggctcgccagaaatcttgagtgtaatgccgggcatgttgaactcctttgcggataatgaatgtccagcgcagagtaagaagttgcgatgccgctgaaaagccggaagatatgcatctatctatcggaaaaacagcaggatgaacatgcgaccccttgacttggatctcttgcgatctttcaccgttgccatcgattcaggcagcctttcgaaagcagcgccgcacttatgccggtcgcaatcggcgttgagcgaacaattacgtaagctcgaagcattcaccggtgtaacgctgctggaacggggcaaaaagggggttcggcctacgccggcggggcagcgattgatggtgcatgcacgagaactattggccttgagtgatcgcgctcttgaagacgtacgtggagtgacgttcgccggcgaattaagattggcaatcaccgactacttcttacctggctcgattgctgagttattgaaacaactgcgcctgagctacccacgccttcgagtgcatgtgtcggtgcgaaagagcctgcaaatagagggcggggcagatgttggagactttgatatcggcctttcaatgcgcatactcgacggccgcagctttcccgagggtattccggtgcgtcgggaagcattgcattgggtatcagcctcggggttaaagccgaagggtgaagaagatagcgtgttgccacttttggtgctgccggagggatgcagcctccaacgtctaacccgagagacgctggacgcacacaaagtgtcttatgtgattgcccattccgcgtccggagtggcagggctgcaatcagcactgatggcagggctgggcgtcgcttgtctgaatgcctccgcggttccgctgggggcagaggtttgccggccggccctccgcttgccgactttacccgatgttgagttcagcctgttacctgcgcgcgctggcgagtctcatttgatcggtgctgtacgggaaatgcttgccagcaaatttggcagaggagttacaaatccctgaggtaaaaaacgtgggctttcaattcggacgatgaaggtccgcttctggccggttggtgcctgtcgtgaagggacgcagtcggccaattgcaggcggtccaaccgttgctgagtgcacagccgctcacttttcccactggtttaggtcaatgggcttcaggccgaaaaaaggctccgcacagaacgaaacagctcggaaagtaacggctcaacgtctctgcggttgctacgggttgagaagcaaatccctcagctaccggttaatacctgcctgagtcggttgttcgcggtctggcacccttacaacgcgggactagttcaaaccacattcctttgaaactggttcgaccatgagggtgtctggcacttttcctgtttgtacatctatcacttctaatgaacagccggagtcaggagtcgacaaggttatccgataggtcgctcccgtgtgggggatgaagctgcggatggtcaaacaacttttgtgaataagtgactcatcagtggtcttgcgattttttacgcccgtactgagagcgttcaggtaaatacgtctctcaggtttgatcaaaaaacgattaatttcggggttcgacgctgaaattccacccagtacgccggtctcttccgtgtcattgcagttgttatcataaaacgcgtaaaacgcttgagagcccccagatactaaattgttactgccccacttggcctccagtgttgcatgcgccgcgtccggcgctggctgctggtagtgaccaacgcaaccggtcagcaatgctaggcatgagattacagaggatttaatcaacttcacaccgacggcaaaaagactggaagggagacgagctggttttgtatcgaccggattgcagagaacaatagggttaaaggccgcatcgagcaactttgttgaaaaggtcacataagcgatctttctgactcatcgtgatacctgtgagacggccttgcggcatccggcctcgacgattggcaggaagctgcggacggctgacatcgctgctcgcgatcgaccccttccgacccaaaggagacggtggccatgtgggctgtgggcacgatttcagctccaatgtaagcaatgaggctagcgcgcaggccctgcaaatgtggtgtccatcgtgtgtcggtcgtaatccagcaggtatgtatgatgcagacgatacagctgtgaaagcagatctttgttggggccgaccacatccaaacctctatcgtcgtagggaaaaaccatgacgtgcttcttcaaattgaagaggtataaaacgcagttgggtttaggctgaattgcggcaaagtccctagccaaagcacaccaaagaaatgcttgaagcagagtcgcaggcgcttcaaatgcgatgttgatccaatactccggctccctttcgcaaaaccattcctccgaatctatctcctcactccagactgagaattccgtgggtatgttaatgccggcagatcgaagagcgtgaatcaggggccgatgagcaaatcggttgctgccagaatgaatgcgcagacaagcaacaagcgtcgcgtcatcaaggaagatatcgctgcagatctttgttgattttcgtagtgctgttagaaattgctcaatcactccgccagtttcagagagctcaaaacgcagacctcctggataggaatagaaaagtggcctggcaaatgctttacccccaaagatcctctcaatttcaagttgtagattcacttgatcctcatggctaatagcccgactccatagcttgggcggtgcagacggatattactgtatacgtaagatctgagctaagccgcgagcgtccgctattggccgatttctgccgttcgtgaagggcagcaatcggccaacgtagtacctagggttaaaccaccgctatctggtacacaccgaatcatatttttccgacagcattctgctcgcagaagggctcaatgctaaggcgttgcgagagaatgcggattgggtgggtgtctactggcatggcgttttccttcctgggggccattaatccatttatgccgtgaaaataccaagcggttcgcttcacgcgtgtcgcttatacgtcaagtaatcatgtgccccggtaccgctgcacacaaaccctgccttctcgtacatcctcttcgcggggttatcaggtcgcacactcagccgcaattgcgtgaatccgtgctgtatcgcgtccagggcataggcttccaacagcgctatgcctaccccgctacgccggtgttctggcatgacatggatagtgcaaagttctgcgtaatgctgttcaggcgtccagagtgagtaacccgcgaaggtattacccataagcgcgacattcagacgatcaaaattatctacccaacgcgtcaggtgccgttccagttgggcgcgccaggatgcttcatgctcgggctcccaacagcggatatagctctcctcgccgcggtagatggccggaagatcggtcacacgtgcttgtctgagtcgtagtgccattccattagcccttgatgagttgaagggatggtatggcctcatcccgcagccatggactgactcacactagcccttcaactcacccgcccgattgctcgccgcatcgtcataagccacatacagcgactctgcaatttggcttttgatcgccttggtagcctccaaacccaatacaaaaccctcggctttaccgccagcacggttaagttcttcatgggtggaggcgccagtaatggcgtcaagaagcttggcggcgtgagggccgacgcctttggggagggagatctggtcgatggacattatcgctaccttgaaaaattgagttcgggagcgagtggaaccactgccggggcaggtatggtagacctgtttgccgtcaaaggggtcgctttacgtacagcggcgctattcttcgcggttacgcggtcagcgttggggcattgataaatctggaggggtttatggagtattgcgttgaaagccactgccttcggccattggcatgcgacgatttcgagaggatcagccgttacgaacgcgtcaaccgcaggcatctgcaaccctgggagccgctcagggacgaggaatatttcaccacgggcagcgccaaggccagggtcgagcagcaagtaaacagtatgcaagctggcaatgctctgtttttcctcttgcttgagtccgagaacggagaggttctagcgcggtgtaactacgcgaacatcgtgaagggggtttttcaggcctgtcatctcggtttctcgctggcggaatcggtccaaggtcgcggcctgatgaaaaagacacttcaggtcaccaaccgtcactgttttgagcaactgggccttcaccggatcatggccaatcatttaccccgcaatgtgcgaagtgaacgccttctggagtcgctggggtttgagaaggaaggttatgcgcgagcctatttgaaaattgctggcgtctgggaggaccatacgctgagatcactgatcaaccctgaacaataagcgcgccacccaccccactcaggaaaaaagccgatgcccaccgagcccctctgcctggttttcgtccccgccctcgccgccgtgctgacagccgccgaatcgaaaaaaggcgctcccctcagcgaggtcgaagtgtgcgatatccgcgaccaagccacttgcattgcggtaaccttctccaccgcgctggcaatggaacaagagcggggttacccggacatcgttgccgaggattgctggaatgagtggcaacgcttgcgcccctcgctgcaataaccctctctctgatcagcctatcgcctgacgccccaccccactaccaggattcacggacttgaaaaaattactctcgcttggatgcttcaccctggccttgagcggctgcacattcaccggcgccaatgaagttgccccgggtgaatacatgatcagcagccatggcagcatcttcaactccagagaaggcctactggaaaatatcaaccagaaagccgcaaaggtctgcaatggcaagccttatcgcttggaaggtgacaccggcgccaatatgctggtgagcacaacctcccatctgggcccgacgcctactaccgtgctggggctgaaagccatttgcgagggcgacaagccataagccgttggagcctttatgccgcctgcctcacgcgaccacgcacgtattgaacgccgtctcatcgcaaccctgaccgaagcctgcgaaatcgcgaaagctgaaatcccgggcttcgactggttgacccacaccgtcgactaccgcgccttcccccagagcttgcgcgtgacttgggtgttcgacagccgtgcgagcaaggagcacgccctctccaccggggccgacgcacgcatgcgcgagctgaccgccgcggcgctggatgacgctggcgtgcaggttacgcacatggcccgttgcgtcagtttcgactccgaagaggaatgccatcaccagcatggcggcgattggcgtcggcgattggccaatgtgcgggcgatctgaaatcagcctttcactgccccgctttacacgtcaaccagcccccccagaaaaggctgctgaagaaacgcgtcgcgtcgccaaacccggcgtcgtgcaacagtttctgaaccgctgcttcggaatgcggagggtcggcgccttggaggattttcccgagcttggcctttacttcgtccgcgctggcaccatgctggcgccaccgttgcccccaggccgccagcagtaacggctggctggcgtaagcatagtgattgcccgcgacaatcagtggtgcgcccggtttgagatgcgcctgtatcgattgcagaatccggcgcttggcctcatcaccctccagatggtggagtacaccgatcaaggtggcggcgtcgtatgacgcatctgctggcaggtcttcgaggtgcccaagatgcagggtggttctttcaagcaagtggttggcttgcaactgctgccttgctgcttccagcatcggctgggagggatcaacggccatgaagcgccagcccggctcgagcccggccatggctatgatctcctgcgccgtaccgcccgcgccgaccacgagtatgttggccgagggcgcatcgccaaggcttgccgccagcatgcaggcggccagatcctggcaggcatcatatcccgccagggcaatacggctctggcgtgcgtattcactggctcttgaggtatcgaatttttcagcagggttggatggggtcgagttcaaggcggttctccgtggccatgaagcaacttacgtcacccacagagataagaaaaattcattaattttatctgctgcattccctaagggaatgcgcctctcaatcctcagcctgtgacaacggccgcgccaccgcctccagcgcctggcgctccgccgccacgccccacaccgcctgcaccagcgccgccgcgcacatcaaccctgcgccgatcaaatacccaatcagtaaactcccgcgttgctgggtttgtataagttgcccgaacaacgtcgggccgattatcccgcccagcccggtgccgaacgcataaaacaccgcaatcgccagtgcgcgtatctccagcgggaaggtttccgccacggtcaaatacgccgagctcgccgccgccgaggcgaagaagaagatcaccatccacgccagcgcctgctgggtcacatcgaaccagccctgttggaacgcgtagccactcaacgccaacagcacgccggagatggcgtaggtcgcgctgatcatcacccggcgaccaatcacgtcgaacaagcgccccagcagcagcgggccgcagaagttgccgagggccagtggcagcacgtaccagccgactttttcggcagggacttggtagaagtccgtgagcaccaaggcgtaagtgaagaagatcgcgttgtagaagaacgcctgggcggtgagcagggtcatgccgaccagggcgcggcgacggtagctgacgaacagggtgtggaagatctcgcccaggggcgtgtggtcgcgggcatgcaggcgcagcgctgggccagtgacggcggggagcgtgtggccggtgtcgcgcaggcgcgcttcgatgccttcgacgatgcgccgggcttcgtcgtgccggccgtggatcatcagccagcgcgggctctcgggcagccacaggcgcatcaccaggatgatcaagcccagggcggcgccgatgccgaagcacaggcgccagccaaggtcgccgccgaccacttgagggtcgagcagcaaaatcgcgccaccggcaccgagggccgcgccgagccagaacgtgccgttgatggtgaggtcgacccagccacgaaaacgcgccggggtgaattcttggatggtcgagttgatcgcggtgtattcgccaccgatgcccatgccggtcaggaagcggaacagcaggaaggtttccaggctgaaggaaaacgccgtggcggcggtggcgccgatgtacagccacagggtgatgaagaacagcttgcgccgccccaggcggtcggtgagccagccaaacagcagggccccaagcacggcgccggcgatgtagacgccgccggccaggccgatatcgaggttgctcatacgcagctctgggctgttcttcaaggcgccggagaccgagccggccagggtcacttccaggccgtcgagcagccaggtgatgcccagagcaaacaccaacagggtatggaagcggccccagggcaggcggtcgagacgtgcgggcaggtcggtttcgaagaccgtgcccatttcgcttctgagtgcctgttgtcgggtcattgccacatccatcctgtgcacatgctccttggttatgagtcagcccgcgcagcgggagttcagttgcgcaggctgaacgaagcaggccctggtgcagtcggaacagcaggccataaaggcaaggaaccctgctcatgtcgttacgctgcgccgccctcctcagcttgttcaccttgactgccagttcgtataccgcagcccaggagccattgcgcctggaaaacctcaagcgatgtggcgacctgctggacaaccgtcagcaacactggtgcctgaccgtgcgcggcctcggcgctgccaccccgcagttgaaactggcgggccaggcattgccggcgaaggccctccagcgtgacggcaaccagttgcgcctgcacctggacagcgccacctaccagagcggcccgctatggctggaagacggcccgcgtaccagcaacgcggcctggctgaccctgcgccacagccaggtagtagccgctgggccaagtgaagtcgccaagaacatggatgggttgactacttatgtcgatctggtcagcgtattgattgaagaagaccacgagggtcgccaggaagccgagcgcctggcgcgcaagtacggcgcaaccgtggtgggcagcattgcgccgctgaacgtctaccaactgcgtctgccggccaaggatctggtgcaacgcgatgcactggtgctgcgcctgggcagcgagaccagcgtggatgcggtggtcatcgaagagtctgcagccgaagaagccgaacaggcccgccctgaaaagccaaacaagccggcgccagattctgatgaatgggccgccaaccgctttcttgacgccgtggcttactaccagcggcgcatccccgggcagcacacgcctatagcgccgcaaccggtgcgcatcggcgtgatcgagcgcggggtggatttcgacaccgcggattttgccgactacctcggcccctgctcgcccaaacgcacctgcgtgtatgcccgcgatacgcaggcgccggacagccacggcaccacggtcaccggcatactcgcggcaggctgggataatggcggcaacagcggctttctgcgcgggctggacaaggccagcgatggcttcgaggtgattgtcgaccgcaactctgatgccggcattaccgccaacatcgccgcgtcagtcaacttggtggaagacggcgtgcgcgtgctcaattggagctggggcattcatcgcgtcggcaccaaggacgtcaatggcaacgacgtcgattccctggtgcgctcgggcatcgccatgagcggctatgaagaattgctggaagagtttttcctgtggctgcgcaaggaacatcccgacgtgatcgtggtgaactccgccggcaatggctcggcgttttcgggcagtgacgactaccgcctgccctcctccttcatcaccgaacaattgctggtggtcggcgcacaccagcgcaaccagcgcaccgacattgccgttgaagacccggcttacgccgtcacacgcagctcttcgaatgtcgacatgcgcgtagacatcaccgccgccgcctgcgcccatgcctccaccgctactgccggcgaggaaggcgcggtgcattgcggcacctcctacgccacgcctatggtcgcaggcctgctggcggcgatgctgtcgatcaacccgcaactggaacccgaacaactgcgcatgctgctgcgccgcagcgccatggcgattggcgacaaccatgatttcgaacgcagcgatgcccaggacctcacggcgcccatcctgccgtcagagcgcaactaccaactcaatgacaaggacgtgggccgttcggcacggctggatatgcaaaaagcgttggacctggcggtgcagagtcgtacgcgggtgcgctgaggttgcaggatcgtacaagcctgctgagcgcttgcctgggtagtctggccttctcatcgacaggaagatctagcatgactcaagcacagcctgtaaatcttgcgcaaaaagcctcgctcatcgaccggcaatggagcccaagggtggtcgccgaaatgaacgactaccagttcaaggtggtgcgcatcgaaggcgaattcatctggcactcccacccggaaaccgacgaggccttcctggtgctcgaaggcacgctgcgcatcgacctgccggacggccctgtgtacgtggcgccgggtgagttgtatgtggtgccgcgtggcattgagcacaggacggcggccgagggagaagccaagctgatgatgatcgagccgcggggtatcctgaataccgggcatgagggtggtgagcgtaccgcgttgaatgaccagtggatttgaacgttgaggcgcatgactttaggtactccgctggaccctgtgggagggggccagcggcgtacgcaaaaaagttgtgcttatacctaacaccgcggccttatcgtctttgaacctgcacactcgcaaacgtcggctcgtcgcgcgcctgctccaatgtgttcttgggcctttccgatactggggctggcgtcaccggtcgcactgcggcgggcgggtgcaggcgcatgtccaagcgttcgtcactaggggccacgccgaaaaaatcccggtagcacttggagaagtgcggcgtggacacgaagccacagatcaccgccagctcgacgatcgaaatcggcgtctgcatcagcaattggcgggcacgggtcaggcgcagcttgaggtaatagcgcgatggcgtgcagtacaggtacttctggaacatgcgctccaactggcggcgggacacttgcacataagccgccaggtcgtcgaggtcgatgggctcttccaggttggcttccatcaaggccaccacttcctgcagcttcggctgttgggtgccgagcaggtgtttgagcggtacgcgttggtggtcgcgttcattgcgaatgcgctcgtacacgaacatctgcgaaatcgccgccgatagctcatgcccgtggtcgcggccgatcaggtgcagcatcatgtccagcggggcagtgccgccggagctggtgaagcggttgccatcgagggtgaagacgctggagctgacccgcacgcggctgaacgcctcctgcatcgacgccatcagctcccaatgcacgctgcactggaaaccgtcgagcaaacccgcctgggccagcgcccaactgccggtgcacaccgcaccgaggcgcttgcaatacaagcgcgcctggctgcgcaaccaggctatgtgggcagagctgatggcctgctgaatgccgatgccaccgcacacgattaccgcgtcgaagccacgctgatccagcgcgcaggcatccggcgtaaccgatacaccatcgctggcccacaccggcctgccatcgaggctcagggtctgccaacggtagagttcttcgccggccaactggttggccatgcgcaacggctcgaccgcacacgacagcgatatcagcgtgaactggtccagcagcaaaaagccgatggtctggcaaaccggcgcgtcagcgtccatcacggcgactctccacgcgggatcaggactgttccagcgcaaccggcttggtcgcccgattgtgctggcgcgccgtgaccaggccgatgaaggaaatcaccaacgccaggccaatggtcgaagacacttcggtgcggtgttccggcgtcaccatcatcacccccagcgccaggcagatgaacacgatcaccaggtaagtcagccagggaaacagccacatgcggaaggtcagctcgatgttctgtcgaagcaggagccgacgcatgcgcagttgcgagatcgcgatcaccagatacaccaacaacgcaatggccccggagctggcgagcaagaattggaacaaccccgccggcatgaaatagctcagcagcgtgatgcccgcgccgatgatggtgctggcgatcaccgccgccctgggcacacccgctgccgaggtgattttcagcgcgcgtggcgcatcgccgcgtttgcccagggagaacagcatgcgcgaggaaatgtagatcgaggagttcatgcagctggccaccgcaatcaagaccaccacgtcaaccatgaacttggcgttggggatattcatcagctcaagtgcgcgctgataggagcccacggatgccagcagcgggtcgttccagggcactacggaaatcacgatggagatcgacaacaggtagaacacaccgatgcgccagatcaccgagcgtgtggccttggcgatgttctgcgccgggttgctcgattcggctgcggcgatggtcaccgcttcggtgccgatgaaactgaacatgatggtgatgaacgcgcccaccaccgccgacaggccgttgggggcaaaacctccgtgttcttccatcaaacggctcaagccgctggcttcacgatccgggatccagcccatgagcacgctgaaacccaggccaataaagccaacgatggcaatcaccttggccatggcgaaccagaactcgaactcgccgtatttggcgacgctgaacaggttggtgatcaccagcaggatgatcgagagcaaggcgaacagccaggcatcgacctgggggaaccactggttgagcacatgcccggcggccagcgcctcgatggggatcaccagcacccagaaccaccagtacaaccaaccgatggtgaaccccgcccagcgaccgatggcctggtcggcataggtggaaaacgaaccggtgtcggggcgcgccaccgccatttccccgagcatgcgcatcaccagtaccaccagcaggccggagaacagataagccagcaataccgccggcccggcggcggcgatggcgtgtccggagccgacaaacagccccgcgccgatgatgccggcgatggacaacatggtcacatggcggggcttgaagccctgcgccagctgaccgttggaatcgttgggagtcaggctaatcattgtttttgttgtgctcaggcggccaatgaccctcaccttaagtgcgtggggcccggtacaagtagcctggttacgccatcatcgtgtctgatctcgacattggtgatggcggtgcacgggttcagcgagtgccgcgtcttactcttgaacgctgcgaatcagcgcgccaaacagctccccacgcggcatcttgtccagtgggatatcggcattctcaaaccactcctggccggcttccggatgtggcccgctcagcaccacaacgcctttctggtaggcgtagcgcgccgctgctacatcgccgttgtggtaggtggcgagggttttgtaggtcgcgtcagcgctgggcttgggaaagtacgggccatcctgatagaacacatgatcagcctggccggcccacgtcacccgcacagcagcgtcgtcgataccggtcacttcaaaaccggggcggccggcctcggtgtccagcgcgtgagggatcagcccgaggttgttgtcgtccgcgaggtaggcgcccatgcacaggccgaggtagcggccacccttggcgacgtagtcgcggatggcctcggcacgctcatcgccgagactgtcgagggcgccggggatgtcctggccgccgccgggttgtacgtaaaggtcgtagcgggccagggtgtgtggggtgatgtcgatgggttcgtcggcgccgacgaagtcgatctggtaattcgggttaagacgctgcaaggcagttttcacgttttccgagcagtccgcgcaacccgcagggccacggtagatggcgacatgggtgatgggggttgcgccgtgtacgggtaaagggtgcagcgtagcgaaggcaagcaacgtggcagcgatggcgggcagtttcatggggtaggctcaacggtcagttgaaggggttgatccaaacgtcgcagcgccaagcctataacgatgagctttttgaagtcgtgaagagttgtaaatccacgtgggccattcatccacttcccagcatctgccacaacgacgcacccacgccggtaatgctctccccggcgatcaaccctgccgctgccgtgatcgcaaagcgttgcgtcacgctcggccagcgacaactcaccgcccaggtgatcaccgcgcccagggccatcatcagcgacaccgaggcgggcaggacaaaggccaggcccaaggctgcagcgctcggcaaatagcgcgcacggtgggccggcagcgtgctgtcgagcaggcccagcagcacgccgaacaggctggcaatgccgatggcccagcggatgctcggcgatagtgaatccaggccatgggtcagggtctgggccacggctttccaggtggccaccgccggggccggccattcttcagtgagcagcatggtctgagggtcgggaatcaacgccaggtaagcgaacacgccgacgatgctgccgacgaaaatccccaggatctgcgcgatcacttgcttgtgcggtgtagcgccaatcgccttgcccactttgaagtcattcatcaagtcggtgcattggcccgccgaaccgccggcggtattggcgctcatcaggttgatcggcacctggccgggcgcaacgatgccaaaactgagctgggacagttgcccgatggcgccaatcggtggaatgccggtggcccccactacccgcgccgccacagcggccaggcagatcgccaagggaatggtcagcagcgccatgcccaggttgatgccgaacagcagcgcttgcaggcttaccaccagcacgatcgccagggcaaaaccagcggctggtccaggtttgggcaccgtccacggcgtaccgccagctgctcgggtcgagcgatgcaatgcccataatcggatcgccaaagacgccagggtagaacacaccatcaggctcacccccggccacaacagccattccaccaacaccgcaaactgcgggccgctgctgccggcgggcaggctcaccagcccgttcgccaacagccacggacccagcccaccccatgcgagcagggcgccgagcagcagggtcaagcccacgcgaatgccgataatgccgccaaaccccagcaacagcagcgaagggtctgcggtgaaggtcaggcgctccaactgggcacttggcgaccagcgcgggagggcccacataaaggtatccacccacttgaccagtccggacaacaacgccgcgccgagcagcactttcaagcgcgttgcggcttcgcgcccgtggttgtagatgtgcaggagggtctccagggtggccatgccttcgggaaacttcagcgccttgtcattgagcaatgaaggccgcaggtaccacgcgatccagatcccgaggaagcttacggaaaacacccaggcgatcatcggcagcgcggccagttggttgccggtgagcaaggtataggccgggatgggcgcgaccagcccgccggaaatgatcgaagcggcggccgaggccacggtctggttgatattgctctcgtgcagggtccacggcaggtgctcgccggaacgccgggccaggccttgccagattccgtagccgatcaacagggcgatgatcgacatattgaatgaccagccgatcttcaagcctgcgtagacgttggaaggggtcagcaatatccccagtacgatgccggtgatgaccgcccgcaggctcagttcgcgttctacgggcgcgattgacgaggtggagtgcatgcagattcctttcgagaaaagccagtgccacctcttaagtgagcgctggagaactcgaaggttcacctaccgtacacgggattggttccaaatgtgggagggggcttgctcccgatagcagtctgtcagtcagcatttttgttgctgacccaccgctatcgggagcaagccccctcccacattggtcttcctcaagcctggctatttagcgaatgcatactctccgccccgctccaccgccttgcggtaagccgggcgcgcctggagctttttgacccacgccgccaggttcgggtacgcctgcaatttgccctgggcctgggccacttcaccgataaagctcatctggatatccgcaccgctgagttcgtcgcccaccaggtacggcgtgcgccccagcacatcattcaagtagcccaggtagttggccaactccgattcaatccgcggatgcagcggtgcacccgcttcacccagccgccccacatagaggttgagcatcaacggcagcatggccgagccttcggcaaaatgcagccattgcacatagctgtcgtaggcgtcggtggccgggtcgggttgcagttggccgttgccgtggcggcggatcaggtagtcgatgattgcggcggattcgatcagcacgcgggaaccgtcttcgatcaccggggatttgcccagggggtgaatggccttgagttcagggggcgccaggttggtcttggcgtcgcgctggtagcgtttgatgtcgtagggcaggcccagttcttcaagcacccacaggatacgttgtgagcgggaattgttgaggtggtgaacagtgatcatagcgggcaacaccttgggggatttaggagaagactacagggtagcggtgaagtgccgtgaatgtggctcaggcgagcaactgatcgatccacttcacctgctgcacgatctcctgcactttctgctcgggcacggcctgccgcgcttgttcgaggctggccagtgtcttgcgtttctcgcgcactatacgttgccacttcgccaggaaatccgggctgcgcgcctgcatttgcaacgggccgaagtacagctgctcggcggtataggtcaccgtctcggtgggttcggcgacgatgatttcgtagtagaagcggttttcccgcagcaactcttcatggaggatctggtagccgttgtccatcagccattggcgcagcggctgttcgccgccgttgggttgcaggatcaggcgttcgcggccattaaggtgagccttgccgctgtcgaggatgtcgcggatggtctcgccgcccatgccgcacaggctgatggcggtgattgcgtcagccggctcgatggccgccaagccgtcggccaggcgcaccgtgatgtgctgcgccaggccgttatcgttcacggtacggttggctgcgtgaaatggcgtagcggccacttcccccgccacggccgccgcaatggcgccacgacgcatcaaggccaccggcaggtaggcgtggtccgagccgatatcggccaggcgtgcgccggtcggcacatgcgctgccacacgctcaaggcgcatggacaaggtgtgttagttcaacggtggttccttatgattgcccggaaaatcgatcccggctgttggtcaagtgcagcaccatggccgcccgtgcggcgtccgggtcctggcgcttgaccgcattgtagatcgcctcatgctccaggtttgccaggtgccccagcttggcaaaatccgcgccgccacgctcggcggccttgacctgggtgcgcgggatcatcccgctgcccaggtgcagcatgatgtcggtaaaaaatcgattgccggtagcctcggcgatcagttggtgaaagcgcttgtcttcctccacgcaactgtcgttgttggccaacgaggcttgatagtcatccagggcctggcgcatgtgggccagttgcgcgtcgctcctgcgcagcgcggccagggccacggcctgcacctccaggcccaggcgcaattcgagcatgttgcgcacgctggcgaccgtgtccacatgcaggcgcaaccctggctgcgtgtgctgctccagcacgaaggtgccgatgccgtgacgggtctccaccagcccggatgcctgcagcttggacagcgcttcgcgcaccacagtacggctcaccccgtgttcacgcacgatggtggattcagacggcagcttttcacccggcttgagttgcccgagcaggatgcgctgggtcagcgactcgaccacgccttgggccaggttggttgaacgtctacgcacaggtgttgtgctttcaatgggcattgtcacggtccacgggcttgggctggagggagcttatcactctgaatgcaaaggacacctcattgctgaaaaaacactcaacttgtatgacaacaccaccacacaccctttttatcaactgtttcgctctgaaagagccgccttaccactgcaccttcaacgcagcgttaaaacccagcaaatactcacaaataaccaaaacacgcagctaaacctggcccttataaacacaaaaccactgacctgagcattgcgatactcagaaaagcacttgtatgatgtctgtcaacaaaacagccaaacccgcataaaaacaatcagggggaagttttcaaatggtgagccattcaagcccagcatctgccgtacccgaaagtgattcagtgctcgcccgcgccgtgagcaaagtgaagcgccatgtgctgccactgttcgtggtcatgttcatcctcaactacatcgaccgggtcaatatcggctttgtgcgcacgcacatggagcatgacctggggatcggcgcagcggcctacggcttcggcgccggactgttcttcatcggttatgcgctgttcgaagtgccgtccaacatgctgctgcaaaaggtcggtgcccgcatctggctgacccgcatcatgttcacctggggcatcgtcgccacgctgatggcgtttatccagaacgaaacccacttctacatcctgcgtttcttgctgggcgtggcggaagctggattcttccccggcgtgatctattacttcacgcgttggttgcccggcgtggagcgcggcaaggccatcgctattttcctcagtggctcggcggtggcgtcgttgatctccgggccgttgtcgggggcgttgctgcagatcgatggttttggcttgcacggctggcaatggatgttcggcatcgagggcctggcctcggtggcgctgggcttctttgtgtggttctggctggactccaagccccatgatgccaagtggatgacccgcgaagaacaggacgccctggttgacgccattgaccaggaacagcgtgaacgtgaagccctgaccacggtgaaaccgaccatcggcaagctgctcaaggaccgccagatcctgctgttctgcgccctgtacttctgcattcaactgacgatctatgccgcgactttctggctgccgagcatcatcaagaaaatgggtgacctgagtgatgtgcaggtgggtttcttcaactcgatcccctggctgatctcgatcatcgccatgtatgcgttcgcagcgctgtccggcaagttcaagttccaacaggcctgggtcgccgcggcgttgctgatcgcagcggccgggatgttcatgtccaccaccggcgggccgatcttcgccttcgtcgcgatttgctttgcggccatcggcttcaagtccgcatcgtcgctgttctggccgattccccagggctatctggatgtgcgcatcgccgccgccgtgatcgcgctgatcaattccatcggcaacctgggcggctttgtggcgccaaccacctttggctttctggaacaaaccaccggctcgatccagggcgggctgtatggcctggccggtacctcggtgcttgcggccattctggtgttctttgccaagacttcaccctctgccgtgttggcctcacctagcgccgtaccgtcaggcgccgccatcagcaaatccctttgagcgtctataaggaccttgccatgaatacccctgtagtcacccatttccaggtcatcccggtcgccggccacgacagcatgttgctgaacctcagcggcgcccacggcccctacttcacgcgcaatatcgtcatcctcaaggacagcagcggccacaccggcgtcggtgaagtgcccggcggcgaacgcattcgcgaaaccctggaagacgcccgcagcctggtgatcggccagccgattggccagtatcagcgcgtcctcaaccagatgcgcagcacttttgcatccagggatagcgctggtcgcggcctgcaaacctttgatctgcgcatcaccattcatgccgtcaccgccatggaagccgcactgctcgacctgctgggccagtttctcgaagtgccggtagcggccttgcttggcgaaggccaacaacgcgacgcggtgaaaatgcttggctacctgttctatgtgggggatcgcaacgctaccgacctggcctaccgcaacgaggccgacgccgatgatgagtggtttcgcctgcgtcatgaaaaagccctgaccgctgacgcagtggtgcgcctggccgaagccgccaaggccaaatacggtttcaacgattttaagctcaagggcggtgtgctcagtggcgatgaagaaatcgaagccgtcaccgcgctggccgaacgcttcccggatgcgcgcatcacccttgacccaaacggggcctggtcactcaaagaagccatccgcctttgccgtgaccagcatcatgtgctggcctacgccgaagacccgtgcggtgcagaaaacggctactcgggccgcgaagtcatggccgaattccgccgcgccacgggccttaaaaccgctaccaacatgatcgccaccgactggcgcgaaatgggccacgccatccagctgcaatcggtggacatccccctcgccgacccgcacttctggacaatgcaaggctcggtgcgcgtcgcacaaatgtgcaacgactggggcctgacctggggctcacactccaacaaccactttgatatttccctggcgatgtttacccaggtggccgcggccgcaccgggtgagatcaccgccatcgacacccactggatctggcaggacggccagcgcctgacgcgggagccgttgaagattgaagggggctacgtaaaggtgccggccaagccgggcctgggtgtggatatcgatatggacgcagtggccaaggcccatgagctgtacaaaggcatgggccttggggcgcgggatgacagtgtggcgatgcaattcttgatcccgggttggggctttgataacaagcggccttgtttggtgcggtaaatcggctttatgaacgctcagctcaatttgagcgtgacgcaaaaaatccgatgcccaaacaggcatcggatttcagtcagatcagaagcttagctgtttgacctctggcacgtctgccagaggtctctttgcgctactgctgattggcgacctcgagatccgccgtatcctcctcaaggccagagacagcagtgccattgatcaacggcccataacggcggctgaactcccagttgtagggcacgtggtctttgttgaccccgttatcccaattcaccgaccaggtcatcaggcccttgatcgacaatcctttgtcgtacaaacgcttgaacgcacgggtcacggctgctgggttgatcacataaccggtggcagccgcgtcgacgttcgcgggcaggccaatgacgaacttgtctgccgggattttggtaaacccgcgcgttccgctcaccaggctttcggtcaggtaaaacaggaagtcctctttcatcgcgtcgttgttctgggcaatccaggcgccgttgccgttgttgacctcttgcacccagatcccgtcgccaccctggttgtaatactgcggggcgatgaagtcgtaatagccttccagcgcctggatgtaaccgacgtatttgccagcggtggtgaggtagggaaactccggcgccatgctgatgatgaagtgtttgccttgacctgcgtagtggtccttgaccaatttcaacgcggcgggcaggacagtcttgttgtcggcgaaatcaatcgcgctctgttcaagatcgatgtccaggccatcaaagccataggtttccacaaggcggataatctcgttggccagtggctgttcgttgcctttatgcagttcgatgtgcgcatcggcgccgcccagggaaatcagcaccgccctgccctggctgttgagcacgcccacctggcgacggaactcggcgtcggacaggttgtacggcttgaaggttgggataccgttgcccttcatgaaggccacggccaccacgttgtaatcctttggtacatccgccaggctcatattggcgaactggccacgctggtagccgtcgctcgggccggcaggccagttgtgccagaagcccatgaggatctttttgccggcaatgctgggcatcagcgaagcggcatcgttcagtggcgattgcagtgaggtaaagtcgatatttgacatgttctaatccttcagaacctgtgggtttaatgatgcgggcttatttgaagtccacgtcgaaggcttgatagaaggcgttgccggtgttggcgacgatccacatcaatacgatcacatgctggcccttcttgttggccggcagtttcacttcatgattgaccttggccttcagttcgccggcatggctgtagtacggcacctgggcatagaagtcttcagcgaacggctgggtttccagctgtgcgcgggtgatgcgctgtttcgggtcccagccatccttggtgatcagccagcgatagccacgggtggtgtgcggcgcggtgtatgcccaggtgaccttgaaggtctgacccggctcgacattgagcaacggccaggtgaaggcgcggttgagtttcttggccatttcctcgctggtgaagttgatgcagtcacgggcatcggtcttgccaccgctgaggatgaaaccgtcggctggtggggtgacgctgtcactgtcggtttgataaggcgccgggaacggaccggccatcagtgccgggaagttcttgccgccttccatctcattgacctgccaggtctccagcaggccgagatccatggcgactgcgccacggctggaaggggatgtgacacgaccatggcgaagaggtgtctgggtttgtggtttgttcattttgtgactccattgatttgattaagaactctccttttcttgaaggagaggacctcaacctaacggagttgcttttttttgccactggcccatttttcactcattttcgtttcatgagcgcgccgacctgaaaacactggatatataaccagtacaatgggaatagccttacgctaccagaggtcgatttcctacaagaccagccgcacatcaactcagcttctctcttaaatcgtttgatcccgttcgtaagggaatggccctctgtggacaaaaagggacgtctctattttcaatcaaataaaccgtcctcttttgggtccatcaggttttgccaatgacggccgtttttttaattgcggtcgcggcaatcggttgcaccgtcagttccacccctaatgccaacatcagcttctggaccgtctcataacgcgtctttgagccgcctttcagggttttatacaggctctcccgattcacccccgccgcttcggcaactttgttcacaccctgggccttggcaacctcggccagcgccttcataaggatttgcgggtcatggcacgccatgctttgcgcaagataggcactgatggtttccgggctatcaaggaagcgtaaagcctcataggcgctggtaccggatgtatccagctcgaggatcggcatgtcctctggtttgaacgtcgacttactcatgtcattgacctctcagggcatcgagaatcttttgtccgcctgtagcctactggctacatcttgcatctaccagtgcttttttaaaaccagcaacacacatccaatgtgggaggggacttgctcccgataacggtgtatctgccattgagaggttggctgacctgccgcaatcgggagcaagccccctcccacatttgcactgggttgctgttgaggcagcatttttccgcgcaacgtcaacccgcgactttctttggtattaagtaaaccggggcagacactattaagatgtcgcccgagcccaccaccctatcgtcacagcgggctctaccctcccaccccgacatcggaagcgctctgcatgaagctacctgagatcagtacattcattgctcaatggccctcccttggcgtgacgcagcctgccgcttggcgggtgtctcaagactgcgaaaaccaggttttggccttgctgtcacgcctcggcacgggctaccggcgccacggagactgtgccatccacgaaagcgccattgtcgaagaaggcgctgtgttgaaaggcccgatcatcatcggcgaaggctcattcgtagccgcgggagcctacctgcgtggcggcgtttatctgggcagccattgcattgtgggcccaagctgcgaactgaaaagcaccttcatgctggccgcaagcaagctggcacacttcaactttgtcggcgattcattgattggcgaaggggtaaatattgaagccggtgcaatcatcgccaattaccggaatgagttggatggggcggatatcaagatccgctacgcagacaatgtgatcgacacaggggtgaacaaatttggtgccctggtaggcgacggctgcaaaatcggcgcgaatgccgtcattgctccaggcgcaatattagagccaaacagtcgtgttccgcgtttggggttgattgaccagttcgcctacgagtagcgatagcctgtagacatgtcctacagcgcgctgcaccaccttgctccgttgcctacagttgcgtcagaatccgccggcttgtgcgcttggatgggcgtctctaaggtggctcggtcgctgacaactcagtgatcgggtttagtagcccgagggtcaattacacttagtgcatgagcttcatctatcagacgttcctgtctgtgcctgatggtggctgtgcgtagggcaccttcgggtgcgccggctttgtgtaattccccggtctactaacctgcgtacagctgccaccctttcgtttagtagcgaaacggtgtcggccccactcaggaattacgcatatgtacaaagtcacacctaaccctccaaacgatccaaacctcaagcttgatcaggcagccgttaacacccacgccgaaccatctccctcaccgctgttcagcgttgccgacgatgccagcaacgaaatgctcatcgccaacagctacgaaaccttttcctcggtaaccgccttgctgcttgatctgtcggatgaactgacaggtaaacagcgcgatgtcgcgttggcgattcatcagttgagtgaattgggggttttgttggtggacaaattgatggcgagggaaagtgcttcaacggttagctagtcttgcagccacccgatagaccgccgcgtcgtcatgatcgacttcacgacgactcggcagcgcctaggcgcccgtcaggccctcggagcctggtgggcgccctttctcttggaagacgctggagccaccccttcctcgcgcagacgattaatcagcagctgcgcattctgcacatgccacaccctcgggtttaccttcgaaaaccattgaccttaaagttggctttaaacctaagtcagtgggtggccaaggcgtgtgattgcacccctcctcatggttttggatttttcatcaattttaataaatacccaggccagcgccatcgcggggtggactgatcgggggtgcctgcaagggtgtctaccagagagcgcgtcttcaaagggtcggctacggcctcatcgacgacgctgtgcggctgcctgtcgtcgactgaaggcgcagccgcccgacgcggttttccggtggccgggtccatggtgtaacccgcggccttacctttttcggtgatggtccagatgccatcggtgttgataagcacgggctcatcaaatgtgagcgttacctcttcggctactgtgaccaccatattgtcgttgatacttatcggtgtataagtcgcgaactccctgcccagcaaagcttgcgtggcacctgcactggaaaatttcagcaccatctgctcaaggaaagcgatgctgcccatattgctcagcgcgccgaagtccgggttcaggacatgacgtaaaaaaccctgttcgaggcgggtagagtcaatggccgagccgtacagaatgcgtgatgccgcagctacatcatgctccttgaagttgaacgtcacccggcgcccctcctgattgtagccattattaccgctcaagagctggcgaccattgtcgtgatggcggtagttgccgaggtcgtaggccagcatgtcgacatatgccaagtcggctccttgctcctgcgcataggcgtacatgtctgacaacaggctgcgatcatcacgagtcaggaagtcgtaactgctttgggccatattgctagaggtcagggtgccttcggccaccgcaggttcatgccccaggaagagccgagaaatcatgagttcacgcccaatggcggaacctgaagaggcgctgacccgctgttcattcaggcgaacctcctgccaggctgcgcgccgttcgttgacggtgaacgtaccgctttcgtcgcgagcaatcagcgtcaattgatcgaccgcgagtcctttgaaagggttactggccaaaccgttggcaaaggcggtggcttgcttggcgcgctcaagcaattccagaacgtgagtatcgggaacctcagcatcatgctgagctttgtcagcgaaatatctttcgtcgctgatcgcatcgagcgggttggagaggttgttgcctgggtctgcttgacgcatgccggcgtcatggttggcagcgtcacttagttgcctcgccaggatcgataaggtgttgtcagcatcggcttcaacaacggcaggcgcgccgatagggtctcgaagaggcaacaccgaggctgggctcaagtcacggacaacagtactacccaggcgattattggctaacgacgtatcaacgttgatagttaccataaatggcctcgcgatcgattaacaacgcttttgagctgcaagtaagccccgcaggctgatcgcgagcggggctcgcaacttagtccctataccgaactgtcaccgtgtcgctgccagcgggataacccagtcgtgcaccgccgcccaaaacatgatgcttgatggtcacgcccgcaccttggccgaagggctgatcattgaagtcggtcgacgttccggaagatccaggccaaatcggcacacacgttcgctgggcggtgttataaggacgcgaatagcacaactcaacgctttcctttatgttttcgggataggaggtcgtattccaatcaatccctagcaactgtttgggaacgccgaaggaaccggctggaaaatcgctgggggacaagctaaaaatggccagtccagtcccaccaatagaaatgacgttgataacagtgggcgtgaccgttttactgatcattttttcctcggcattaactacaccggagggggaaaaagttattccgatcagcaaaaagactaaataactacggccagacaggtcatacctcggcttcgaaccaagtgatgcacttataagctccataatcatcaccctttaattaaaggtcagtgtcgacacatccagtaggattcacgctccaacactgcatgatttacagcttcaagtaagccagctacttcctaaaaacgtgaagtccgcatctgtaataccaagcagtaggactctgtcagccacttcgtagtcccgcctcccctctacctgaaccgaccgtttcaggtcatgctgcgccctccctttcaaggacgaaaaaagcatgaaagcccgcctcgccgctctgctgctgatgtgcctgagcgctaccgcattcgccgctgacaaccccgtcggcttccaaactaccaacctgcccgacacccacaacaaccgcccgttggaaatggctgtgtggtaccccgccgccgccactgccaaacccaagctgatcgccgacaatgtggtgttcatcggcgtgctggccgttcccgatgcggcgccgacgccgggcaagcatcctttggtggtgctctcccacggctacggtggcaattggggcaaacaggcgtggctggccagtgcgttggcgcagcagggttatatcgtggcggcggtcaaccacccaggcactaccagccaggatcgcagcgccgaggccgctgcgcagttgtggcaacggcccagggatttaagccgggccatcgatgcactgttggctcagccggcgccattcggtgcggtggatagcgaccggatcgcggtggtggggcattccctggggggctggacggtgatggagacggccggtgcgcgttttgacccggcgctgtttgcccgggactgcagcgcccatccgacgctggtcgcgtgtaccgcctaccgcgagatgaatcctgagggcactgcgaacgggaaggagcaattggccgcggacttgagcgacaaacgcgtcagcgccgtggtgtctttggacctgggcctgtcgcgcgggtttaccgatgcaagcctggcggcgcttccggtgcgggccttggtgatcgccgccggtgtgccgtcagcggatttgccggcgcagatggaatcggccgacatggccaagcggttgccaaaagcctcgacgcagtacgtgcagatcagcgacgccaaccacttcagcttcatgtcgcaatgcaaaccgggcgcagcggcggtgctcgacgcggatgtgcccggcgacagcatcatttgtcaggatggtccgggggcacggccacgaccgattatccagcagcaggtgatcacgttgatcagccagtttttggcacgttgatcagggtttgatgatgtaggagcgagcttgctcgcgaaaaatctcaacgataacgcgcgcttccaggtaaaacgtggcgtgctgaagtgcttcgcgagcaagctcgctcctacagaacagcggttcaaataagtatgaaaagaagcaaagacacctttgcctatcaggcggtgtaccgctacctcatcgagctgatcgaggcttgccctaccgacggcgaacgcaaattgccgtccctgcgccaactggccctgcgcctgggcgtgtcggtgtcgaccaccaagtacgcgtatgcattgcttgaggaacaagggcggatccaggccaggcccaagctcggtttctttatcgccccaggctcggctgccgtcatcaacccaagctcatctcccctgctcgaccaggtcttcgccaacgcacgccaacccggcatgctggccctgtgcagtgacgcgccggcgatgctgctgtcgctggagcaacctttgttgatgctggaacgcgaactgacccggcggtacccgcgctcactggcgccgctgtatctgccaatgggggaacccgagttgcgcgccgccctggccgaacgttacagccgctccacggagcactattggcaggccgaccaggtctatatcggctcggacctgcacagtgtgttggaggtctcgctcaatgccctggagctggccggcacgctcgcgttggtggagtcaccctgttcgtgggcgatcctgcgacaattgcaggcggcgaagatccgcgtgatcgagatgccgctcggcgcggatgggcgttttgacctggacgctttgagtgtgctgctcaagcgtgagccgatccgactggcggtgctgtcgtcgacggtgaatatgccccagggcggcgtggtgctgccacaggacaaacagcagatctgccagtggttagccgagcgcgatatctggctgttcgaaaacgatacctacggcgagctgtactttggcccgcaaccggcgcgctatcgtgactatgccgacccgcagaaactgttggtgttttcgaccttcgacaaagtcatcggctcagaggcgccctacggctatgtgctgtgtcgcagtgccggggcgccgttgcagcggctgtttctggagcgcggtttccgcctttcgccgatccgccagaaggccattgccaggctgttcacgacccaacgtttcgacgctcacctgaaggcgttgcgggcactgctgctggagcgcatgacccagctcaaggccttgctgcacgcctatggcgatgacctatggcgcgtggtcgccccccacggtggcgcaagcttttggctggaggccacgcgccccgtgcagatgcgccaagtgttcgcgcacttgctaagccagcgtatcgtcatcgcccccggcgaactgttcagccagcaaggcgcctggtctcatcacctgcgcctgagctacacactcgactggagcaaggacatttcccaggctgtccagctactggcccaggcgctgcgtcaaagcccgtagcagtgccggtcttcgggaaaacgcccctggcgcacatcgtcggcaaaacgctcgcacgcgtcacgaatcaccgcccccacgtcagcgtattgcttgacgaagcgcggcatcgaaccgccgcccaggcccagcacgtcctcggtgaccagcacctgaccgtcgcatgccggcgatgcaccgataccgatcgtgggtttgctcgagtccagggtgatctggcgcgccacgccctcggccacgccctccagcagcaggctgaaagcaccggcctccagattggcgcgggcatctgccgcaatcattgcagctgtttcaggcgtaagcccctgggccttgaacccgcccatcacattgacgaactgcggcatcagccccacgtgggccatcaccggtacaccccgtgcaaccagaaactccacggtaccggccagggcctgattggcctccaacttgaccgcatcgcaaccggtacgcgccagcacctgggcacaattgcgaaacgcctgctcatgggattcctggtaactgccaaacggcatatcggcgatcacacaggccaagcgggtactgtcgaccaccgcccgagtgtggccgatgatttcttcgagctgcatgctcaaggtcgaggcgcggccatagccgaccatggcggtggagtcaccgatcaggatgaagtcgacaatcgggtcgatcagcttggcgatagcactggaatacgcggtgagggagacgatcttctgctggcccttcatggcaaccaattggggaacggtggtgcgtttagtgcgggtatggatactcattggggggcttccgtttgcgctggatacccgacctgattattggtaaaacccagccccgttcaatgcacagattgccgcgaaaaagcgacccaggcccggccatgttttttcaagctggtatcatccactcctttcctccccaggcagcaagacatgaaccgccagaaaaaactccagcagctcttcaaggccaaagccaagaaggccagtgccaagctggcgccaaaaagcaaagataaatacatcagcaaggccgaccgtttgaagctggagaccgaggccggtgaaagccccgtcacgtcccccgagacgcctgctgaataaggcgcaccgctgaaggggtggccgcttcatatttgccccagatacgccgcagatgccgcgccgaaccaaagcctgcgcgctcggcaatagtttcaatggccaggtcagactcggccagcagttcacgggccacggccaggcgcaggcggtgcaggtaatccagcgggctgatccctacgtgctcctggaacaagcgccccaggtggcggctgccggtgcaggccagggcggccatacgtgtcacggtccaggcttcacagggggctgctgcgatagcgtcctgcacccgatgcaccgccggatgcaggtgattacgcccggaaatccagggtgacaactgcgggtcgctgccgctgcggcgcaggtacaccaccatgtcccgcgctaccgcacacgccagccgtggcccggccagttcggcgacgaggtacagcatcaggtcgataccggccgtgacaccggcgctgcaactgaccgggccatcggtcacgtacaggcggttttccaggacccgggccttgggcgccatggcttgcaaagtggcgcacaacgagtggtgcgtggtgcattggcgcccatcgagcaatccggccctggcggcactcaatgcaccggcgcatacgcacacaaggcgttccgcggagggcgcgaagacgctttgcagccagtgggtcaggtggttgctggccgactcgaaagcctgttggtgcaccttgtcgaccttcatcgtggaacccaccaacacgaccagggtaccgggggccagggccggtggcagtggcgccaaccctgtcagcggcaagccgatggacgtgtgcagtgacgccaccgggctgacgtattgcaagtcgaaatccacagccgtcgggtcgtcgacttgcgcggccaggcgcagcacttcggcaggccccgccaggtcgagcatcagcacattgggcagcaacacgaacagcaccggcacgctcattgactcatcccgccagggcctgggcgaccgtcacaatgcgcgcaaatcgatcatccaggaccagctccgtgcgctggcgaatctcagccggcgtgtagacccggccgctgtacacatgggtcatcgggaaggtcagcgtcgcctcgctgacaaaatccaccgtaaagccgctgtccgaagcctgccgtgtggtggtctcgcagcattgctcggtgcgaatgccactgatgatcagcgtggtgacgcccatctccgtcaggcgagcagccagtggcgtaccggcaaaggcactgtggtagcgcttgtggattaccaactgcggatcgatcgacaactcgctcaatgccctgacgttgcccgattgcatggagaaatgcccctggtcttcaatatggaagacttgtaccaccgggatgccttgctgaacacaaccatcgatgagtgcctgttgtttttccaggtaatcgggcaggtcattttcggaccagtaggttgaatgccggaacgaatgctgggcgtcgatcacgatcagggctttacggctcatggattgtccttgtggcttgtatcagtggctgaacgatgcagccatggtatgggcaacacacttcgcacgacagacgcgcgacggactacttcaggacggattcggacttcccaccgaacaggccatggcgcatcggctgccaggttcgaagccatgggcatactcatccgccaggagattttccaaacgctgatcggtatgcgctacaaaccccaggcgccgatagaacggggcattccacggcacctgcaggaaagtggtcagcgtcaccgcacgcaggtgccgagcacgtgcatggcccatcgccgtttccaccaacttgcggccccagccttggccttgcagcggctgggccaccgacacttcatggatatgcaggtcgtcaccgacagactctgcgctgatgaaaccctggggctggccgcgttcatcaaccactacccaacaggtcatcaaggcgatccactgccgatggcgctcgacgctgatcggcgcggcatccgccagccagcccagcccctcgattacccggaacgcttgggcggcagagcgctcgatggcgggcaatagtacggaatcctccatgcgcgccaagcgaatgtgagcgggccgctcagcacccactcaaggccacctggggccgttcgcccgcgaagaaaaacggccgcagacgcacgcccacgctgttgccgataaacgctgccaccagccacacccaaccgtgcaggctgcccgaagcgatgccgctgaaataggcgccgatgttgcagccgtaggccaggcgcgaaccataaccgagcatcaggccgccgatcaccgccgcaatcaacgagcgcgccggaatattcaggctgggcgcgaaacgcccggccaggccagcagccagcagcgcgccgaggacaatgccgatatccatgacgctggtaatgtcttcccataccggcgcggccagcgccttggcattggccggcatctgccagaacgcccagctcgccacatccacgcccaacccactcgccaccttggcgccccatagcgcgaacgccgaggtgatgccccacggccgcccggccagggccagggtggcgtagttgagcaacgccaggccaatcgcgccccataccagcggccacggcccacgcaggaatcggcgcaggccttgatgctcgctttgcacgccttgctcaagctcgccgtgacggcgcttttccaagcgcacactgacaagcgcaatcagtgcgaacagcgccaggctcaggaccaatgccggcagcacaccgaagctcttgacgatggaaaccgccgggaacgacggcagtgcaaaccaccagtcgacatggtgggtggcgatcaacgagccacagataaagaacaacagcgtcaccagcatgcgcgcattaccgccgcccacggtgaacaaggtgcccgatgcacaaccgccccccagttgcatgccgatcccgaagataaacgccccgaacaccaccgacaccccggcaggcgccactaacccggccaccggctggccgaacaggctgcctgcgcccagcgccgggaaaaacagcagcaccgctaccgccagcatcaccatctgcgcacgcaagccggcgccacgccgatcattgataaacacgcgccaggccgaggtgaaaccgaaggcggcatggtagagggtcaggcccagggcggcgccgaccaccagcaacagcacctggcgcgcgccgactgtgttttgcaggaacagggcgcccgccaccaggatgacaaaggctatcagtggcgcgatgggcgtgcgcgccggagggagggaaacagaggtgctcatggggatctcgatgtatttgaagaaggccagtatagacccttaaggtgcgggtcctatttgaggctcaaggaattccacgctgcttcggccagcagctcacggtactcaaaggggctctttttgacctttgccgacagccatgcacgcgaatagctttccgccgcgccaatgatcaacgaaggaataagttctgcgggcaaatggctgaagtgttccttgcgcccttccccgcccatccattccttcaactgctggttgcgctgccggttgcgcgcaatcagctcgtccttgaacgggccgttggacacggcaaaacggctttggaacacaaaccgcgcccactccggctgtgcgctgacccattcaacgtagctgtacaccaggccgaccacgccggcgtgggcggtgtccgccgtttgcaggtagcgatcacgcaaactggcctggtcttccagcgcagcgaagaacagcgccgccaccaagccctctttattgccgaagtggtgatagatagcgccgacgctggtatcacagcgcgcacggatggtttcgatattggtcgcttcgatacccgcctcgttaaagcacgccagcgcttcacgcaggatggtgcgcttgaggtcgctgcgccggccgggaaaggtgcgctcgataagatcgatggagtgcatggggggacgccaaataaaaacagtttataggttgagcgaccgccagagaaagcctggttgacagaccgggaaacagcggaatattattccgttacagaatattattctgtaaaccacttctgaggatattcctatgagccaagccctgagcatgttcaatagcgtcggccccgccgcattcagcaacctggcgtgccaaatggccccttacttcagcacgatcacgccgcaaatcgctgagctgaagcccaaccacgcggtggtcaccgtgccgtttcgcaaggaaatcaccaatcacctggcttcggtgcacgccatcgcgctgtgcaacgccgccgaactggctggcggcatgatgaccgacgcttcgattcccccaggtgcacgctggattcccaaaggcatgaacgtggaatacctggccaaggcaaaaaccgatatccgcgccgtcgccgacggcagcgctatcgattggcagactgctggggacaagatcgtgccggtagagatcttcgatgcgggcgacatcaaggtgttcaccgcccacatcaccatgaatgtgaaactcgcttaggcgatcggccggtcagtgccccaccaccgcaggcccattggcagaccgccgtcccggcttgaaaccatgggcatgcgccgtccaggcgatcagcaacgcgaggatgatcaataccagcatcgcccagggaaacgcggccacgctccagcgatccagcagcagcccgccgatcacgccactgccggcaatcgcactgttccatgccactacgttcagtgacagcgccacatccgcgccgtcaccggcggcatcggccagggcggtttgcagcagggtggcggcgccaccaaagctcagtccccatatcgccacgccgaggtagaccactgccggctggctgcctagcaggccgaacgccacacagatcgccgcgaatgttcccaggctcgccaacacggttttgcgcagcatcggctcgaccaaacgcgccgtcagccatatacccgccaatgcggcaacaccgaacaccagcagcaccaggtcgaccctgtccgccaagccagcccgcgccacgaatggcgcgatgtaggtgtacagaatgttgtgggccagcatccaactgatgacgaccgccagcaccgggcgcacgccgggcgtggtcagcactttgccaagggatacgcgctgatgcgcaggctgtggcgggtagtcagggaccttcaccagcacccacacgatcagccctagcgtcagcgccgacatcaggccgaatgtggtacgccaacccaccaggccaccgagccaggtgcccagcggcacacccagtgacagcgcaatcggcgtgccgaccatcgccaaggccagggccttgccttgttgctgtggcgctaccatgcgccgcgcataaccagccagcaggctccaggccaaccctgccgaaacgccggcaaagaagcgcgccaccagggtcacgccatagtgggatgacagtgcggtgatggaattgaacagcaggaagccgacgatggtcagcagcagcacgttgcgccgacgccagccacgggtggcgatggtcatggggatcaccgccagcaccgagcccagcgcataggcggtgaccatctgcccggccatggacggcgaaatgcctaggcctgcgctgatcaacggcaacagcccggcgggcagggtttcggtgacgatgcagatgaaaccggtcatggccagagcgagcagcgcgccgatgggcaagcgttcagacgacgccgataggctgagtgagggtgtcatgggaaactccttggcggacttaaatactgatcgatacaaatgttgcgcgacctggcatcgcattgtcaacgacttatgtatcgactagtatttatctcatctccccaagaggattgccgtcatggcgcaaatgggccgcccccgcagcttcgaccgagaagaggccgttgaacaggccatgcacctgttttggcagcacggctacgacgccacctcccttgctcaactcaagacgggcctgggtggcggcatttccgcaccgagtttctacgccgcgttcggctccaaggaagcactgttcgatgagtgcgtgcagcgctacctggcaacctacgcccaggtcaccgaatgcttgtgggatgaaagtctgccgccacgccgggccgtcgaaaccgcattgcgccagtcagcgcgcatgcaatgcgacgacgcccaccccaagggctgcatggtgacactgggggtgatgagcgcgccgagcccgcagcatgcgcgggtggtgaacgcgctgacccaatcccgggcgcgaacccgggcgggaattgtcgcgtgtatacagcgggcgatccaggccggccagttgccggacacgctgaatgttgaggcgatggcgaccctgttcgattgcttcttgcagggcgtgtcgatccaggcacgggataacacaccccatgagcagatcgatgcggcgatcaaccatctgctgttgacctgggacatcgcggcatctacggcagcgcccattcgtcacggcacgccagcgctgttgaaaacatcacagccgtaaggaagaacacggttgcactatctatttgcagcgctcggcatcacgcgggtgaaatcgaggatgacggtgaagcgttgttgctcgcggatcacgtcaatctgccagttcaactttgcgcacaattggcgcatcaactgcaacccaaggccatagccatagtcgtcggattcctggcgcggtttgacctccctgatgtgattggcaatcaccagccgagggtatttgaagctgatatctactgcgccctcttcggcgtattgcagtgcattgcgcaggaagttgccgatcacgatgcggcacgcagtagggggcagtcggcaaggttcgtcgtggatgtcgatgctcagctcgatatcccggttaccgatcaggtagcggtgcttctcaatcagttcgccgaccacgtcgctcaagttaacgtcttcctccggcagcgattcggcgtgctcgcgactcatccacagtaaggtctcggcgataagctgcatattcagcacggagcgttctatacgctgcaaggagggaggcagcacaccgccggattgcagggccagcagttcgatattggccttgagcaccgccaatggcgttcgcagttcatggctggtgtagcgcaacaggcggccttcacgctggctggcggcctgcacttgctcgacacttttggccagggcatcggccagcatattgaactccttgaagttgaaaccaggccgcctgctggccagggcatcagggtttttcaaggtgccggaccattggaccaaacgtcccagcggacggaccaaccaccacacgagcaaagcgatgatgatcagcgccggcacgaataccgccaggctgatgaacttaacgctctctatgacctgatcaaaataggcgtcagacaatggcgtctcgacctcccccccggcctctttatcgtggtcgatgtcgtacatgtagagggttttgccgtcacccaggggctgttcaaggatgatctggaatggttcgtcgtcgtcatcggaatagagatcgccgaagatattcaccgcaccgaaggacagattcggcggtgtattgagcaattcacggacgtcctgcggcaacgcctccttgccgatgacgctggtatagaaataattgtgcggagtcggtgtggtcgggtcctgcttgtagtgcctgacaaaatactgggcttcctcttccatcatcgcgctggcggtatagaacaagccgcgcacggtaaattcaggcagcagcctgctgtagatcaccagcaccaccgcaatcagacacaggaaactcccgctgatcacccatttcaagctcaggccgttacgcatgggctttcacctgaatgccgacacccggcagggtatggatcaacggccggccgaagggtttgtctaccgccttacgcagccgatgcatgtgtactttgagcgtattgctgtcaggtggctcatcgccccagatcttcgcttccaggcgttctcggggaacgggttggggacttgcgcgcatcaggctttccaacaaggtccagcaaatgggtgacaaatgcagctcctgccccgcgcggctgactttgcgggtggtcagttccatcaccagatcatctacttgcaggcgactggtctgaccgctgcggcgcaggctcagtgcgcgaatcctggccagcagttcagccagctcgaacggcttgaccaggtagtcgtcggcgcccgcagcaaaactggcgagcttgtccgataaggcgtccagcgaggtcagcatcaggatgggggtctgaatgccttgctgacgcaaccgctcgcataattgctggccgtccagtcgcggcagcatgatatccaggagaatcacgtcgtaatgctggttgagggccaggttgagcccggtctggccgttagtgacgtggtcgcagacgatgccgctgatctccaggtactcgatgacggtggtggccagatccaggttgtcctcgaccaacagcaagtggatatgcacggaaaaaacctcggacagggagtgcgcagaggtttgaaggataacggaagtcgagcggttccctacgggtgtttacctgacgttaacccagcgctgattaagctggagttcctctagtccagagctcgtcatcgccatgaacctgtcttcgatgatcaaaggcgtcctgctagccttgattttcctcacactgctgctcggttgcctgccaccacaagctcagcggatgcgtatgggaggcaatagctggtttccgattggccacaacatcgagcactcagggtcgtggtatgtcacctgtgcatgctgacgacgtcgacgccagctatgccaaccagttggtcgcctgtgtggtgctgattgtttgtgtgtcggttgcggtcggtatctatatcgcgcgcttgaatgcccatgttgataagcaacgcgagctggcgtcggtatacctgcacgaatgtcacaatgggcgcgggggctttattgtctaccctgatggcaggcgcagcgcagacgactgctacaccgccacagggggtaaatcgacggatgccgacgagccacaggatcttcctggcttgcttggggctcaatagcgttgaattcatctgaccctgcgttgaatccgcgcaggcttttgacggtagaatcgctgcgaatcgagctccaccaaggataggaaagcaatgtatttcaattttatcactctgctcacgctcacattgctcactggttgtgcagcaatcccttacgaaaagccgcaagaccagttgagcatccagaaagacttgtcattaaaacctgaagaaattgtcacaatgacccaggtgaattggtgcgcctacgcctatggtgaactgacgccttgccatcctcaggaagcgctgggggttcagactcggacaaaattgatattggccagttacgacaagccccactacaaaaaaattgttgaagtacaagccagcgatgtcatgtgcgcgcacctacaaacgccggtagacaccactccaaatctgtttttgttcgcgcaacactacgccgtgcagatttggccagtagagccgagttttaaaccggatatagcgaagaaaaaactcatcgtggacaccatgctccaaccaggaaagcgaaccttagtgggcactgaaaaggattatgtaaaggccacggggcatgggagagcaagcatgacgatgaccgctatcgtaaacctggttaatccttgtacgctttgaaaccaaaaaggttggaaggtccctcccggcgcctcatgcgttagcgtatagaacgaggacagtgacggctgggtatcgagatcgacgagtacgaagacccgcgtcggcgcagaacgcgcctggattggcgctaactgtggttttacccggcccgcatttggttgaaacgactgcagcgactttcattggccttacctctgaatcgaaggattaaagatggcgtcatgggaatcgcgctaagcgtttggattgctgggtcaaatcccaggcaaaaaaaagcctgtatctctacaggcttttctctatctggctccacgacctggactcgaaccagggacccaatgattaacagtcatttgctctaccaactgagctatcgcggaatgcgccgtatgttactgattaaaaagaagaagtcaagcgttccctgacgttcgtcgcaattaactcccatgaccgctcgagaaccccggctccagggccaaatccagccaggcccgcgccgcaggtggcaggtgggcactggcgcgccaggccagggcgatgtgccagtcggtgtggggttcgtccaggtggagcaaggcgatgccggcgtgttgatgcttgtgcgccagcatgcgtggcagaaaggcaacgcctaggccggcggcgaccaggtcgacgataaagtcgatctgcccgctgcgggcggtgactttgggggtcacgcccttgcgctcgcaagcgctgaggatcttggcgttgagggcgaagccggcttcgaacaggataaatggcgagtccgccaggtcggtaaagtcgatgcgcttgcgatgcgccaacgggtgactgataggcagcacggcgatcaggggttcgttgcgtactggctggtagtcgaagccttcatctaccggcaacagcagggccgcgaggtcgacctcccccgcctccaggcattcacgcagttttttactgccgtattcggtcagttcgatatcgatgtccgggtaacggctgcggtaagcggcaaacatagcggcaaacaacacgccacatcctacgggcggcaggccaatgcgtagcacaccacgcttgaggccgcgcaggtcattgatttcagccaccaggtcgttgcgttcggcgagtatcaccagggcgcggcggtaggcaatttcaccggcagcggtaagttcgttcttatggccgaggcgattgagcagcggcgtgcacaactcatcctccagggtcttgaccgccttgctgacggtggactgggtcagcgccaccgtgtcggccgcctgggaaaagccgccttggcgtaccacttcgacaaatgcacgcaaggttcgcaggttcatcagtattccctttgcgactggatagcagcgataaaagttgtttttatcatgtcacaactttgcttatggtgtagcactttgccctgtggagacaccgtagatgatcatctcgtccgcttccgactaccgcgctgcagccaagcgcaagttgccgcgctttctgttcgactacatcgacggcggcgcctatgccgagcacacgctgcgcgccaatagttcggacctggccgagatcagcctgcgccagcgcatcctgcgcaatgtcgacaacctgagcctgagcaccgagctgttcggcactgaactggcgatgccggtaatcctcagcccggtgggcctgaccggcatgtatgcgcggcgcggggaagtgcaagcggccaaggcggcggccaataaaaacattcccttctgcctgtcgacggtatcggtgtgctcgattgaagaagtggcctcgcaaagcccgcagtcgatctggttccaactgtatgtgctcaaggaccgaggctttatgcgcaacgcgctggagcgggcgcaggcggctggagtcaccacgctggtgttcactgtggatatgccgacacccggcgcgcgctaccgcgatgctcactcgggcatgtccggcccatacgcggcgcaacggcgcatgttgcaggcaatcactaaaccgcaatgggccttcgatgtaggcctgatgggtcgcccccacgacctgggcaatatctccaagtacctgggcaaacccacccacctggaagattacatcggctggctcgccaacaacttcgacccgtcgatcagctggaaagacctggaatggatccgcgagttctggaaaggcccgatgatcatcaagggcatcctcgacccacaggatgccaaggatgcggtgagtttcggcgccgacggtatcgtggtctccaaccatggcggccgccaactcgacggcgtgctgtccacggccaaggcgttgccgccgattgccgaagccgtgggcgacgacctgaccgtgctggtggactccggcattcgctccgggctcgacgtggtgcgcatgctcgccctgggtgccaaggcatgcctgctcgggcgtgccgccgcctatgcactggccgccgagggccagcacggggtggagaacctgctggatatcttcgccaaggaaatgcgcgtggcgatgaccctgaccggggttacttcaatcgcacagatcgatcgcagcaccctggtctagccttgctgctcggcgatacctctcgaccttaacgtatgcctggatttatcgtgatgggagccgtgctgtatttgcggctcaatccagatgttttttattttcggcaaacaacctgacccgcaaagagtaaaactgagcaagcggtagcaactctagctccaaccagccaaataactggcgccattgtttgccagacttttctgacattaaatacagtcgattgatttataaggagttttgttgactgcataaacttggcacgaatctcgctctaatactcttcaagcaggttgggcgatgacaagacgtgcggcagtgccccggggttataacccgaggcaaagcggtttaaactgtttccaatgttttacggtactgaaggaacagtaagacgcttggcgttcgccactctcatcccgcctgtaagacagccaagtgcttagaggccattcgtttatgaaaacacccacccagaccaacgcaattgacttcgacagtgccaaattgcagcgcctgggattgggtcagccttcccttcgcccacgtcgccctgcaacactcaccgaacttcgccagcaattgagccagcagctgcaaaccagccttgagccggagcgtatcctcagtctgttctttcgcgaaatacagcgcttggtaccactggatgcgttgcaatatcgccatgccgccagcgacctgcgcctggagttcggccatcgtggccaccattcggtgagctacaccttgagccacgagggcgagcacttgggcgaactggtattgcgccgtaaccaacgcctgatcgaagaggagctgaaccagctcgaggcgctgttggtaacgttgctttacccgatgcgcaacgccctgctctaccgcgccgccacccgcagcgccctgcgtgacccgctgaccgaaaccggcaaccgcgtcgccatggaccagaccctgcaacgggaaatcgacatggccagacggcacctgcaccctctgtcgttgctgatgctggacatcgaccatttcaaaaaaatcaatgacacccatggtcacgccgctggcgacagcgtgctgcgcgccgtggccggggcgatcaagcgccagttgcgtaacgtggacatggtgttccgctttggcggggaagagtttctgatcctgctgtccaacaccggtcgcgaggccgcgaggatggtcggtgaacgcctgcgccaggcggcacaagcccaggactactgggtggagggcacgcggatcgaattgacggtgagcctgggctgctcgacgctattggcggccgagtcggctgaaagcttgctgcgccgggcagacaacgcgttgtacgtggccaagcgcgaaggccgtaaccgcttggcaatggcggggtaagcccccgccatcgcacttacctcacgcctcgctggcgacgcgcattgggcgctcgcgcaccgccgccttgtcttggtctttctgcgcgttctccaggcgcatgcagctttccaggaacaggtacatgtagtcatagctcttgcacaccgcctggcgcagctcttcctggagcgccttgctcgggttggtgccggccagggtgcagatgatttccagggcttcccacgggtgggcatcgtcgtactgggcgtgcatcttgagccacttcatcgcgcgcttgcgatcttcctcagggaaggcggcagcatacacaccggtcgagcagaccacggcggaccactccccagtcgccccctcgatcgcgtagttggtggcggcaatcgcgacgatcaacggatcggccgaactggtgtgccagcaccaatggctcagtgcgtgcagttccggcggtacgtcctgcgcctgcagttcttccaggctgacgccgtgggcacgcgcccagtgcacccaatagtcggcatggttgagttccacgcggatattgcgcatcagccaacgtcgtgccatgtcctcccccgggtggcgggcaaacttggtcttggtcaggttctgcgccatgtacaaggcaaactgttcgaccaccggccaaccaccaatgaggtagtggcgcatggtctgggcgctgagggcgttgtcgcgcatgcgctgatacagttcgtgctcgacaacccggcgcttgctctcgctacaggcctggatcaattgctgcgcccaggcggggtaactcgaggcttccataagcgggccggttctgttgaaggtgtcgatcactgtagggctccttttaagtgtgattgtacagaccagcaaatgtttcagcggaaagtgccgggcgccttgaataacagtggctgcggtcgcgcaggtcgacactgcaagctatcaaaggtaaacaactgcgggcgttcaatcaggtagccctgagcgtaatccacaccgatctcaagcaacgcctgttcgatctggggtgtttcaacaaactcggcaatcgtacgcttacccatgacgtggccgatgtggttgatcacttcgaccatggcgcggttaatcgggtcgtccagcatatcctttacgaaacttccatcgatcttcaggaagtctacaggtaaatgtttcaaatatgcgaatgaggacattccggcgcaaaagtcatcgagagaaaaatggcagcctaaggctttgagttcattaataaagcgaatcgcactacccaaattggctatagcactggtttcagttatttcaaaacaaatcatttctggcggtatgttgtaagtgccgaatttctcacgcaaaaaaccgagaaagtcatcatctccgatagttatgcctgacagattaatcgcacacatcgccatggggcggcccggacgttcatgcatgcaacgggcgataatcttgaatacgttctccaccacccagcgatccagggaagtcatcaagccgtaacgttcggccgcggggatgaaactgtcaggcaggatgattcgccccgcctcatcatgcagacgcaggagaatttcgatgtgcccgttgccggcttcggtctggcccaaaggcgaaatttcctgggcgtagagacaaaagcgatcttcttcaagggccatgtgcagccgctgcacccaggccatctcaccaaagcgcagggacagctcggaatcgtcggcgtggtagacctgcacgcggttgcggcccttttccttggccatgtagcaggccatgtcagcagcgcgcagcgaggtttccagggtggtcggggtttgcgagatatgcaccaggccaatactgacggtagtcatgaacggccggcccttccacacaaagtgcaggctctgcacggtatgacgcaagctctcggcgatcttttccgccaccgccggcggacagttctccagcaggatgccgaactcatcgccgcccaggcgcgccaacgtgtcgccctcgcgcaagtccgattgcaacagcgcacagatgtggcgtagcaactcgtcgcccgcggcatggccgcaggtgtcattgaccagcttgaactggtcgaggtcgaggaacatcagcgcatgtcgcccagtttgctggcgtgtggcgtgttgcagcacctgttcaaggcggaactcgaattcgcgacggttggccaggccggtcaaggcgtcgtgggtcgcctgccaggaaaggttggcgatgtactgacgctcctgggtcatgtcgtgcagcaccagcaccgcaccactgatcttgccggcgctgcggatcggcgcgccgaccagggtgaccgagacggtgctgccgtccaggcgctggatcagcttggaatgctcgctgccgccactgagctggcccttgatgatgtgctcgatcaaggtgaaaccgtcgggctcggcgttttcatccagcaacttgaacaatgccgccagcggcaacccctgggcttgctccgacttccagtgggtcaacacctcggccgccgggttcatataggcaatggcaccgtcgacgtcagtggtaatcaccccatcgccaattgactccagagtgatctgtgcacgctccttctccgcttgcagggcatcggcgaatgcatggcgctgggccagcaacttatgggtgcgcagcagcgccagcacgatcaagcccagggcggtggccaggttggtgatcaacaacaggcgcaggatcacccgcgaaccttcgcccaaggcatcgctgaacgccttggcggctggggtcactccctcgttgatggcgatgatgcgcgccttccagctacgcacgtcattgtccgtgacctggtcagtgccgatggcgcggtgcatctcccgggccagttcatccagttgttccagataagcatcgccaactgtccacagttcaatggctttttccagataactgaaatgacggaagttaaggtacagccagatcaggctggggacgtcatccgggtgattgccgcccttgaggatgcccaggcgtgcggcagccaggtcaggcgtggcactgtccagggcgacacgcaactcatgcccgccctggggcacggcaatggcctgttggtatttgaggtaagtggcgtcgtcacggctatcggcatacagcgtcaggtagtagatcgcgtccttctggcccttggaccacaagctttcaccagccacatagccacgcaccgcagaaagcacgtagagactgccgcagcctaacaatgcctggaacaagacaacggcgataaagggccagacaatacccaacaaccgtggcgttccgagagtccgcttttgcttcatgaagtcccttgcacatgcacagctcaatacgcacgcgaaaatccgcttccgatagcacagcctaagctaaatcaacgcacttgttgcagatgtccgtacagttttgcatacaatccgccatcggcgatcagttgttgatgatcgccatcctcggcgatatgcccgccatcgaataccagcacccggtcagcctgcttcactgcagacagcctgtgggcgatgatcagtgtagtacgcccactgagaaaccgcgccagtgcctggtgcaggttatattcggtagccgcatccagcgccgaagtggcttcgtccagaatcaccaccttaggctcggcaagcaccatgcgggcgatggccaggcgttgccgttgcccaccagaaaagcgcacgccagagcgccctaccacgctgtccaggcccagcggcagtgccttgacagtagcctccaactgggcgatttccagtgcctgccagcaggcttggtcggaacgcgtgcggcccatggtcaggttggcgcgtacggtgtcattgaacagcgccgggtgttgcagcaccaccgcgacgttctcgcgaatggtttccaggccgatctcctgctgggtcgcaccgccaaaacgaatactgcccgcctgcggggtgtaaagccccagcaacagttgcaccagggtacttttaccgccgccgctggcgccgacaatcgcaaccttctcacccggtgcgatggccaggttcaattggtcaagcaccaggtcttcgccgtagccgaagtcgaggccacgcacctcgatgccgacggtttggcgcccactgaacggatctgcgccgcctgcgtattgcggttcatcggcacgcgccaacagctcgttgatccgcgtcagcgcaccaccggccgcgtagtaggcgtattgcaggttcagcagttgttccaccgggccgatcatgaaccacaggtagctgaacacggcgagcatctggccgatggacaggtcggaaaacagcacggtcagcatggccgcagcacgaaaaatgtcgataccgaactggaacagcaaaccactggcgcggctggacgcgtcggttttccattgggaatgaatggcgtagtcgcgcacttcctgggcacgctggccaaggcgcccaaggaaaaagccctggcgattaccggcgcgcacttcctggatggcatccagggtttccgtgagcgcctgggtaaaacgcgaagtactgtcgttctcgagcttcttgaggtgcttgacgcgtttgcccaactgcactgtggcgtagatcaccagcgggttgaacaacaggatcagcagcgccagttgccaatgcatccacaccaggatcgccgaggtgccgaccagtgtcagcatcgctaccagaaaacggctgagggtttcaccgacgaacttgtccagggtatccaggtcggtcaccaggtgcgtggtgaccgttccgctgcccaggctttcgtactcgcccagggagatgcgcttgaggcgctcgatcaggcgcacgcggatgcgatagacgatgtccttggccaagcgcgcaaacaggcgcgcctgcaccacgttgaacaccagcgcgccacaacgcagggccagggtcaccaagagcatcaggccgatatagccggcggctttctgccaacccaggggcaatgcgtggttcatcaccttgagcgcagcgtcgccatggccgagcagcacttcgtccaccagcaatggcaacagcagcgggatgggcacgctgcacagggtcgccagtacagcgacaccgttggcgacccacagggatctcttgtggcgcagggccaggcggcggatttccgcccaggtcaggcggtcggtgcgttggggttgttcatacacaggcggctcgctccaaccagcgggcgagcaaaggcgacagttcggacagcgattggtagccgttggtcagcaaggccagttggccatcgcgctcggccagcaaggtagggaagccagcgatgcccaaatcctgcacccaggtaaaatcggccgccgtcgccgcatgctgctcggcgcggtcgaaagcgccggcaaactcgatgcgtggtatgcccgcctgctccgccagttccaccagcacactggcaagggtcacatcgcggcccccgacataaaatgcacgctggatcaggcccagcaacgtccatgcgcaatccggcgccaggctgcgcgccgtgacgatggcgcggcaggccggctcggtgtcgtagacaaaaccatcaggcagcgcgccctcgagcttgaacggttggccggtggcctcggtgacggcctgccagtgctccaggatatagcgccgggtggtcggctccaacgccgcgccgctgccggtgcgcaggccgcccaccaccaggtgcacgtccacgccggccgcctgggcctgctcaaccagcgcctgcgctaccggagcaaagccccagcaccaggaacacatcgggtccattacatagagcaggcgcgcggacatggctcaagcctcggaaggggtttgcttatagttgaagccaatcgggtgcggcatattgcgggccttggccagttcgatctgtttctggcggtcgatcgcgctgcgacgggtcttctccggcagcttatcccagcaatgggggcaactgatgccggccacataatgttcggatgcgcggtcttcgatgctcaccggcgtgcgacaggcatgacattgatcgtagtcgccttcgctcaagtcgtggcgtacggtgacacggttgtcgaacacaaagcagtcgccctgccatttagtctcttcctgagggacttcttcaagatacttcaggatcccacccttaaggtggtagacctcatcgaagccttcgctgagcatatagctcgaggctttttcgcaacgaatgccgccggtgcagaacatggccaccttcttgtgcctggccgggtcgaagttggcttttatatagtcgggaaattcgcgaaaactggtagttttcgggtcgattgcgccctcaaaggtaccgatggacacttcgtagtcgttacgggtgtcgatcaacagcacttccgggtcgctgatcagcgcattccagtccttcggatcgacataggtgccgaccttcttgttcgggtcgacgccttcaacgcccagggtcacgatctctttcttgagcttgaccttggtgcgatagaagggctggtcgtcacagtaggactctttatggtcgatatcgaccatgcgagggtcttttttcagccaggccatcaggccatcgatgccttcgcggctgccggaaacggtaccgttgatgccttcttcggcgatcagcaaggtgcctttgatgccgttgtcgaccatcgcctgcaacaggggctcgcgcagggcgacgtaatcttcgagggtgacgaacttatacagtgccgccacgacaatcggttgagtcatgggtgttgtctccaggtggctaccctcgtaaggggtgaaccggatgcagaaaaatgcaggccaagccgcgcggcgcacattctagcaaaaccacaacaccactgcatcgacactcagtcaccgatatttccctgactcgctcacggcattggctgacctcggcccgtacagcctgcgtgatagcgtcttgcgtcgtccattggatccacctttgggctcacaggaagaccgatgacatggaaacttcaaaccgttctttattggccagactggtggaacggcccgcccctccaggtgttgggaaggtcgacttcaccagcgccatgaaccaactaggcttcaccagcgtcttcgacatcgtcgagctgcccaaggccgagttcatccgtcaactggcccgctacaatgatgacgatggcgcccacgcttacgaaaacgcgtcgtcctacgccacgcaattacaatggctgtacgaccaacaaccagtcaacgcccccccagcctccacgcgtagcaaacgcgacctgggatccaacgtacccagcctgctcaacgaggattgggggaacgtctgtcatcccggtgccatcgccgctatcgactcaccggttgcctacctgcgcacactgtttctttttgcaactcagcttgaaaacaacgggacgggaacgcaacacaaaatcctcctgagccagcggcgcccggacctgaaaaacttactgattgaccacgacacgacctttgcccagcgcccgctgctgacgctgatcgatgacctgttgcgcaaccagatcaaacaccatcacccgcaagaagagttgcacctgctgctcagcaagcaacactaccccttgacgctgccttaccaccatcatcacctgcaatgccgcctggggctgtcgggaacccaacacgccttgggcgaattgaattatcgactcagcaagcggctgccgtttgacgatgccggcaacgcactgtacggcacggtcaaaaagcgcaatggtgacgcgcaatgcctgctaagcgaactgaatccgcagcagcaaaagctgttgacgcaaccgcccgtcacggagagcacactatttgaaacctactttggcagatcccgtgcaccagaaaaccttgacgactttttgaaatgtacggcgctggacagtacccagttgcaagccctcctggcgcaaaacagtttcgccccccatgcctcccgctcggcgcctaaacaaacgttgctgatctatggtgcccgctatgtcaatggcacagaccgtctgcccaagctggaagtcggccacgccgacggcgggaaaattgcgacactactcaataccagccccgaccggttcgaccgtctgcatcggatgatccgcctgcaaaagtgggtcgatctaccgtttgccgaactggatacgctgatcgtcaacgccatggtgcttgagggcaccgccaacgccgctcttcagataagccacaccaccctgcgcgcactaggtgtctaccgctacctccgtgggcgctaccggctcaagccgctggagtttgcggcgtggctggatcgcctgcccgtacaggccagcgccaacgagcaacccttattcgatcaggtgttcaatcgcacactgttgtccgggcgaccactggcgctggacgaccaagtcttcgattcgcatacccgccagcagctttgcgccgcgttggcgttgagtgacaccccggattcgctgcaactgctgacagacgtgctccccacccctgtcctcaggaaccttgtcacatactcccggatctatcggctggcacgcatcgcccaggttttcggcctttctgtgctgcactgcaaacagctggccgacctgctcggcccgtccacctggagcaagctggccacccccacattgagcaccgagagggactttctcgatgtactcatgcagttggactgggccgtcacctggctcagggacagtaacaccagcgtaacgcagttgcgccagcgattgctgctggaacccgccactgataacccagcgctcaagcgctgggtcgacttactgccaaagggacttgaggcgtgcatccaacagttcctggaacacccggcgccggccctttacagcaatgagcttaagctctactacaacctgcatttcaaaaaaacgcagactgagcccaaacacctgatcctgctggcgccggatatcaccacgctgttgccgttgccggtcaacagcgcctcactgcgtcaattactgatcaacccccattggcttgacagcaaaaaatcacccacagaactggtcgaactgagcctgggcacactctatcttttgcagcgtttcagagactgctgcgatacgtatggcctggcgcaggacagcctcttggcgtacttccagagcgccaacagcaacgggcctcaacccctcgataccacgctcagccaatggttggggtgggacgaaaaagaactgcgggtactcactgagaccttgcccacaggcacggtcaagtccatggaccaactggattggatcatgcgctgtcgacaagcctgcaccatcacccggctctccagccaaacgctgctcaacaccagcgaactggataacgccagcgatttcagtcaatggaagctcgtgggcgaagccatcatcgccgcacatcaataacggcttactctctaccagcagactcaaggaatgaccatgtctgagcccctcgaccagcgcctcaatgaagcctggcgtgatgccatgctgagctactatctggctcactgcatcagccccgcccttaaagactcgttgcgcgcacccagcgacctgtacgactactggctactggacgtacaagtcagccaagcggtgccaaccagcccggtcgccagtgcgatcaccagcctgcagcactacatcaaccggattcactcgggcctcgaaccaggttatgaaacccagggcatgtcgcctcacgagaccctggcctggcagaactccctgcacacttaccccctgtggagcgccagccagcaactgcgctatcacccgcaaaacttcctcgaccccacgctgcgcgaggacaagagccagagcttcgagcaactggaaaacgagctcaaccagcatcgaatccagcccgacaccgtgcagaacgccgtacaaggctacctgtcacggttcgaagaggtcgccaacattcagacgctcaatggctacattgatggcaatgtcaaacagtgggataccagcacctattacttcgtcggcaaatccaccagcgatgagctctattactggcgttcgctggacctgtccaaacgctccaccgtcaagcccgagggacctgcgcccctggcctggacagactggacacccctcaacctgacgttttgcgccgatacgcccgcccacagtatccgccccgtgatgttcaatcatcggttgttcattgtttgggccgagagcatcaagcccgccccctaccaatctttcaaggcaccgggaaacggcaatggtgaccacgagaacgatgactacgacgaaaaacaacgccaggctgagtggctgaacggccggttcgtgaagtttcgcctgtgtttctcctataaaaaactggatggcacttggagccttccgcacacgggcctggaagagcactgcgttatgcgcagcatcaacgcactcacgtcggcgcaactaatcagcatcacgcagaccgttgccgtggtcgatagccgctcccctcacaccctgttcctgggtataacggccaatacgctcaatcatggcagcggccaaatgggcgagttcttccaagccatcagtgtcgatcagtcattagggataaaaatcgtcgcttgtgcgggcagccctggccgatacaagatcgtgccgggttcagaagttgcgcaggaaaccgtcaggttgctggaagcctatgagtccacaaaaaatacgccactgcagaccgctttgttgggcggcgtcgatcaggacaacgtattttccagcgtggtgctcccctcgttcgcccaccaatacttccgtctgtttttcgatataaacaaggacaacttacaattcaagactcacgtagcgcagggagaggacaaaagcacggtagtcctggaagctcacaccccccagttagaggatcaacagaagtggaactttgaatccaaaagcaccgatatagtcgctaccgatactgccaccacaaattttgatcccgtcaccaacgagttcgtctttacctcgaaaatcgctaagcccttcctgcagacttacagcatcacccttgcctcccattacgcccaggtgagcattaccctggtcaccaactctgcgttgcatgacccgactttatccgaagttgaactcatcagcagctcagtcctgaggatcgactgcgcgatattccccgaagtgaaggctacgtatcactcgatgtttttcaaaaaccccaggaccggaaaaagctattccaacgccatttatgacagaggctccatattgttcagcctcgacaaaatagagacggtaacgaggaaagacttgagaagagggtatgaaggtcaatcctataccgcctttgaattctccctggccgggaagcttctcaacaaaaatgcattcctgcacttatatacccattatcaggatcccttcctgacgatcctcgaccgctacagcggctataacctgcccggtgacgagaccgccaaccagaaactgcactttgtgaacgacgtgaggctagagtccacccacacttccgcgcccattttgcgtttctacaagcacgtcatcatgcagtccaaactcaccgacgtgccgactccgcaagccatcaacaacaacaccgcccaaatccttaactacacggacaccgaacacgaaagtctggcgggtgcctcgcccgaattagcagccgggcacctggcgagtacacggataacgttacccaatgagcaacccgcctcagccatcacggtgatccatggggtcatcacgcttgagagccaagagaataaggtgaaggttctcggctacgcgctcaaggcagtcaaatgctcccttgccacatccgttgccgttgacaagtctgcgcattccccgcgtatcacgcgccaacagcaaaaaaccggagagacaaccgagtacattgatttttccacaagcttcgccccggctatcccagcaatccggctcaataccaccgttgcgagtaaattgacccagactgccacgctcggcttcgacccatcacttttacgatcccccgaggactggacggaaccggcgctggacgcaggtgcctcccccgagcctctggattttcagggtgcccacggtaaaagtctgcgcgaactgtttatctatttaccctggaccatcgcccattacttcaaccagcaacagcaatacgcttacgccgaaacctggttgcactacctgcttgaccctcaccacccgaacaagggggctctcggcgcgctgccaagccaccccgtggagctgagctacgcctgccaacaccccgagagcccgcattaccgggcgctgagttttccgatatacctgcgcaaagcgttgtaccacctcaatgtggatattttgatcaaccggggcgacgcggcttatcgccaactgagccccgacagcctggcagaagccaaactctggtacatccaggcgcagaacctgctcggcatgcgtccgacggtcacgcgcgccgatacctggacgtcgcgtgatctgaacgcactggcgacgacatcctcccaggcaatacgccggttggaacatcaacccgaatacacctcgctattgtcccagcagtgcaaattcaccgggcaacacgcctggtttacagacagcccctatttataccggccgttgaatacgcaactggtagcacgctgggacacattggagagtcgcctgcacgggctacgccatcatctggatatttcgggcaagcctttacgccagacactttttgcgccccccttgtcacctgccgcgttgctgacgcgcaacgcacagggggctgcgagtggcgccagtgcctatctaccgagccgtcctgaagtgggtcactaccggttccaggtcatgctggggcacgccttgagtgcggtcgacagcctggcgcagttcggcaatacgctgctcacgctgatcgagcgcaaggaacaggcgcactaccttgaggtgcaacagcaaaacgcctggcagttggccgaactggtgctgacccagcagacccaggccctggccatcgatgaaaaaaacaaagacgcgctgcgccgcagccgaacaatcgtcgaggggcgattggaattcgtgacgcgtcagttgcgtgaaggtgtcagcaccggtgaaatttcggccggccagcactatctggagagcgccgcgtgggagagaaaagtcgcgattgccgggatgggcgccggggccgccatgctcgcgcccaatatcttcggtacgtcgttcggtggcatgcgttttgagggcgcgttccatgccttccaggccttcgcccagggcgaagccaacaccgctcgcgccaacggtaatgacctggagcgcactgaacagttaaatcgtcgcgctcaggagtgggcccatgccgagcaacaggcccgccttgaattggcccagatcgacaccctgctgctggtgcatgccgagcaggaaaaagccactcgcctgcaactacacagcgcccgcaccgcattggcccaagccaagtccgcctaccaaatgctcggcatgcgctttaccggagcacaactctatcaatggctcactgcacaactgagcaccttctattacgcgctgtatgacagcgtccactccctctgcttggccgctgaagcctgctggcagtatgagaccgccgacagccgacagttctttcaagctggggcctggcatcacacatcccgcggactgttaagtgccgaaagcttgaaactgaacctggtaaaaatgaacaccgcgtacctgcaacacacaccacgcgagctggaaatcagcaaaaccgtgtcactgcgccatcgcctgatcgagtgcctggtcacaaccgacaaacgcccagccgaaatcaccgctcccgccaaaacctgggctgagcataaggcgcaactggtaagcagcggtacgatcagtttcgccctgactcaagcgttgctggatgaggactaccctgggcacaccctgcgccggatcaagcacgtcagcgtctcactacctgccttgctgggaccttatgaagacatcaaggcgacactgacccagacacgaaatgaaatccagatgcccgacggcaccaccaggaccgacttcagggcacaccagcaaatcgccttgtcacgcgggctggacgacgacggcctgtttaccctcaacttcgacaacgatccacgttacctgccgtttgaatacaccggggcagtgtcgtgctggcgcttgaactttaccaatccgctgcaacaaaaagccctgcttgaatccatcaccgacatcattgtccatgtgcgctataccgcaaggcctggcaggagcgatacatgagcaacccagcgaatgaatcgcccctgaaggtgccttcgctgcccaatgccggcaccgtcatcgaaggggtcgccaaaggctggggcaacgtgagcaccgatggtacggcgaccttcgaggttgcgttgccgatttccactggccgtggttatgcacccacgctgtcattgacctatcaaagcacggcgggtaacagtgcgttcggctttggctgggacgtcaagcctggtgccgtcacacggcgcacccagcagggcgtcccccattacaccgcagccgatacgttccagggcccggatgcacagcactggatgcccgagcgcaccactgagggcacgcttgtacagacgcagcgtgaccattttgaccaggtgccgctgggtcgccgctacctcgtcacgcgctactttcccagggtcgaacggcgtttcgagcgcatcgagcattggcactcagacggcgacgccgccgggttctggctgatccaggcggctgacggcagccggcatgtgtacggcaaaacctacgcggcgcgcatcgctgatcccgacaacctgagccatgtggcgcaatggctgctagaggaaagcctgaacgcccatggcgagcatatcggctaccagtacctggccgagaccgctaccgataccggcactgccccccatgactgccgagcccagcgttatctgcataaagtgtgttatggcaacgtcaaggccagggaaaaagagacactgtatctgctcaaaagcgacgacctttccagtcaggcatggcatttttacttgctgttcgactatggccaacgcaccaccgccagcgacgcgctgccttcctatgaggccctcaccccgtggctctcacgcgaagatgcgttttccaacttcatctttggctttgaattacgaacactgcgcctatgccggcaaatcctgatgtttcacgtctttgcggatgagcccgacatggggcccagccctatactggtcaggcggctgaggctcgaacaccacacctttcgcaacgggctcaacactctgctcgcggtctacgagcaggccgttgatgcccaaggaacactcaccagcctgccgccgcaagaatacctgtatcaatcctcgggcctgaaactggatacccggcgctaccagcgtttcgttgacgtgccgagtctcaatgacggccagcgctatcaactggtggatctatacggcgaaggcgtgccggggatcctgtatcgcggtgatcaagcctggtattaccgcgcacctcagcgagccgaggcgtccacaggcgatcaagtggcatacgctgcccctcaagaactgcctgctattgcggtggcagaccgttcacgcccggtctatcaggccttgcttgatataaacggggacggacgtttggaatgggtgctggcccgaccgggtatgagcggcttcttcagcctggcccctcaacgcaaagaagcgggtttcgtacggttcgacgcgttcccggtggagttcttgcacccccatgcgatatttgccgacctgatgggcagcgggttggctgatctcacgctcgtgggcccgcgtagcgtgcgcctgtatgccaatcggcaaagcggtttcggacagggcgtcgagcaggcgcacagggttgacggcgacgacttgccgtccttcacccgttcttccgccgactgggtcggcttcagcgacatacttggcagcggccagcagcacttggtgcgtatccgtcacaacgaaatcaaatgctggcccaatctgggccatgggcggttcgccaagggtagagtgttggctgccctgcccttcagagaaacgaccttcaacgccgccaacgtattgctggccgacctggatggctgcggtgccagcgacctgctgtacctgacgaccgatgaagtacgcattttcaccaataagggcggcaatggctttgccacaacccccttggtattaccgtggccatccggcgtacagtacgactccctgtgccaggtgaacgtggcggacctgcaaggcaatggttacgccagcctggtcatcagcgtcacgcacccgcatccgcgccattggcgctacgatttttttgatcgcaagccctgtttgctcagcggcactaacaacaacctcggcgcgcaagtcgaggtgcgctatcgcagcagcgcccaggagtggctggacgagaaaaagcaatatcaaagtgaagacaagcctgccgttagccaactgccattcgcgctcaacctgattaaacaccaggaatggcgcgatgagatcagccatcagcggctgactcagcgtttcagctaccggcaggcgtattacgatgccgatgagcgcgccttccagggtttcggcttgttgctgcaaaccgacgaagaaacccgcaacagcgaagttcccgtagcaggttcgcaaaccaagcgctggtttcacaccggccaagcgctggacatgccccaggaccattacagccgccatgacgccgacgccaccaaactcggccccacattgctggcgatacacgatgcacccgaacagccgcaaccgacagaccatcacgacagcttgattgcgtcgcccacgccaccgcaagtacgggcggcagcctacgcgctcaggggcctgccggtacgggtggaggtgttcgaccttgactcggccaagcgcacacccagctcggtgcagcagtaccgctatctggtccgtcggttgccccaggctggctcagaccccacgccacgcatgctgccgctgacgctggagtcggtacactatcaatacgaacaggtgcccgatgatccggtctgcgaacaccaggtcaacctgcgctgggacgcctatggcagcctggtccacaacgtcactgtgcacggcgcgcggcgcaaggcagcccgcgatgcgcctccggcactgctcaaggatgagcatcagcaacaatggtggcgtgatacccacgacccggctcagcaggtcttttacctgagcgaaaccttggcgcaatggattcatctatcaaacgacgaccaatggcgattgggtttgccctatcgtcgacgcgacaacgcctggaccctgcccaacggccagccacctgccgggttgaacacgacggcgatcaactacgagacgttgatcaaccggctgtcaggaccgctggggccgcgagcaccacgcgagctgagcggcttgtcgatccagtactatcgtgaaccgggcggcaaggggctgaccctggcccctggaactgcaaccttccaggggctggctgattatcaagaaaccgcggagctggcccctgaagcgctgcaggcgctggagaacattcccgacatgccgggccaacccgccgaagaccttccgagccgactgcgccgaatcggctatcgccccatggcggtgtttttccatgccaatgatcaggaacgccaagcgccttccctctggtcgatccgccgtcagtttccacgctacttcaacgccaagcacttctatcgcttacgcacctggcgcctgacgctggccgagaacgaaaccacgctgacctatgacgcttacgggcttcaggtcatccaggtgaaacaacccgacggctgcatcacccgcgtccagcatgactaccgtctgctgcagccgatcagtatcaccgatcccaacggcacgaccgagcaagccctctacgatgggttcggtcgcttgatcgcgaccagcatccatgggcaagaatcgggaaagtccatcggtttcgggcaattgtcagcgtatcgcaggccgctagacacacctatcgaactcgcaattcaaacacccgcaaccctactgcgcgaagcggccaaagcctggctctacgacgcgttcagttggatgggctcgatcgccaccgcagacaggcaggcggactgggtcactcagcgctacctcttgcccgacgggcacatacgcgccaccgccaggttgcgcttgaaaaaaaaggccagcacgttgagcgcgagtgagaaagccttggctgacctgatccaaaagatcaggcgcgaacccgcacgaagcctgatgttggccgctgatcgctataccgacgatcaggaacagctcatccacatgaccctggtcgcccaggacggctttggccgcatcttgcaaagtaaacagaaagccgagccggggccggcctatgccgtggacgacaagggtgacctgagggtcgaaaacggcgccctccagacggttcaggctgacccacgctggtgcgtctacgagcacaccgaatacagccccagggggctgattattcgggtgtatcgcacctattacgccgagcaccataggcacatcgacggtaaccccctgctgcacagcgacacacagtttcatgacgccctggggcggcccgtgcgtactctcacggcccgagggggaatgcgacaaaccacctactgggcctggtacaccgtcagcgaggatgaaaacgatacctgggagccgcctccggcagggcaaacctctaaaccttaaccatgtaaccaccgtggccgatgccgctgagtcaccgccacggtgattcgttcaatcagcgtaccgcccgccttgaagccctggaactggcgggtttatagctgcgccacgcggacgagttggactcccaaggcgcatcgacccgctgttggtgccgatagaacgtcacgcggcctgccagttgctgtcgatgccgataaagccagcgcagttccgaacctgtggcagaagactgggacttatcgattacccgattcaggtccagatcatcaagagcaaaatgcacatggcgcatgctttcaggagccgtcagggtcttcaaggccgacttactgatgcggctgaccagcttatgctggaagtcaatcaagtccacgtctatgtagtcttcaagggtgcgctcgaatgaatagtcgccagaagcaagatcactgacaaatttcttcgcgaactcccggttggcggtggtcgatgtacagcccgaatacttcgccacaacagcgccatagaactgctgtgcgacctgtacgccttgctcactgatcgtttgcctgtacctggcctcgctcatcctgccgagcccgtaccgaacgtgcgcactgacgctttctgccagcgccgctgttgccggccctatttcatcaattccgacataggcggccatgatgtccccacgtgctgtcagcttcgaccagaagctacgatagctacgcacagtattcgccaagccgaaaaggatatcgcctcgacttggttggaattgctcgccgaacaacgtttgcccaccatcgacatccctgaaccgcaagggattgcccagcgccatcgcatacagattcaagccgtccacgtcacccagtgggtccggactgatccagcgttgcagccacggcgcgtaataccgatatccgtagtaatacaaccctgtcgcgtcgcgctccttgcccgcgtagcggcgaaccttatagttggctcgctgcgtatcgttggtagcccaccacgccgtcatgccatacggatagtagtgctcctggctcagcaactgcgcgtgctcgtccagctccagtaaactgctgctgaggtgatcgaggatgctgaattgcaactgctcggcgctcatatcactggggcgaccgtgctcccattgcaacaccgtgacacgaccgccgcccgtatcaatctccagcacgttcaaacgcttgccaggttgtacatgcaggtgcaaacccggcaagtagcacgtcagttgcgtatggggtttacccgcgacccgttggcttctgatcttggcagcccgctggccctggccgtcgtagaggtaattttccacatcaggatcaccctgttcacgccgcacctgggtggcatgggtgagttgattacgcacgttccagcctaaccgttggccgccgcccagcgattgctggttaccgttggcatcaaacatcgtcgcccagtgttgcgccgcaccgtcagtgaccgacaaggcgcgattgctgcccaccgctacactcatgtcccgggtataccctgcgccactgctcgccacatggcgtaggcgtgtcaggttgccatgctcgtcgtaggtataatgctgggtgtaattgcgccagagtccgtcgccggttgcaccaaacgccacccgccccggggctgcctgaccaccgctgccaacagcattttcccgaccgctggcctgggttaactggtaaagactgtcgtactggtaacgactgaccgcatcaatgcgcgcattgctgtgccattgagtcggctgggcctggtcgctgaggctgaggatattaccgaccgggtcgtactcgtacacaaggtcctgtaaaggctggatagcctcgcccttgcgatacaccgtcaactgcagcaaacgattatcctcagcggcgtatttcgccactttggtgacttcattgcctagccgttcggactccaccaagccgctggcgttgtacacgcgctggttcatcaacacttggcgtgtgccctcacgcagggtcagcgcaacctcctgcagccaaccttgccgcccatagcgccagtgccggcgattgcccctggcgtcgatctgctccagcagcgcccccaaggcatcgtagcgccaggtcgtggtatgggctttggtttccagctgttcagcttgattgtcatcgctcgatggccagtcaactgccgaagtgtccatgcgaaaccgtcgagtctgcttgatgacgttcccaccgatcccgtactcatccatcaacacaacaccggccgggtccgcgtgacgaatcagccgtccacaacggttgccggccacctcggctgccccataggccaggcgctctacacaacgcggccgtggctcattcgcagtctgttcaaatactgccaccgggcgtagcagacggtcgtagcgttgctcctgatgggcttgacgcgaatcccaggtgtgcaacggctggcccgcttcgccgcgtaatatcaggcgccagccggcatcggcgctctcggtgcgaaccgtctcgcccgacagactgaaaatgttcgattgcgatgccacaccgccagatccccgcgcacattgccgcgggtcccactgactggacaaaaaaccactggccccaaaaacctgtcgggtaacccgtgcctgcggagcctgggtcacgctctggcggtgatattcaacggtacgtacagccagtccgcgaggatccgtggccttcaaggtaggtgtatttcgatgcaaagaattagacatgaactcatgacctgactagctaaggtcaaaaaaactctagggagctgctctgtgcagtgggggtattacgaggatgttttatgtgtctaattacaaggactgaataccattgggactgctacgcagcccaacgagagcaagcgttatcgccacagatactgggctgcggcggtttaaatacctatgcccggccccgtcaacctgcgtgatagcgttttttcattgcccgccgaacccatcggcgggagtgaaggaacgtatgaatatgcaagccgacagcagctccttgctcgctcaactgattgaccacacacacccttgcacccccgccgcagccagttggggtcaggcatgagcgacgacactctcaaactgcaggtcaataccccgacactgcccaaaggcggtgctgccatccaaggcaccggcaagggctggggcgatatcggctccagtggtacagcaagctttgaaattcccttgccgatctctcccgcgcgcggctatgcgccggccatgtcgctgacctaccacagcggcgccggtaacggccccttcggcctgggctgggggctgcccctgggcgccgtcagccggcgtacctcccatggcgtgcctgactacacgatgcacgatgtgttggtgggccccgacgcgcaaatctggctacctgaacgtgacgccaacggcgtgatcagcagcagccgccttgcttcattcaatggcttgccactgtccatcgcgtatacggtcacccgccacttccccagggtcgagacccgcttcgaccgtatcgaacactggcaatcggcaaccgacaccgctggcttctggctgatacacagtgccgatggcagtcagcacttttacggaaaaacccccttggcccgaattgccgatccggaccacgcgcaccacgtggcgcagtggttgttgcaggaaagcctgaatgcccacggtgagcacatttattatcactacacaaaagaaaccgataacacgcgctaccccagggattgtcgagcccggcattacctggaaagtgtctgctacggcaacttcaccgcccgtgagcacgagcagctttacctctggcagaccgacgataaaccggacgtgggctggcactttcaattgctctttgattatggtgaacgcgcccttgaactggatcggcggccgacgtaccagaaaatccgggactggccggaacgacccgacccctgctcggattttgccttcggcttcgagttacgcaccctgcgccggtgcagccagatcctgatgtttcaccacttccccaaagaagcgcgaatgggtgccgatccggtactggccaagcgcttgctgctggaataccacgcacccagccatgtcagcctgttgagcggggtccatgagcaggccttcgacagcgcgggcaatagcgtgagccgcccgccgctggagtgtttttatcaatcgagccatctcaaggtcgacccgggccgctaccaggcattcaatgcattgcccaagctgcatgacggtgatcgttatcaactggtagatctgtacggcgacggcctgcccggtatgttgtatcgcgcagacaacagttggtattaccgtgaaccgctgaggccgcaacacccgcaaaccagcgacgaggtgagctacggtgcggcgcgggagttgacgcgggtgccggtcgccgacagcacgcggcccatccaccaggcgctggccgatgtggatggcgacgggcgtttggactggctggtggccgggaccgggctcaacggttttttcagccaggacgaacagcacaattggtcagtctatacgccgttcgatgcattcccgtcggagttcttccacccccagggcatgctcgctgacttgatgggggcaggccgtcatgactttgcgatgatcggcccgcgtagcgtacgcctgtatgaaaatcgccgaacatccggcttcgcacccgccactgaggtaccacatacgcccgacgaaggcttaccgaccatttcctcctcacccaacgaactggtggcattcagcgatgtacttgccacgggccaacagcatctggtgcgtatccggcataacgaagtgaaatgttggccgaacctgggtcggggtcgtttcgcccggggttttgtattggctacattgccgtttcgttatcaaacgttcaatgcggcgcatgtactgctcgtcgacctcaatggcggcggcgcggcagacctgctgtatttgagcgccactcacttgagtattttcctcaacaaaggcggcaacggctttgagacacaggcgatccacgtcccttggccagagggcgtgcagtatgacaaccactgccaggtcagcgttatcgatgtgctcggcctgggctgtccaagcctgatcctgaccgcagcccaccagacccccagccactggcgctatgactttttcagccagaagccctggctgctcacgcgcacctacaacaatatgggcgcccaggcgtcgatcaaatatcgcagcagtgcccaagagtggctggacgagaaacgcgagctgcatgccaagggccaacctgcgatcagccagttaccctttgcgctgctgctggtcagccaacaaacccaacgagacgagattaccggcaaccaactgacccaacactggcgctatcgccaggcttattacgaccgcacggaccgcgaatttggtggtttcgggcttgtgctgcaaaccgacaccgagagcagcaaagacacgcaacacacccagggtttcagcgcccccgtgcgcaccaaaacctggtttcataccgggcaatccatcgacatgcccaccctcggccatagcactcacgacccccaggccaaagccatgggccccacgctggtcagccgctacaaagcgacgtccggggcacagccgctggatcaccacgacgacttgatcagcgatcctgcgccaccgttggcacgcgaagttgcacgtgcactcagcggcagtgtgctacgggtggaggtggcagcggcggagccggcgcacgacaccctaccctattgcgtcaagcaacagcgttatctgatccgcgaactggcgccgaacaatgcccatacgccctatgcccggctactgccattagccctggagtcgatcagctatcagtatgaaggggtggaagacgatcccgtgtgccagcaccagatcaacctgcgctgggacgcctatggctgcctggtgcatggtgtcaccctgcattacgcccgccgtaccagcgcctacggctcaccacccgccgtgctggtcgatgagtatcacaagcgttggtggcgcgatacccatgacagcgcacagcagttctattacctgagcgaaacgctggcacagcacattcatctggacgacgcacaaaactggcgtctggccttgccgtaccgccaacgaaacaatgccctggtgctgcgcaaagcgccagcggccggtgggttagagcttgggcgtatcacctatgaaaagttcatcgacaaccacgacgggccattggccgcaggtgccaaacgcgaactgaatagcttgtcggtgcagcgctatcgacaagccggtggcctcggtaaaaccctggagcccggagtcgccaatgcccaggccttgactgactacttggaaaccgcagagctggatgacaagggcctgaatgtctacaagcacataccggcgatgcctgaccaacctgcggttgatctggtaaaaaagctcagcgacagcggctatcactccatggagctgttttttctattcgacggcgaggtgccgcccgaggaaaatcgtctatggtcgattcgccggcactttccgcgctatggcaaggctacccagttttatcggttaagggcgctgcggaccaccaaggcccatggcgaaacaacactcaactatgacccctatacgctgcaaaccgtgcgtgtaaagacgccggacggttgtgtgaccaaagccgaatacgactatcgcctgctgctgccgacaaaaattgtcgaccccaatggcaatattcaagaagcgctgtatgacggttttgggcaaatgctcgtcaacacttttcgcggccacgaacataacctcacagtgggtttcgccgcgttggagagctaccgcccgctcaaggatgtaacgcccgcgtttgccatagaaaacgcgcaaagcgtgttgcagagcatggccagcctacactgctacgccccgttcagttggatgggcacggtcgacttggccatggtcaagccggagtgggtcgccaaagcctatctgctccccagcgggcatatccgcgcgggtgcgagggcacgtctgagtgcacgagcgcgccagggtagcggtcgccaggggctcagcgacagcgacaaacaactccaggcgttgatcgacaaagccagccggaccccggtgcatgggctcatgttgcaagccgaccgctacccggacgatgccgcccaacagatccgcatgaccttgacctgttgggatggctttggtcgtaccttgcagaccaagcaaaagactgagccaggcctggccaatgcgctcgacgaccagggcaacctgctggtcgacaacatacccgatacggtacccggcactttcaagaaacagctgcgccaagtgcatgccgacccccgctggcgcgtcagcgagcgtgttgaatacaacaacaagggcctggtcattcgcatctaccgcccctacttcgctgacaagcacgcctacgtcaatgatcattccatgcgtgagctgggccacagcgaccgacagttctacgaccctctcggccgcccgacgaagacattgaccgcagcaggattgatgcggcgtaccacctattgggcctggtacaccgtcaatgaggatgaaaacgatacctacgaaaagctgcaagctacccctccaaagcactgacagacgaacgataagtgcccggctgaccggatcgtcaaagcgcgtgcgctttccagtttttgttcgctcccacgcagagtgggaacggtcaacgcaggcttgaatccgtggcaacccgacaggacggcggcccattccccccctacctggagcgtgggcttgggcgccagctcgtcgccaaggtcgaatatccgcccctggcgaactgtacgaacaagctgcgccattcggtcagcgcggcaatcatgccgcgggccgccatcacaaggttgcgtgtcattcggccttgggcggccatgggcaagcccgtcagcgcaacggccaatgcctcgacaccggacgcggcccagtgcgtccacacctgattgaacattctgctcagcccaccgtgcatcgtcgcggcagggtctggcagctgcagggtctggccatggggatcgtggacagccgttgggtgaccgccacgaatcatcgttcccgccgctgcatcgtaggcttctattgcaggtgaaacattgggtagcatcagcgcaggcacttccccgccgtataccgcgttggccacggtagcaagggcataggccgccgtcgccccggcggtgcgcgtcaacctgccgcgcaggggcgtgctgccccaggagacgccagtaccgtgcccacggaggacctgctgcgcgagttccctggagagcgcgcgcacatgcccgcccaaccgctggaccgctaccgggtcccagctgtgctcggcttgatcacctatcgagtcgccataaacggcatatcccatgcccgcggcacctgcaagaacagcacctacatggggtgcatattgcgtccagttaccgacaataccagtgctcatatgtgccgtggacactgcatccagtgccgcaacggtcatgcgcaagatttgattgcgttgcgccgtcggctggatgttgctgaacaccgccagatcgacacccgtccagaaggtattggaaatataggcggataaaccatcgcgaatcgcagccgatgaagccgcttgtatcctgggtcgcaaaatgagctgcatatgcgcgagcctgcgactgatggaaagcctgcgtagttgagtctgccgaggttgttccaaagccggtgtcgccgtcagcccctgctcatcgatcttgctgacggggttgccgccgaccatggcgtacaaattcaaaccgtcagcatcgccggtcggggccgggctgatccagcgatacaaccacggcgcgtaatacctgaagccgtagtaggacagcccactggcatcgcgctccttgcccgaataacggatgaatttatagctcgcctcgctggcgcttttcgccgcccaccacgcggtaccgccgtagggataatagctttcctggctaagcagttgcgcctgctcgcccagctccatagtgctgctgcccaagtggtccgataagccgtaacggatctgcgcgtcctggcggacgcccgaggggtggcgatcccaaatcaggacgcggacggtggtagtaccgacatcgaggttgagtacattcagttgctcacccgttgcgctgtcatggcgaacttccagttccggcaagtagcgcacctcggccgtatgcaccacgccccgggcctgggagacccggcgtttgaggatgcgccgaccggtggcatcgtaggcgtagcgttcttcatcgtcattgccgccctcgcgccgcagctgcgtgaggcgcaccagttgattgcgcacatcccaagccatcttttgatcgccgcccagcgtttgcagattgccgttgtcgtcaaaaccctgccccaacccgggcgcggtcttgccatcggcctgcggcagaaaatgattgctgcctgcggccacgctcatctgccgcgtgaagcccgtgccgctgctgggcacatgctgcaactcaagcaaattgccggcaacgtcatagctgaaccgctgggtgtagcgacgccatacgctgtcgtctgtcgagccaaacgccaccctcgccggtaacgcaggaccggcggtattgccggcggtttcgcggccggtggccttggtcagttgcgataacgtgtcgtactcataaaggctggccgaactgattcgggtgttgctcgaccattgcgtcggctgggcaaggtcatcgatgcgcacgatgttgccaacgccgtcatagtcgtagctcaggtcttgcaacgctgcgcccggttgtacggtcagacgggcggtcatttgccgcaagcgaccatcgaactcgcggtattgcatggtgcgcacaacaccgttgccggcgcgttcactgagcacctggccggctgcgttatattcgcgctggctcaacacctgcgtagacgcgccgcccatgggggtgacgaagatactcgccggtaggccgtcaacggcataggcgtagtcgacgcgattacccttggcgtccgtgtgatgcaagcgttcacccagcgcgttaaacccaatggaggtctggaacctctcgggctccaggcgcacctcgcgttgtgcatcggcttggggccaatccaacgcagcatccgcctgccggaagcgtcgggtctgctgctcaacctgcgcgtgcagcccatagaattcgtggaacaccgagccgccaccgtcatcgtggcgaaccacttggccacagcggttgcgtgcagcctcttcagccgagggtaaagcataggcaatacgctcgacgcacagcgcttgctcgtcattggccgcctgctcgaagacggcgaccgggcgtagatattgatcgtagtgatgagtctggtgagcgccacgcccatcccactcttccagtaaattcccggcttcgcccatcagtgtcagtcgccagccggcgtccacgctgtcggtgcgcaacacttgtccgccaaggctatagaccgtgcgttgattagccggggtgtcaggctgagagcgtgacaactgcgacagacgtgggtcccattgttcaatcatcatgcccgtactgccaaacacctgacgatgaatgcgcgcctgcggttcaacctctgcgcttgagcggtggtaatcgatgttacgaacagttaacccacgcgggtcgaatgcagccagggacggcgtgtttcgatggatggaagcagacatgacctcaagaccttagtgctggatatgtaatcctgaaagcctagggatgaggtgtggagaaaggtggtgctggaggatgttttgtgtatccaggtactggcatcgccccgacccgctcgcgcgggtcggggctgcgctcaatgcccgccggcgcaggtcggcgaggccggggctgcgtcgattttcgcccattcatcaggcgtataggtatgcagcgccaacgcatgaaactcgctcatcaggtcacccagggtggcgtagaccttctggtggcgcttgacgcggttgagcccctcgaactgcgagctgaccagcacggccttgaagtgggtctgcaacccacgactatgcatatggctctcatccagcacgtccaagtgttgcggctccagggcggcgagcgccgtttcgatacgctgttgcatggtcattcctgcttacttcttcttggccggtgcggcggcttttggcgtcagctcgttggtcatgtcttccaacagcttgttcaccactggcaccgcgctttccagcttggcctgggtcatctgggccgattgctgggtcagttgtggcattttttccaggactttcttgcccagtggcgactggtagaaagctaccaggtccttgagttccgattcgctgaaattggtggtgtagagcttgaccatgtccggtttaagcttaggccagccgatagcctggtccagggcagcgttggccttggcctggtagctgtccagtacagactgcttggcggcaggcgccttggtctgttcgaagcgctgggcgaacatttgctgcacttgcatgtacaccggggtccccagcttgtcagcatgggccagggtaaggaaggcttcggcactggcgttgtggctggcggtatcggcaaaaacctggccgctggcgcaaaccagagcaaccgcggtacagatggcacgaagacgagtcatcgagtttccttttctagcaggcgaggtaagaccccaagggcgcccattctgcgcctaaaaaacctcgcggctcaaccccaccccacgcaggccctggttttgcggggcgcaatggcacaaataccgatttagggaacccacggcagccgtcagggcctaaactgaccaatcacgactggataaggagggtgcccgatgagccgtatcgaaaccgacagcctgggagaagtacaggtccctgatgatgcgtattggggcgcgcaaacccaacgttcgctggtcaacttcgcgattggcgagcaacgtatgccgctggcggtattgcatgccctggccctgatcaagaaggccgccgcccgggtcaatgaccgcaacggcgacctgcccgccgatatcgcccggctgatcgaacaggccgccgacgagatcctcgagggtcaacatgacgaccagttccctctggtagtctggcagaccggcagtggcacccagagcaacatgaacgccaatgaagtgatcgccggtcgcgccaacgaactggcaggcaataaccgcggcggcaagagcccggtgcatcccaatgaccacgtcaaccgctcccagagctccaacgactgcttccctactgccatgagcattgctgcagtgcaggcggtgcatcagcagttgctgccggcgattgcgaccttgtccggtggcctggcggagctggctgcacggcatatgaagctggtcaagaccgggcgcacccacatgatggacgccacgccgatcaccttcggccaggaactctcggcgtttatcgcccagctcgattacgcagagcgggcgatccgcagtgccctgcccgccgtgtgcgagctggcccaaggcggcacagcggtgggcaccgggctcaatgcaccccacggctttggcgaggcgattgcttccgagctggcagcgttgtcgggcctgcccttcgtgaccgcgccgaacaaattcgccgccctctccggccatgagccattggtgaccttgcacggcgcgttgaaaaccctggccgtagcgctgatgaaaatcgccaatgacctgcgcctgctaggttcaggcccacgggccggcctggccgaagtcaagctaccggccaacgaaccgggcagttcgatcatgccgggcaaggtcaaccccacccagtgcgaagcgctgtcgatgctggcctgccaggtgctgggcaacgacgtgaccatcagcatggccgccagccaagggcacttacagttgaatgtgtacaagccggtgatcatccataacctgctcgaatcgatccgcctgctggccgacggctgcaacaacttccaggagcactgcatcgccggtcttgagcccgacgccgagaaaatggccgaacacctggagcgcgggctgatgctggtcaccgcactcaacccgcatatcggctacgacaaatcggcagagatcgccaagaaagcctacgccgaagggctgacactgcgcgaagccgcgctggagctgggctacctcaccgacgccgagttcgaccagtgggtacgtccggaaaacatgctcggtagctaaaccgccatgcgcagccgccgggccttgagcccggcgagcagcgacggcgccagggcgactgcagctgaccccaagaccaccacgaatgcgccgaagtagcccagggcgttgatctcttcggcctggacataatccggccacagccacgccgccagcgccaccgcgacaaaggtcaccagcggcgtcaacgccagggtcgcactcacccgcgacgcctcccagtgggccagcgcttcggcaaacgcgccatacgccaccagcgtattcatgcagcacgccagcaacagccagccttgcagggggctcaactgcaacgcctccaggggatgcgcccacggcgtgagcagcaacgcgcagaacaggtagatcaccatcatcacctgcaaggaattccataccgtcaacaattgcttctggcccaaggcatagaacacccagatcgaggtggccagcaggatggtcagcaccccggcggtataagtgcccagggacgtcagcaactccacgaggcgctgattgaaaaacaggccgaagccgataatcagcaccaccaggccgaggacctgccccaggctgaaacgctccttgaagacaaacacgctggcgatcatcaggaagatcgggcccatctgcaccaccaattgggcggtgccggggctgagcatcttcaggccaaccagatacagcacgtagttacccaccagcccgcacacggccatggccaccagccaaccgcccttggggccgagcaccttgcggctgggcaggcgcttggtggcggcgaggtacacgaacaagcaagtgccggccactgtgagacgaaaccaggtgacggtgatcgggtccatgacctgcaggacctgcttgagcttgatcggaagaatgccccacagaaaggcggtcagcagagtcagcaagaaaccgtagacccagcggccggaagagatgtgcatgagtgccccaaaaaaagccagaggtggaggagccgccattctaggggtaagtgaccagattcggatacgcggatggccaaatgtgggaggggggcttgctccctatagcggtgggtcagccaacatcaatgtttgctgggccgacgtcttcgcgggcaagccccctcccacatttgatcttcgccgctttgagcatttcgttcgcttaactgactggcattagggcttgcccccgatagccatggttatctatacaactctgacgtagcgaccctcagtaaccacgatgcgaagcgagccgctcttgatcttgatcttgatctgcttttgatcttaggcgccccgttaaaccacgctggccggaattcgacagggatttggggggtaaaccggcagggatgccggtttagccgccccgcgccatggatggcgcgtggcggcggccccccaaatccatggcggattacgggcacaccgagcctgggcgaggtgccgagtggtggggcgaggaccttttgctcacttttgggtccttccaaaagtgagccgctgtaagagcggaaccctaagtggccgttaccgcaggaatggatatgtactcgatctaatccaacatgctggccggctgtcaggtcgccatcgggggcaagccccctcccacattttgatcagcttacggcttcgaagagcccggtagcgcccatgccgccgcccacgcacatggtgacaatgccgtagcgcaaattacggcgttgcagctcccgcaccaaatgccccacctgccgcgacccggtcatgccgaacgggtggccgatggagatcgagccgccattgacgttgtacctggcgttatcgatctccaggcggttgcgtgcatagaggcactgtgaagcaaaggcttcattgagctcccacaggtcgatatccgccacctgcaagcccttggccttgagcagcttgggcaccgagaacaccgggccgatgcccatttcgtccggctcgcagccggcgacggtaaagccacggaaaaatgccttgggcttgagccccaatgccagggctttttccaggctcatcaccagggtcattgaagccccatcggagagctgcgaggaattgcccgccgtcaccgagccatcttcggcaaataccggtttcaaaccactgagactggccagtgtggtgtccgggcggttgcagtcgtcgcggtccaccacgccatcgaggatctgcacttcaccgctgtgcttgtcctcgaccttatacttgaccgccatcggcacgatttcatcattgaacaagccatcagcctgggcctgggcagtgcgctgctggctctgaagggcgtagatgtcctgctcctggcgggtgacctgatagcggcgggcgacgatttcggcggtctgccccatgggaaaatagatgcccggcacctgctctttgagcagtgggttgatcaggttgtcggtgttgacgcttttcatggtcaggctgatggactccacaccaccggcgacaatgatgtcgctgcagcccgaagcaatctgattggcggcgatggcaatcgcctgcaagcccgacgaacagaaacggttgagggtcatgcccgccgtgccggtacccagttgcgagagcaccgccacattacgcccgatgttatagccctgggcgccttcgttggagccggcgccgacgatgcaatcctccacggtggccggatcgatgccattgcgggccagcagcgcgttgacgcaatgggccgccatgtcatcggggcgggtctggttgaacttgccacgaaaggacttggccaggccggttcgcacgctgtcgacgatcactacttcacgcatgggcttacctcgatcttgtggttgtggatcgaggatagagccaggcccggccggctgcgatgatcattcactgcataaatgcaaaagcatggggccaacacacggtctacctgatgtgtggcgatccaatgtgggaggaggcttgccccctcccacatttggaccattgttcgatccgcgctatttctttttctttttgtcgtgcttgtcggttttatcgaatgcgtcttccaacgcacgattgatggtgcgcagcaccttgacccgcgcccagcgcttgtcattggcttccaccagggtccagggcgccacctcggtgctggtgcgatcaaccatgtcgcccacggctgcacggtagtcgtcccatttgtcgcgattgcgccagtcgtcctcggtgatcttgaagcgcttgaacgggatctcttcacgggcctggaaacgttccagctgcgtttgcttatcaatggccagccagaacttgaccacgatcacgccagcatcgcgcaactgctcctcgaaatcattgatttcgccataggcgcgcatccagtccgtcggggtgcagaagccctcgacgcgttccaccagcacacggccataccaggaacggtcgaacacggtgaacatgccgcgtgccgggatcttctgccagaaccgccacaggtagggttgcgcgcgttcgtcttcgctgggcgcggcaatcggcacgatatggtactggcgcgggtccagggcggcggccacacgacggatcgcgccgcccttgcccgccgcgtcgttgccctcgaacaccgtgaccaacgcgtgcttgcgcatgcgcttgtcgcgcatcaggccggagaagcgcgcctgttcggtgatcagttgctcttcatagtcgtccttgtccaggcgcagggtcatgtcgaggctgttgagcaggcttacctggtctacggccgacggcagcggcgccgggttcatgccgctggccttgcccttgggcattttcaaggcattttgcaggccttcgagcaggatcttgcccacggtaaggctgcggtaattgctgtccaccccttcgatcacatgccacggcgcgtaatcccggctggtacggcgcagcacgcgctcaccgaaatgcacgaacttgtcgtaggtcttggactgctgccagtccagcgggctgatgcgccagctgtgcaacgggtcgtcggccagggccttgaggcgtgccttcatctgcttcttggacagatggaaccagaacttgaaaatcagcgcgccttcgtcacagagcattttttccaggcgctcggcaccggcaatggcctggtcgagccgggcgtccttgatctgcccatgcacccggccttgcagcatctggctgtaccaattgccgaaaaagatacccatgcggcccttggccggcagctgccgccagtagcgccaggccggtgggcgcgccagttcctcgtcggtctgctggtcgaaggtacgcacttcgatcaggcgcgggtccatccactcattgagcagcttgacggtctcgcccttgccggcgccctcgatgccgttgatcaggataatcaccgggaagcgtttctgctgctgcagttcgtactgcacctccagcaaggcttcgcgcagggccggcacttcggcgtcataggtgtctttgtcgatggcgtgaccgatttcggcggattcgaacatgggcagctccgtttcaagatggctcaagactagcggattgggcaacgacctggggcaggaaattccacccgcgcttgtcttgggtcaattcaacccctgttgatcggctagaatggccgccttgtctttgcccgctttcctttatgagccgccatgaaccccatcacccacgcccagctcgactgggatgaccaaggccgcccgcactcgcgggtgttcgacgatgtgtacttctccgaccagtcgggccttgaagaaacccgttatgtgttccttgagcaaaaccgcctgcaggagcgcttcgccgccttgcctgcgggagggcgactggtgattggcgagaccggcttcggcaccggcttgaatttcctctgcgcctggcaactgttcgagcagcacgccgcagccggtgcgcagctgcattttgtcagcgtggaaaaatacccgctcagccaccctgacctgcaacgtgccctggccctctggcctgaactgcaacccttggccgaacaactcttggcgcaatacatcgccatccatcagggcttccagcgcctggtgctgggccacggtcgcgtgaccctgaccctgttgatcggcgatgccctggagcaactgccgcaactggatgcacagatcgatgcgtggttcctcgacggctttgccccggcgaaaaaccccgatatgtggaccgccgagctgttcgccgaactggcgcgcctggcggcgccgggctcgaccatcagcaccttcaccagtaccggctgggtgcgacggctgatcaacgcggcgggcttcaagatgaagcgcacgccgggcatcggccacaagtgggaaatcctgcgcggtgagttcgtcggctggccagccgatattcccaggtccacggctacaccaccgtggttcgcccgcccaacaacccactacgcagaacgccgcgccctggtgatcggtgcggggctggccggttgtgccaccgcggccagcctggcggcacggggctggcaggtgtgcctgctggagcggcatgcggcgctggcccaggaggcgtccggcaacccgcaaggggtgctgtacctcaagctgtcggcccatggcaccacactgtcgcagttgattgtcagcggcttcggttatacccgcaggctgctcgaacaactgcagcgtggcgtggattgggacgcttgcggcgtgctgcaactggcgttcaaccccaaggaggccgagcgccaggcacaactggcgcaggcctttgccacggacctgttgcacccggtcgatgcggcccaggcccaagccctcgctggggtggcgctggaccagggcgggttgtttttccccgagggcggctgggtccatccgccagcgttgtgcgagtggcaggcccgccatccaggcattgaggtgcgccttcatcaggaggcgctgaatttgcagcaggtcgacggccaatggcaggcccgtgacgccgaggcgttgatcgccagtgcaccggtggtgatcctcgccggggccgccgaggtcaagcgcttccccttcagtgccgccctgcccctcaagcggattcgcgggcaaatcacccgcttgccgcaaaccactgaaagccaacgcttgagcacggtggtctgcgcccagggctacgtcgcccccgcacgcctgggcgaacataccctgggggccagttttgcgttcaacagcgacgacttgacgcccaccctggccgaacatgtcgataacctgaacctgctacgggaaatttcccagcccctgctgcaagccctgcatgctgacagcgcaccactggaaagcctgcaggggcgtgcggcatttcgctgcaccagccccgattacctgcccatcgtcggcccgctggccgatgcagcggccttcgcccaagcctacggggtactcgcccgggatgcccggcaagtgcccgatacgccctgcccttggctggacggcgtgtacatcaacagcggccatggctcacgcggcctgatcaccgcgcccttgtcggcagaactgttggcggcctggctggataatgaaccgctgccgttgcccgccagcgtggctcaagcgtgccatcccaaccgcttcgccttgcgtgaattgattcgcggcaagccccggcagaccccatgaaccctgcctagcgaatctcgcacacccccagttcgtcagcgcgcatggccgccagggtcaggcgctcgaaggccacctgttcggcggtggcctgctcctgcagaatgccgttcatgcgcgacctgaagacctcgtcctcaaggtcatcgccttgttcgaacacctcttgcatccgcgcttcgaacggctcgttaagggttctgaaactggcggcataggcgcgcttgaggtaatccgtccagaacggcaggtcattgagaaaacgcaacagctcgggtgaaacctctgcggccttgattttgatttccgcatcgctcagcgccgccggggtgacaccgctcaagccggcataacgcatgtgcctaggctgccctggcagatagaaacggctggccaggccggtgcggtaggccaggctgacttccaacggatcgccgccggggttggcgatgctgtgattgcgcgcaatgctttccaggcgatcaagccgatacaggccgcgccccaacgccaacaacggcctggcagacaactggccgccctcgacctgccggcgcgcatcgctgatctcaaccaggatttccagggcgctgaagctcaccgccgcgccgtcatcgcagttgtatggggtagcggcccggtcgaacacttcagtagccagttcatcgcgctggctggtcgcctcgagtacacgccatacgcgccgggacatgtcttcacgcacatgctcgctgtcagccgcgccgcccagctcggccagcaacttgaacaagccgtcactggacctgtcatccttcaacatccgccatatcacctcttttggcgcgtagtcggccagccgcaaatccggcatccacaactcgcgagcggcctgctcgttcaaacgcgcaatatcgtcttcgtaaaagcccatgcccacgccgcgctggcgacggtaatcgagcacttgccggctggtggaggccgacaaggggttgtggcgcaagttgataccttgggtgcgttgtcgaggcgccgtgaacaaccaagccggcagctcggtaatgtcgttctcgcgcaggtccacactggtcaggtagggcaagcgccacaagtgttcgggaaagctcttgagccggcagtcacgcaagatcagttggtgcaggtcgaacaggtgatcgaccctgggcgggtcaatcagcgggttgcccgccaggttcatgatcctcaggttgcgcaggtctgccagcttggtgcgcgtgtaggcggtcaacgccagttgattgtcatccaggtacaaggcttgcaactgcggcattcgcgacagcgcctccggcaagcgcgtcaagcggttacccgacaactcgagggacgtcagcccggtgaagtgcttgaggaaataccccacctcatcccccacctccatgttcttcattgtcagtttgcgcacgtgctcgaacttgatctggggtggcaaggtgggcagcggcccgccgatcatttcatcaagtgacaggctggcttcttcgttcaatccggtcatccttcgccaacagtctttgatgcgctgcacgatgatcttgcgactgaaccgcgcgtccgctggcgtgcccgggattttcgtcagcgcggcgcggtcatggcgccaggtgctgagcactgagcgcagggtttcatagtcgtcctgcaggcccttgaccgcacgggcacgtgccatgtgatcagcccccaggctttcgatcaggcttgaagcctgggcatcatcgagcaaggggtagagttttttcaccttgcggaccagtgccgccggctgcggcgtaacctgcggcggtgacgcctgcacgcaaccttcgccccacgacggcaaggattcggcagagacacgccgcagatgcccagccaccaggtcacgctcatccccgacccgccagcgtaacctcaactgcaactgcgtggcgccccgctcgccggtggagtaaatccccaggccggtgcgctctgtggctgaaagcgtgttcaacagtgcctggtaaaagcccaacgggcctggcagcggctcatgcagggagcgaccctgctcatcgaaagcctggtagccctgaccagacttgactaccttgcgcaggcgcgtcgccgtggcattttccagcttgccaatcaaggcaccgtccaacgtctgctcatgcacttgcacgcgcagctgcgccggccatcccggtaaccgccccagcaggctgaccgccaggcgttgagtcgattcggtggccaacggcggcaggtagaagccggctaccgcacggtcttcctgcagctcgcgccacgcctgcccggcacgctgcgacaggcgcaagggcacgctggcggtattgcgcaaatacaggcgttcccatgacgacgcctgggccaatagctcctcggccatcccggtgggcaattgcgcgaagcggtgtttgagcacgccggcaatgcccgaagcgggccgatcagcatgttcgcagagctggtcgaacagcgtgcggtaatgccgttttacccccgccagcaaacgcgtacgcagcagcttatgggcctgctggatgtcggctttttcacccagcagcacgtcgcgctccttgtcgctgagggcctcgagcagcgtgtgcatcacctggccgtccttgagttgctgctcactgacgtggatgctcatgtcttcgtaatcgaatggagcggtgtcgggatagcgcttgagcaaattaccctcggcgtccagcagctcgaaaaaccgccccttgggccacccttccagcatcggcaaggccagcatttgcacggtccccgtaccggcatctggctggctctggaattccagttgccaggccaggtcgcggatcaattgctcctggcgccaacgcatcacacagtcgcgcagccgctgcggcaagggctggttgtactgcgccagttggcgtaaccagggcaaccggctgttggtggtgctgatgatttcgtccaggcggccatcgggcagtgatctcaagccgggcgacaagcgctcaagtacatagttcgggctgttccactgctcgacctgctcggcctgatgacgccagccgccgaagccgttgtgctccagcagcgggcaataggccgcttcacgcaccggatgcagcacgcgccaacgaccgatgcccgcatcgaaaaacacccggtagatcgcgccgtcaatcgcgatataagagcgcccttgatattggtaaatgcctttgtagctagggttggcaagcacctcaggagtcaccgactgctggtaggggcgcagatcacgtcgccacaaccgtgattgcccctgggcggacttgaccgcctcgaactgctcgaaataacttgccggcgtgctcgaagcgcccttgaacaaggcgccgaccactttgcccccggctgccaacagtgccattgacgcgatgcctgtggccacattggtcatatgctccagtgcctgggtcttgtgctcgtgtcgccaatcctggacgccctcgaagacctcgcccagcagttgacccacgcccacccccagcatcaactggcccaggcccggcacaaaaaaaccggcaatattggccaatgtcaggcccagctccacataacgttcgttcagtgatctgcgggcctcctcgtcgacctccgccaccggcaccgccagtaccctggcatccaattgcgccttaccgacataggcatcgaaaaaaaaccgcgacacaccgacggtgaccgacaccgcctcaaggctttccacggctttgcgggtatcaaaacgctggaaaaagtccacgcgctcggattcgtccagatagcccttgaaaaattcgcgataggctggctcctgcagcttggacgacagatagcccttgaacgccgccaaggtgtcgtactcgaaccatgggcgggctggatcgttgggcatgtacaccacgcagcgccccggggacaggccctggccggtgctaccggaaaataccagcacgctccatgcgcatgcctggtcgatgttcaatccatgccagaccagagcacggccctccagcaacaggtcgcgggttggataagtgtccctgcccgaccacagcaccttgaataacagcgtgccggtctgcgtggtcacatgccccttgcccatggcgacatgcaggtccaggcgcatgtcactcagcttgagccggccaatgtccctggcggccgggttataggcatccaccgtcatcacctcgccaggggcgggcaagtcgaagacctcgcgcagatgttgctgataggccgcccccaggtccaactcacgacaatagccggcaaactcgacggcactcatggactcgacctcaagccccgtaccgacgtcgcgcaccagtgcaccgatgcccaagccgccgtcctcagcctgggaggcgctgaaattctgcatagcggcctgcagcagcgtgcgcttctcgaccgtcaccgtcatcaacagcggcccaagcaggtcggggttggcgttagtcatcgagcgatggggcaactccagcacatcgtgctttacatccaactgctggcccttggagagcagcaatgcttcaagtcgctcgctgcagaactcgtcgagcggctccaggtttttcaatagcctatcgagcgtctcgcgcaatacctcactgtcctcatgctcacgcttgatatgcgccaggctgcgggcgtcggcatgaaccatccagccgggcaaccggtcgagcaaaacttgggttatatccaaatcctgggtggcctccagcagtttgccgggcaactgcgcccacaccgttggcgtaaccacctcacttacctgtgacatccatgacctccatgacaaccttgaataatgacgctccaccatatgcccgccgccgccgggaatgggtttgaatacctgctggtttgcgcgggctaccgccccataatttgcgtgcaaccttgacctatctaacgcccccgccacgcagcccgcggcgggccgtggatgctcaccagcgcctgaggccccgactgcttataacttatcgttctaaaactccacgggtatgcctgggtcagtttcagggtacctgcgcgttcagcgcgcgatgtgttgacctctccccaacggaaaaaccggtaaggactttatgtgtggattagctggcgagttacgctttgatcatcaacctgccgacctggcagcggtagaacgcatcactcatcacctcgccccccgaggccccgacgcatggggcttccacgcccaagggccgattgccctgggccaccgtcgcctgaaaatcatggacctgtcggacggctcagcccagccgatggtcgacgcccaactggggctgtccctggctttcaacggcgcgatctataacttccccgaactgcggcaagagcttgaagccctgggctacgccttctattccggcggcgacaccgaagtgttgctcaagggttatcacgcttggggtgaggcgctgctgcccaagctcaatggcatgttcgcgttcgctatctgggaacgtgacgcccagcgcctgttcatcgcccgtgaccgcctgggcgtgaaacctttatacctgtcgcgcaccggccagcgcctgcgctttgcctcggcgttgccggcgctgctcaagggtggcgatatcaacccgatcctggatccggtggcccttaatcattatttgaatttccatgcggtggtgccggccccgcgcaccttgctggcgggcatcgaaaagttgccacccgccacctggatgcgcatcgaggccagcggcaaaaccgagcagaaaacctggtggaccctgccctatggcccccgtgaggatgagcagaacctcagccttgaagactggaccgaccgcgtcctcgacagtacccgcgaagccgtggctatccgtcaacgcgccgctgtggatgtaggcgtgctgctctccggtggtgtcgattcgagcatgctcgtcggtctgctgcgtgaagttggcgtgcaggacctgtcgactttttccatcggctttgaagatgccggtggcgaacgcggcgacgaattccagtactcggacctgatcgccaagcactacggcacccgccatcaccaactgcgcatcgccgagagcgaaatcatcgagcaattgccggcggcgttccgcgccatgagcgagccgatggtcagtcatgactgcatcgccttctacctgctgtcgcgggaagtggccaagcattgcaaggtagtgcagagcggccagggcgccgatgaactgtttgctggataccactggtatccgcaggtggatggcgccagcgacccctacgccgcgtaccgcgatgcgttttttgaccgcagctacgacgactacgcggccaccgtcgcgccgaaatggctgaccgccaacgacgccgccggtgatttcgtgcgcgaacatttcgccatgccgggcgcggatgccgcggtggacaaggccctgcgcctcgacagtacggtgatgctggtggatgacccggtcaagcgggtcgacaacatgaccatggcctggggcctggaagcgcgtacgccgttcctcgactaccgcctggtggagctatcggcccgcgtgccgggcaagttcaagctgcccgacggcggcaaacaggtactcaaggaagccgcgcgccgggtcatccccagcgaagtcatcgaccgcaagaaaggctacttcccggtgcccggtctcaagcacttgcaaggcgacaccttgaactgggtgcgtgaactgctgctggacccgagccaggaccgtggcctgttcaacccggccatgctcgaccgcttgctcaccgacccccagggccaactgaccccgctgcgcggctccaagctgtggcagttggcggcgctgaacctgtggctcagcgaacaaggaatctgatcgatgaaaccgaatgccgcggcgtacagccaacgcttactcaagggccaggcgccgacctacgagcgcctgcaagcgcgcctggccgaagatggcagcccactggccgccgagccgattgccgtgcattgcggctgggggcggttgctgatcggtcataccttcccggacccagccaccctggcccaggaactgctcaatgagcagcccggcgagcgcgacatcgcgctctacgtggcagcgccccagcagatcctcgggatagaccctcagcagttgttcttggatccctccgacaccctgcgcctgtggttcagcgactatcgcccggcaacccgggtgtttcgcggctttcgcattcgcagggtgcaaagcgatgccgattggcaggccgtcaatcagctgtatcagggccgcggaatgttgcccgtcgacgccgagcgcctgacgccgcgccatcagggcggcccggtgtactggctggccgaggacgaagacaccggggcagtgatcggcagcgtgatgggcctcaatcaccataaagccttccaggatccggaaaacggttgcagcctgtggtgcctggccgtcgacccgcaatgcacgcggcccggggtcggtgaagtactggtgcgccacttggtggagcacttcatgagccgtggcttgagctacctggacctgtcggtgctgcacgataaccgccaggccaagagcctgtacgccaagctcggctttcgcgcgttgaccacctttgcgatcaagcgcaagaacggcatcaaccagccgctgttcctcggccccgggccgcaggcggagttcaatccctatgcgcggatcatcgtcgaggaagcccatcggcgcggcattgatgtgcaggttgacgatgccgatgcgggcctgttcaccctcagccatggcgggcgccgcgtgcgttgccgggagtccctgagcgacctgaccagcgccatcagcatgaccctgtgccaggataagagcctgacccacaaggtgctcaaggccgccggcctgcaactgccctcgcagcagttggcgggcagtgccgacgacaacctggagtttctcgatgaacaccagcgcatcgtggtcaagccactggacggcgagcaaggccaaggcgtggcggtagacctgcgaaccatcgaagaggtgcagcaagccatcgaagcggcgcgccagttcgatagtcgcgtattgctggaaagcttccacgaaggcctggacctgcgcatcctggtgatcggttttgaagtggtcgccgccgcgattcgccgccctgccgaagtgatcggtgacggccagcattccatccgcgccttgatcgaggcccagagccgacgtcgccaggctgccaccgacggcgagagcaaaatccccctggatgcggaaaccgagcgcaccctcaaagccgcaggttatgactacgacagcatcctgccccggggcgtgcaactagccgtacggcgcaccgccaacctgcataccggtggttgcctggaagatgtcacggcgatcctgcacccaacgctggtggacgctgccgtgcgtgctgcccgcgccctggatattcccatggtcggcctggacctgatggtgccggcggccgaccaaccggagtacgtgtttatcgaagccaacgaacgggccgggctggccaaccatgaaccgcaacctaccgcagaaaagtttgtggatttgttgtttccgcacagtcagccgaccgcttgaggcttgtgttgaatgtgaaaccgctatcgggggtaagcccccgatgagaccggcacaggcaacgaatcgctcaaccctttcatcgaaaccatcgatgccccctactcatcaggagtttccatgacccgaaccatccccgaacccgatctcgcctacctgcaaaaagtgttgctggaaatgctcgccatccccagcccgaccggattcaccgacaccatcgtgcgctacgtcgccgaacgcctggaagaacttggcatcccgtttgagatgacccggcgcggcaccattcgcgccacactcaagggccagaaaaacagcccggaccgcgccgtctccgcgcacctggacaccatcggcgccgccgtgcgtgcaatcaaggacaacggccgcctgaccctggcaccggtgggctgctggtcgagccgctttgccgaaggcagccgggtcagcctgtttaccgataatggtgtgattcgcggcagcgtgttgccgttgatggcctccgggcatgcgttcaacactgccgtggatgaaatgccggtgagctgggaccacgtggagctgcgcctggacgcctactgtgccacccgcgccgactgcgactccctgggtatcagcgtcggtgactatgtggccttcgacccgctgccggagttcaccgagagtgggcatatcagtgctcgccatctggatgacaaggccggtgtcgccgccctgcttgccgcgctcaaggcgatcatcgacagtggcgagccgctgctgatcgactgccacccgctgttcaccatcaccgaggaaaccggcagtggcgccgcggccgccctgccctgggacgtcagtgagtttgtcggcatcgatatcgccccggtcgcccccggccaacactccagcgaacatgcggtgagcgtggcgatgcaggactccggcgggccgtatgactatcacctgtcgcggcacttgctgcgtctggcggcggataacgacctgccggtgcgccgcgatctgttccgttattacttcagcgatgcgcactcggcggtgactgccggccatgacatccgcaccgctctgctggcgttcggttgcgatgccacccatggctacgaacgcacccatatcgatagcctggctgcgctgagtcgcttgctgggcgcgtacatccttagcccgccagtgttcgccagcgatgcgcaaccggcccagggctccctggaccggttcagtcaccagatcgagcatgagacccaaatggagagcgacacccgcgtaccgtcggtggacagccttgtgggtcagaagtcctgaccctggcaccacctgatactggcaacaaaggtcccggcgcagtagcatcgccgggattctacccccgaggcttgtatgctgattccccacgatgcacttgaagtcgacaccctgacccgcctcatcgaagacttcgtcacccgcgacggcactgataatggcgacgatacgcccctggaaacccgcgtgctgcgcgtgcgacaggcgctgaccaagggccaggcactgatcgtcttcgaccccgatagcgagcaatgccaactgatgctcaagcacgatgtgcccaagcatctgttcgactgaacacctgcgcctaaagattggggaccggcacaggatgggtggcgggcccttggtgtttgagaatcttctggtacacctcggctcggtgcactttgacgtcctgtggcgcgtcgatgccgaatttcacgtgggtaccgtttacttcaaggatatgcacgacgatgtcatcgccgatggagatggcttcgcctagagtgcggctcaagaccagcatggcggttgtccttttcgagtgacaggaccctgaccatgcgcccttgaaaatggaccggcaatggcttgcgatcaaatcaggcgctgcctacacaggtaggtaatttacctgacagacttcgcccggatcagcctttaacggcttgggccttggcgcgcattttgtcagccatcagcgtcatctcgtcatacagcaactgcgggtttttctgtttcagcgcccaggccatgcgtccttgctcatggggcaggatcatgaattcgcctgcggccacgcgctggtagatgtaatcagcgatatccgtcgcggtgatgggcgaactctcaagcaacttacccacctgcgccttcatggccggggtcggccctcggaacgagtcgagcaggttggtctggaaaaacgacgggcacaccacatgtacgccgacttcctgctgcttgagctccaccagcaggctttccgacaacgccaccacgccggccttggccacgttgtagttgctcatggccgggccttgcatcagcgcggccatcgacgcaatgttgatgatccggcccttgctcttttccagcagcggcaggaacgccttgcagcccttgaccacgcccatcaggttgattgcgatctgccagtcccagtcctccagggacagttcggcgaagaacccgcctgaggccacgccggcattgttgacgatcacatcgatgccacccagcttcacctcgcacgcctgggccagcgcagtgagctggctgtagtcacgcacgtcacagcgctgggtaaacccatcaccgcccgcctcgcggacctgcttgagggtttcctgcaaaccggcgtcgctgacatccgacaaggctaactgccagccctcacgggcccagcgcagagcgatttcacgacccaggccggacccggcgccagtgatcatcatgcggttttgcataggaagtgccttgtggttcacgaaagaagtgaccggcagtctagcgaaggtttttcctgcacccacgcaccatcagagtgatgaatgccccaggcaaaccgcgggctcggtcggatgcctgcgtatagcctaagttcaataaacttcaactaataagatggatttgcgtacgcgttaaaagaaataagcgactgagcaaaatgctttaaaaaaacacggaattttctgtgaagtaaaagagtcggagttagtaaggcgcccgtaatcagatagacgggggtatcgtaaataaccggtctttaccaaagacctataaggaaaaaaccatgagcctcattctgatcattatcctgatcctcctgctggtgggtggcctgccggtgttcccgcactcgcgtaactggggttacggcccatcgggtatcctcggtgtggtgttggtagtcctgctggtactgctgttgctcggccggatataaacgccgcgccaagcgtttaagaagcaaaaaaaagaggccttctagaaggcctcttttttattgccggtcagttagtccggcttaccatccaccacacccgcggtgttatccagcaggctcttggttgcggtttgcaggaacgactctagtttctgcttaagtgcagcttcgtccggcgattccgggatcaccttgccggtcggctcggcgcccagtgtgtattcccacaacttgggtggcatttccttgggcaataccagcacacggtcaccggtgagcaaggctacggtctggtcgctgcccgacggcttgatcacgccgaagcccttgtcgccttccggcaggttaagcaggtcacggccccagcactggtgcagggtgtcgccgcccaggcggcccatgatggtcggcacgatgtcgatctgggtgcccaccgtgtgatcacgctcaccgaacttctcctgcatgcccggcgcaatcatcagcatcggcacgttgaagcggcccaggtccatctcggtgatctgctgctcgttgccaaagccgtggtcacccacgatcacaaacagagtctccttgaagtacggctccttacgggccttttcaaagaactggcccaaggcccagtcggagtagcgcatagccgtcaagtgctcgttgaggctgccacgatcggtgactttttcaaccggcaatggcgtcggcaacgcgtacggcgtgtggttggacaaggtctgcagcagcgcatagaacggcttgccgccttcacgggctttcaattcttccaggccacggttgaacatgtcctggtcggacacgccccacgtcgggtcggagaacaccggatccacaaagtcattgcggccaatgaagttggtcatgccctggttgctgaagaaccccgactggttgtcccaggcgaaatcgccgttatagacgtacacatcgtcgaaatcacgggcgctgagcaactgcggcaggcccgacagcttgtggctgccttccggggtctgcatcaggtactcaaaacccggcaggttcgggaagcaggccatggtggcgaacataccctggtgggtgtgggtaccgttggagaagaagcggtcgaacaacaagccttccttggtcagcttgtcgaagtacggggtgatattgcccggacgtcccaatgcacccaccgagtgaccggcgaagctttccatcaggatcaccacgacgttcttgatcggcagggtcttctcggcgggtggcgtgaagtcacggcgcacggcggcggtgtcggtatccaccaatttttcctgcggcaacaccagcatgtcacgcacggtctgggtggccaatggctgttccagggcggctttccagatattggagcgatcttcggagaagcgcgacttcgccgcagcgatcagcgacagggtgccattgaggcccagctggttggcgaagttggaatcggtggtgtagacatcaccccaacgcagcggcggcccctgacgcagggtgccacggatggcgaccacggcgaccagcaggcacaccacgaacaccgcgatgcggctgtaccacggtgccacctggcgcgtgctgatggtgccgccactgaagggaccacgcgggcgcgttgcgcggtcggcgcccttgaaggccatgctcaggatcagcgtgcccacggcccaggccagcaggtaacgcaccaccgggaacccgtaccagagcatgctcatcacggttttcgggtcttccttcacatactggaagaccaggccgttgaggcgctggtggaattcgcggtagaagtccatctccatcaggcccaggaacaaggcgatgctcgacgcaacggtcagccacaagcggaagaacccgcgcgccgccatggcccgcacactgaacagcgccaacaacagcggaatcagcaggtacatgaccaggcggatatccaggcgcaggccgttggcgaacgcttccaggaacgtcgaggccggcgtatccaggatcatctcgcggttgtagaccagcaacgccaggcgcagcagggagaacatcaccatcattaccagtgcgcacagcagcgtgtaagccagatgggatttgacggtcggttgcagcaggcgatttgcagctcgctgctgattcagggcgtccgggtttgccatgtcgttttaggacccattggaagtttaagttgcgaaataaggcagtggcgtccgtccctcgcccaggctggctggggtaggcggttaacgcggcggcacaaatggtgcccgatcaaggccggcaaggctattaattactgaacgtgcaacctggctgggtctttagaagccccagggatagagccttgccaggcgaatacggccggcgaattgtcttggatggaatgtgaaaattctgtgcagcgaatatctcgatacacaaaatacgaatggcccggtcattcttcggccacgcagctgaaaaaaattatcggtacgggtggggcatcgcaggcgccattgttacgccatcacttttgcgcggtgtgcccacccattgcaccggtaattttgccgaaggcagtcgtccccattatgggggtcatgaaaccgactggacacgcacccaatcaccgaagccaagtcatacaccaaactacgcatcgctgttgcgcgcgacggcgcaaacctgctgctgcattagacttcggcacattttgcatgaaatgcagacgcgcagatcagcccatattttcaattaactattcagccctttcatcgcaaaaaggcagaattgaaaataattgtattgtcttgacacccgctcccccgcctgcaagtttcatagtcgttgcgcaacacacatccttaaacgcaatgctatggataggaaaaacaaaatggacgctctcgttaacaatgcaacttttgaactggaactggattcggaaaccgcggagaagttttccgtcattctgaacgatgaaagcctgatgcatgctggctttgtcgcacaccagtcgaacaacaacgtgttgacgctggccctggctgaagaagtgaaaatcgcagcctgaaaaaacgggagggaagtcattccctcccgtttccagtgtgtgcttgtttaactttcatcacgccaaggtaacaacttatgcaaaggcttagttcgagccttcgtcgtcgcagtgccgaagaaacattatccatcatcaccaacgaacttgccccacgcctgggcattacccgagtaaccgacacaacctggctggaccgtatcggcatcccagtgtttgccagtattcgacccgatgccctcaagggctcgctgtgcgtcaatgcaggtaaaggcctcaggccagccgaagccaagataggcgcgtacatggaggctatcgaattcagccttgcgcaatacaatacggcccaactgacactggtggagagcactcctcggcaactcatcgacagccatgagggccgcatagcgttcaatcagttctgcatgctgtatggcttctctgccaatgccgacgcgctcatcatggccatcgaagtcgaagacgtattgcgcgagaaaaaggtccttgcacccgccgaactggtgttcattccctaccccgagaacccagggcaacaactctttggagaaagctccagtggcctggcctccggcaatgacttggtggaagcctcggtgcatgcgatgtgcgaactgatggagcgcgatgtccaggccttcaatcacctgcatgaccgttcctgcctcgtccatctggaccagtacagcgcagagatcgctgccctgatcagcaaggtcaatgacgccggcctgagcctgtcggtccgctacaccgagaactgctttggactggcctacttccaggcgttcatcatggaagagtccccccaggcccccatctctgtggcgactggctcagggctgcatccgatcaaggaaatcgccttgatccgggcaatctgcgaagcggcccaaagccgtctgagtcacatccacggtggccgggacgacatcattgagcgggtcaaatacttcgagaagaaaggccgctccgtggagcttgaagcgatctcacgcttgcgtaacgtggcgacctcccgtgaacagatgatcgattactccgccatcgactgccaggaagccgcgatccccaccatcgaagcggcctggacgttgcttatcgagcggttgcaggccatcggcctgagtagcgtgctgagggtcgtgcttagcaaggctacggacgacatcacggtggtcagaatcatgattccggggcttgaagcctttgaacccgggttgaaaagggtcggtccgaggttacttacgtatgtcaaacaaagcgcttgaaccctgcacgctatttgcgggcccttccctgcaaggcatcgacagccgactgctgtgcagtgacgacctggtggtatgcccgcccgtcaaacgcggcgacatagaacgcctggtcgcgcaatcgccgccttcggaccttgcgattgtcgatggggtgttccatgcacaccctgcagtcgggcatgccgagatcctgacggcgctgaacgccggttggcgcatttggggcctgtcttccatgggggccattcgcgcctgtgaaatggacaggttgggaatgaccggctttggcgaagtctatcggcaattcgccagcgacccggacatgtccgacgacgaagtgacattggtgcaccaggcacaagcgccttacctttcgctcagcgagccgcttatccatatccggcagtttttgaagcactggacggcggagcaaatcatcacgccagcccacgcacagcaaaccctgcactacctgaaaaacatgtggtacggacatcgcacgctcagttgtctgaaagacgccttgatggcactgcctgtcgcggaacccaccatagacagtgccctggccaacttttcggcctacagaataaaaagtctggacttgatcgattttctcaaactgaaaccatggacgaagacggtaaaacagaatgtcgccatcagagatactgtgtgaaataaacggcttgccgtttgtaaatccacacttcaacagcaccaaacttctaaccctcgtcgccgttgtacgcaggaatattgcgggcagcgagttaccgttagccacttatctgcaacctgattttgccaccgacctgtatcaccagcacgtcgaaggcgcgcctgagtttccaccccatcaagcgctgggtaacgccgagcagttcatgctggccgaagccaggagcaaccttaaagccttgctgccgcactggagcaaactgttcgatctgccagtgaatatctataagttgctgacgcaccaggtcagcctgaccaatccggtgctgccgcaacagatgttcctgggtgaagacgcgttcaccagcatcaccgatcttgaggaactgctcgtgcatgagctgtcgcatatctggtgcagcatgatcgccgagatttacgacttccagctcaaggacagcgcgaacgactacgtgctgccatcgggcaccggcggcaagaaccctcggggtgtcctgctggcttgcctgtttgcggtcagcgccgtgaactatcaccagcgcctggtggcgagcggctccgggcgggcgcgccccgaacggctggattttctgcaccagtatttcctgcagagcctggccacgctccaggcatccgccgaattgtctgaaatcggcaagctgatcacctccaggctggatacattctccagtgaactgaccactgacaacgctcaaggatgacccatggcagtcgtacactttccccggcagttcatgccttacaccgaccaacataaaacccacgaggccgagggtttgtgtgtcaatgatgtactgggcaacctgaccgcgcggtttcccgcgttgattggcccggtgttctccgaggaccttcatccccagccgttcgtgggcttgttcgtcaacggcatgccggtaatgagtgcgcaagaccgcggccgcgccctggacagtaatgcgcagttgattctgatcaacgccgtggcaggtggctgacatgcagtgcgacctgaagacggacacctcccgttatgcccgccagataatcctcagtgaagtcggtgccctgggccagcaacgtctcaaagacagcaaggtgctggtggtcggcgccggcgggctcggctgcccggtgctcttgtacctggcgggcgccggggtcggcacgctcggcatcgttgataacgacatcgtcgacctgagcaacctgcatcgacagattctctatgggatggccgatgtgggcgaactgaaagtgtcggccgccaagcggcgcgtcaaccagttgaacccggacatcgtcgtcgatacctttgccaccacgctgaacccggacaatgtgctgtcgctgctggcgagctacgacatcatcgtcgacgccacggataacttcgacaccaaatacctcatcagcgatgcctgtgtcgccggtgagaaaccgatggtctatgcctcgatcagtcagttcgaaggccaggtgtcggtatttaatcactaccaccaagccacccaggagcgggggccgtgctttcgcgatctgttcgaaaccccaccgcctccacacttgacgcaaaactgcgcgcaagctggcgtgctgggtgtcatacctggcctgctcggttgctttcaagccaacgaagtgctcaaactcatcctccagacaggtgagccattgagcggcaaattgttgtccatcgactgcctggacaacacctttcacctgttgagcgtccataaaaaccggaaccgccttcccgcacccaccctgggggcttccaccacgcctgcatggcgtgacagcgactggctgtcgcccgacaacttacatgattggctcgagtcacaagcacccttgcaactggtcgacgtacgcgacagccatgaacacctgcacgcttcgctgggcggccgcttgattccgctcaaagacatactcgatcgccggcaagaactggataccacccgccgtatcgtcttctattgcaaatccggggtcaggagcaaggccgccctgctggcggttcgcagcatccacccgcacgcggaactctttagccttgaaggtggcatcgagcgctacctgacgacttttcctgacaacgccacgctggtcgcgccgtgaacgccgctgattgcgcagttaccctctccgtatcaaaggtccctcaatgagcgcaaattcttcaggcatcacctggggttttcccggcatcgaccgacgtctgctgaaagtgcaattcagctttttgctgatggtgctggggggccgctgcaatcaactggcggtggcctggtgggcgttacaggaaaccgggtctgcactttattttgccaatatgattgcctgctccatcgcagccgaggtattagccaaacccctgctggggtggctgggggacaagtacaacaagatcctgatcatcaagctggcttcctggctcagcttgctgactgccttgttgatggtggtactgtctgccacggggtctttcaacccctggacagtgggcgcgctgatgatgatcagcagcgcgatcgtcggcgtacgcgatccgctccaggcgtcgatcattcctttatttgcggacgacgataaagtctccctggcctttcgcactaaaagcgtgatgtcgtccttttcgatcctgctggggcccgtcatggccagtgggttgatctatgggttcgggatcacatttgcgtttgccgccgattttgttgcgattctcttcgccggggcgctgatagcgaccatacctaaccccgtcggtgccaccagccacagcgacaatgcccccgccaccagcggctggcgcatgatctactccggcttcaaggtggtgtatggcgtgaaggtcgagttttacctggccattgtcgcgatgctgatcaactttgccttgtttccctttttcaccatcctgctgccactctacgtaaaagacgtcatccactatccggtcacttacatcggtcttctggactcatgtttcggactggggattctggcaggcagctacaaaatcatcggctggttatccgatcgtctcccccgcgacctgtgtgtatccgcaggctttgcgttactggggttaaacctggtggtggtcggcaccgtgtcttcgtcgttgctggtgccggcggcctttttctgcgggggcgtcggcctgatgctgatcaacatccccacctcggccgtgaggttactggcaacccccaaactccatcgcaaccggatctttgccacggtggcgtttctctctgccgcagccagccccttgggcagtttcgcgatgaccggcctgatcgcccatctgggcgtcgcgctgaccatcaccgtgctgggcctcatggtgctgctgttgtcgttgctggtgtttctggtacccgacttcaaaacgttcatgcgcacccaggacacgcaactgagcgatgcctacctggacaaatacccggcagcgttcgcgcgctgacgcgtctcgtcatcacccaccacttgcaaatggagttgcctttgaccacgtcagacctcaaggaccggcctgaacccgctcgccatgaacagatcttctgcggccaatattatgacgacatggggtgcatcggcttcctgggcgacccgtcgaaatcggacatctcggtgttgatgctggggctttcggatggcgtggcgctggcgccgattgcagccagtacccgggtgacccgcctgttggccgtcgacctggacgagaccgccgccgtgcgaagcctggaaaaccgcaaccgactggcagcgcatctgcgctttgacagtgtggtcgacgatgccgcgcacttcctgggcgcgacctccgagcggttcgatgtgatcatcgtcgatctctacaccgaggagggttacgccccgatcgtgtttgatcaggggtttcaccaacggctcaaaaggcgcctgaaccctcgcggtcatgtggtattcaacggttttggcgtgcccatgaacctagagccgttcataggttttaccccgcaggcctggctggctaagcgtctgaatgacagctggggcgacattcaccacctgccccaccgacgcaatgcgacgttcatcatcggcccaccgccctccaccactgcagccgtggggtcgttgtgtgtcagtgaccggctgttcatggacctcatgggccttcgcctgcgctacctgacgcccacggttatccaagacacgccggatgtaccaccagcactggacttcgcagggattgatcaggaggtgcataaacgttgggtgggtgcgttaccggccttgtccgcactgcttgcgccgccgttggtgctgggcaaacccggcgatctgcttgagctgctggatcacccgcaagcttgcctggcactgcaggagcgcctgctgaaagacccatcatcactgcgcaccaccctggccttgctgatcgcaggtgaggtcaacttctctgatcgtgatatgtcatggttgccggactgggtcgtcgcgaccctggacaatagcgtcgaagcacgccctcgagactggctggaggggctgcttccttacgcctatggcgttattacccacaggacccgcggggatgcgaacaaggtggagggcttccgcagagcgctggatcgattgtcacaagcagcgtgacccagctacgcggctacgcctgcggtgcatcagacgcaccgtagacccagccgcgctgcaccgcctctacggcggcttcagatccgcacgttaccgcgtggcccggcaatcgcccagatgatcaggcccagtaccggcaacaacaggatcaacaaaatccacagcaccttggcgcccgtgctcgcgccgcttttgaacacgttgatgatcgcccagatatccagcgcgaggatgatcaggccaatcaggccattaaaagtggaacccatggtgtcgctcctaagtgagggcatgcccttgtaggatagccaggcctggcaggggttccgttttattttcagacgtgtacggcaatcttcaaggcttccagggatggctcagccttgatgccgacttcggcacacagctccagcacccgtggcaggtcgttgccaaataccagtaccgcctggatctcgtcgtccagcaactggctgaagttcatcagcacataaccgccatcttccgggctcagggcactcatctggatctggatacggttcagcgcagtcaggtcttcggtcttggccaattgcttgggcttgaggttgaacgccacgcccgggccgaacgacgcgacgatctgggcaaacaggtcgacgtaggtatcggcctggaacaacaccgtgtccggcaagctaccgaccaccacccattcacccagcgggatcgggaagctgtcgtcgtagttgatatccgggttggccgtcaggaacgccgccgggtccgcgtaggcctgggccgcttcatcggcgatgcgcgctacctcgtcgtcgcccatgacgccggcgctgattttgctgatgagttcgacgagggcggttttcatgggcgatcctatggcgggcgggttttggagggcgcgtagcctacaccagtttttgcaactgcgccgccgtatccaccgcgcccatggtctttgccgccgccagcgcagtggcaccctgtgcatcggtggccttggggtttgcgcccttgctgagcaggtaatcaaccatttcaacgcggttgaacatcgccgccatcatcaaggccgtacgcccgtccgacgacgccgcctcaaccggcgtgccgccgtcgatcagcgcctgcaccaccggcaggttgcctttgaacgccgcgccggcaatcggcaactggttcttgtcgttggcgatcaaggggtcggccttgaattccaacagtacttttaccgcctcaggatgaccgtggtaggccgcgagcatcaataaggtgtcgccattgtgattacgaaagttggccggcaagcccttggccaacaacgccgcgagcatggcggcgtcgccacggcgggccacgtcgaagacctgctcggcaaattcggcagcttcgtcttcggtcatttgtttgggctggtctgacatgggggctccttgcttaggcggcttatgtaactgaataaggcgctcagtgtcgcgagggagttccccagtgtcatggcttttttgtcaaaagccgtcatagccagaatcaataacggaagtgtccgccctggatctggaccagcagttgcccggtgaccggcacatagctgtccgtacctggcaaccaggcgtagaccggatcattgccggccttgcccgggtcgaatgcctcctccttgagcttcactttctggtacttgaaggtgccggtggtttccatcttcaccttgatccgcagaaatagtggcaccgcataatgcggcaactggccgtgggcgaattgcagcaattcacgcatatccagagcggccagggattctctgggggtgatggcgaccatgcccgcacgaccattggtgttttcgatctcgacaccgtaggccaccacctcggcgatctgcgggtgttgcagcaggacgttttccacttcggtggtcgagacgttttcgcccttccagcgataggtatcgcccaggcgatcgacaaattgcgcgtggccaaagccaatgctacgcaccaggtcgccggtgttgaaatagcggtcgcccttttcgaacacgtcggtcagcactaccttgcggttcttttcggggtcggtatagccatcgaaaggcgatttctcatcgattcgcgccagcaacaggccctggccaccggtggcgaccctgtgcatgaacccgtcactgccgcgcagcggctcattcgtgtcgtgggcgtaatccaccagcgcccaatgctgcaggcaaaagccgatggtgttgtcgaaattcagcacattggtgaagccgatattgccgtcgctggcggcatacagttcgcagatatgctcgacctcataacgctgcttgaacgttgcccacacaccggggcgcaggccattgccgaccatcttggtcacgcggttatggcggtcctgttcgctgggcggctggtcgagcaagtagcggcacaactcaccgacgtagccaagggtggtcgcgttgaacctgcgcgcatcgtcccagaactggctggcactgaatttgcgccggatggcgaagccggacgcaccaataatcgccgagccccagcacacacacaggccggtggcgtggtacagcggcaaggtgcaatagagaacgtcctgcgggcccatgtccagtgcgatgctgccgaagctcacggcggtcttggtccagcgcccgtgcttcatgatgccggccttaggcaagccggtagtgccggacgtgtagatatagaagcaggggtcgttgaagaaaacctgcgcggagctcgtcgggttgtctaccgggccgtcggcgctggcagccatcaggtcgatgtagcctgcgggcgtcgcgctgccgggttgatctgcgatgaaccaggtccgctcggccggaatcccgacctgatcgcgcaccgccgcgtaggcgctcgacaattccgcgcctaccacgatggctgcgggcttgaccaacgtcaggctgtgcaccagcggcgcctgggtttgcgaggtgttgagcatggcgcagatgccccccagcttggccacggccaacacgctcaacagcaactcggggcggttctcgataaacagcgccaccacgtcacccttgcggatgccttgggcctgcaggtagtgggcgatgcgattggcatgctgattggcgtcgcgatagctgatcgcgctgtccgcataaagcaaggcgttgccatctgggttgcgcagcgtggcttgctcgaaatgccagcccaagccgcagggttgcctggggtcagtgacattgcctgcgcgcatgccgcggaccactcgcggcagtgctcgaacgatagcaggcaccttgcgcagcatcatgctccaggtgatgaggtcgttttgcggatggctcatggcggaacgtcccttttcttattcttggtctggtcgagaaacatcgacggccccataggaattcgccgaatggctcgcaggaaaatacgtcagccattctttggctgtacacgcaggatttgaaaagttttgtatcccaggcggcggcggccattggcgatggaattttctgggaaaaatcgtggtcaatagtgtggaaggccaacggcccagcgtgaaaaatgcccgacccggtagcgcaaaatgcaggatgcacgatggaccttcatgcaaaatgcacgaaaatgaaaactgcaaaaaattataagtagctgatttataaggtttttttaagacaagcaatactggcacaatcactgcacctatcactccatgcttgccaacttgagccaacggagctgatagacatgagcctgatccaagataaattcgcttcagtattctccaactacgacgtcaccacccaaccacgtccagacggcggcatcctgttgaccctgcgcaacagcgaaggtaagcaggtcaagcgttcgatctcttaccagcagctgcacaccgctgatcaactgacctgggtgatcagcgccattcgtcgcgacctggccgaacaagccagtgagctgccacagatttcgatgctgcaaagccagaaccggtttgccctgccgacttaccattcggcttaagtcatcgacgttaaaagggccgcgacgcttttaggcttcgcggcccttttttatgccttcaacacaagccctggcgggaggcttcattcatcgcctgcacacggttggtgacatccagcttgccgtagatattgcgcagatggaatttcactgtggcttcggaggtggcgcgaatctggctgatctcccagacggtcttgccctctgaggcccaccgcaggatctccagctccgtcggcgtcaggggcttgccagacaagctcaggcgcttcctgacagccgtgggtacgataaccaacgggggatatgtctgctctgggccattcattgctctctcctttgatatctgctgatgcgctgccacctttcggattcctcctattgacagatggcttaaacattgacgcggaacagagagttacataacgaatggagtgaaagcgtaaaggacagaataaacagcttcgccctacaactaattgagtttcttcccacagcaaattccaacttgcctgggttgaatattcaattttttatgcttagtcgtccaattccggaaaacgaacagctatatcgtcgccggtgagttttggttcccggccttgagcggtgtcgaacaagcgcagcgttacacagtgcgggttctcgcccatatcgaaccagtggggtaaacctgccgggatgatcagcaggtcatgtttctcacagcgcacgccgtacacataatcgtctatatggagagtgaacagcccctggccggcgacgaagaagcgtacgtgatcttcactgtaggttcgttcggccaggcactgggctcgcaacccgtccttctgtggatgatcattctctacgcgaatcacttccacggcggcgtagccgagcgcatcgatctgcgcccggtacgcctcgatcatttcagcctcactggcgcccttttcgaccgggctgggctgccagcgctcaaagcgaacgccgtgctcggccaggatcgaccggatgtcatcgacatgggtgagcactttgttcggggtatccgcagtggcgatggggtagacggctacataactcattgcatggctccttggttcggctcttgcaatcgaaggccaatgataatggcggcggccagggccgcggcgctggcgatactgaatgtcagggtcggccccagcaggttccagctatagccggaatacagggcaccgagggcgccgcccgtgccggccaatgccgcatatagcgcctggccctggccttgctggcggtcaccgaagctgcgttgcacaaaggcaattgccgccgcgtgaaagctgccgaacgtggcggcgtgcagcagctgcgccaggagcagcacccagaaaaattcggcgaacgagcccagcagcaaccagcgcagcgccgccagcaggaaactggccaacagcacccgacgcacggaaaagcgcgcgaggatgcggctcatggccaggaacatcagcacctccgccaccacccccagcgcccacaacaggccgatcacaccgcggctgtagcccaagtgttccaggtgcagggtgaggaaggtgtagtacgggccatggctcatttgcatcagggctacgcaggcatagaacgccattaccccgggactgcgcaattgtttgaggaaaccgtcaccggccaggcgcttgccgtggctggtgggctgcgcgttcggcacccacaggctggcaccaatgatgccggccatgatcaccacgaccaccaccgggtagatatccaggctcagccattcgaacagacgccccatgatcaccacagtgaggataaaacctatggaaccccataggcggacctggctgtagcgcgaggtctgcttgtgcaggtgggccagggtgatgacttcaaactgcggcagcaccgcatgccagaagaatgcgtgcagggccatgaccatcgccagccaggcgtaggtcttgctgacaaagatcaggcagaaactggccagggtgcacaccgcgccaaaccgcacgatggccaggcgccggccggtgtagtcgccgatccagccccacaggttaggcgccacgcagcgcatcagcatggggatggccaccagctcgccaatgcgcgcactggagaatcccaggtggtcgaagtacagcgccaggaacggcgccgtcgcccccagcagggcgaagtagaacaggtagaagctggagaggcgccagtacgggagcggtggggtcatttcaggcggggctgcttcgcagcccggcgcgagcaagctcgcacctcgccacagaacgtcacagctggcccagtaccggcgtactcacgcgcacatcggcattttgcccacggttgcgcagcagatggtccatcagcacgatggccatcatggcctcggcaatcggcgtggcccggataccgacgcacgggtcgtggcggcccttggtgatcacgtctaccgggttgccatgcacatcgatcgagcggcccggcgtggtaatgctcgaggtcgccttgagcgccagatgcgccacgatcggctggccggaggagataccgccgaggatgccgcccgcgttattgctgaggaaaccttccggggtcagctcatcacggtgttcggtgccgcgttgggcgatgcaggcaaaaccggcgccgatctccacgcccttcaccgcattgatgctcatcagtgcgtgggccagctcggcgtccaggcggtcgaagatcggctcgcccaggcccggtttcaccccttcggccaccacggtgatcttggcgccgacggagtcctggtcgcgacgcaactggtccatgtaggcttccagctccggcaccttgtccgggtcggggcagaagaaggcattgtcttgcacgctgtcccagctcttgaacgggatctcaatcgggcccagctggctcatgtagccacggatgacgatgccttgggtggccaggtatttcttggcgatggcaccggcagccacgcgcatcgcagtttcccgcgccgagctgcggccaccgccacggtagtcgcgctcgccgtatttatgatggtaggtgtagtccgcgtgggacgggcggaacaggtccttgatcgccgagtagtccttggacttctggtcggtgttgcgaatcaacaggccaatggcgcagccggtggtgcggccttcgaagaccccggagaggatttcgacctcgtccggttcctggcgctgggtggtgtggcggctggtgccgggcttgcggcggtccaggtcgcgctgcaggtcttccaggctcagctccaggccaggcgggcagccgtcgacaatggcgaccaacgccgggccatggctttcgcccgcggtggtgacggtgaacaatttgccgaaggtattgccggacatgcagggcgctccgtgaaatcagttgaatcaagtcaaccgtaataacttaagacggccagtatacgcaggctaaccgactagttcatcctcgaaaccttaccggtagacgttggtccaaccggcacctctctgatgatggcgcgatgatgctgcgagttttactgttcaccctcaccctgttgaccactgtggcccaggccgcctcccctgtcgtactgcaacgcccgatcagcctggacaccggcagcggcgagctatttggctcgttgctgttaccgcagtccgacaaaccggtgccggtagtgctgatcatcgccggctccggccccaccgaccgcaatggcaacagcgccgacggcgcccgcaatgacagcctcaagcgcctggcctgggtgctcgcccggcataacatcgccagcgtgcgctacgacaagcgcggcgtggccgcgagcttggcggccacgccggatgagcgcaacctgacactcgacgcctacgtgtccgacgcagtggcctggggcaagttgctcaaggccgacccgcgcatgggcccgttgatcgtgctgggccatagcgaaggcgccctggtggccgccctcgccgcccagcaactggcgccggccggggtcatttccctatcgggcagcgcccgcccggtggaccaggtgattcgccagcaactggccgatcacttgccccctgccctgttgctgcgcagtaatcaaatcctcgaccacctcaaggccggccaagtggatgccgatgtgccgcgcccgctggagggcattttccggccgagcgtgcagccttacctgatcagcctgttccgcgccgacccgtcggccgctttcgccaggctgagcatgccggcgttgatcatccagggcaccaacgacatccaggtcggtgtagcagatgcccggcaactgaaaaaggccaagcccgacgcgcagttgacggtgatcgaaggcatgaaccacgtgatgcgcatcgtgcccaacaacgtcaagcagcaactggcgtcctacaacgacccgaaactgcccctcgccgctgagctgggccagcgcatcatcggctttatcgacggacttcaaccccgttaagcgactattggcctccagtcctgggaaaaacggccgataagccctgggtcgacagtaaaaagactgtcggctcgccgggcttggacaggatcgcgccgcatgacaaccaccgaagcaacacccgaatcgactgccgacaccccgactgggcccgaggccgtcgtggcgccggccctgccgtgggcggacgtccacgccgaacatttcaagatgctgcgcctggcgcccctggccaccgaccgtgccaccggtgccaggccgttgcgcttcgtgcagttcggctatgccgagcgccatgacaaacatcacagcttgctgcgcatggttattcagttgccaggccaacgggtgcgtcgcgagcagaatcacttggatatctgggtcgatcacgataaacaccgcgtgcactttggcccgggcaacagcttggaaatcgaaccggccaaccgtggtctcggccgcttcctggtcgcccaggccgccgcatgggcaaagaagaagtggtcacactaccgcgtcgatggcgtggacctggccaacaaggacgccctcaacgaagccacgcgcctgcgccgcgatcatttcctgcgtatccagggctttgatgtggcctatgccgatgtgcagcacctcaaaggcaatgtacagccgggcaaggtcagcggcgtactcgacagctggaacaccgagaaggtgcagttcgtggagattctcgaagccgcgcagatgctgcaacaggccgagcagaacctgatggaacaggaagtgaagttgcgcaaggaggaggaaaaggtcaccaagttcaagcgggaggacagcgggctgcgctttaccattacatgcctggtggcgtttacggtgtttcaggcggggttgttgatctggattgccacgcaccggtagcagactggaatgcaattaaaaatgtgggagggggcttgccccctcccacattggcccagttttttcagttaaacctgggttaaaccctggcagcgaaaatggcctgatgttggcgacactgctcagccgtcaacatgaacaccccatgcccgccacgctggaagtccagccaggcgaagtccacttccggatacagcgcttcgacatgcacctggctgttgcccacttcgacaatcagcaaccccttctcggtcaggtgatcggccgcttcggcgagcatccggcgtaccaggttcaggccgtcgtcaccgcaggccaggcccaattccggctcgtgctggtattcgtcgggcatgtcggcgaaatcttcggcatccacgtagggcgggttggacacgatcaggtcgaaacgctggccaggcaggccgtcgaagccatcgccctgtacggtgtagacgcgctcgtcgacgccgtggcgctcgatattctgattcgccacttccagggcttcgaaagacaagtcacccagcaccacttcagcgtcctggaactcgtaggcacaggcaatgccaatgcaaccagagccagtgcacaggtcgaggatgcgtgccggcggctgggccagccatggctcgaagcggtgttcaatcagttcgccaatcggtgagcgcggaatcaacacgcgctcatcgacgataaacgacaggccgcagaaccacgcctctttcaacaggtaggcagtcggcacacgctcatggatacggcgatgcagcaagcgctgcacatgggagatttcctcttcttccaggttgcaatccaggtagctgtcggcaatttcccatggcaggtgcaaggcgccgagcaccaattgacgggcttcgtcccaggcgttatcggtaccatggccgaaaaacaggtcttccccatggaaacggctgacagcccaacggatgtggtcgcgcaaggtgcgcaggcgggaagtgatcacgggggcagactcctggaaaaaacgactggcgattctaacagccttcacctgtacggacgatgtacgaaaaccccggcgccgtacgtcggatttcatccaattggcccgctttgtgttaaacaggctcacctcttgacatggctgcacgccagcaacggcgtaccttacgatagtagcgattcacagaagcgctcagccagtggacaatgtcgcaaaagccccactcacaggagcccccagaatgtccgttccaaagacgatgtttcaactcagcggtcgcggttacgcagcagccaacctcaatcatgcgacccttgtgatcatcgacgcccagaaggaatacctcagcggcccactcgccctttcgggcatggacgcggctgtcgagcatatcaagcaactgtcggcggcggcacgcaacgccgggcgcccgatcgtgcatgtgcgccacctgggcaccgtcggcggcctgttcgacccccagggcgagcgcggcgagttcattccgggcctggagcctgagggtgacgaaaccattatcggcaagctgctgcccagcgccttccacggcaccggcctggaaaaacacctgcaggaccttggctctctggacctgatcgtctgcggcttcatgagccactccagtgtcagtaccaccgtgcgtgcggccaagaacctgggctttcgctgcaccctcgtggaagacgcctgcgccacccgcgacctgccttacaagggcggcatcctgagtgccgagcacgtgcagcagaccgaaatggcgatcatggccgacaacttcgccaccctcgccttgaccaaagatctgatctgatcactccccaatgagcggcgtattgactgcgccgctcatccgcaaagccctctcatttggcgcttttacctcgagcactggaacaacctgtgtatcttccggtcgaagggccgataccctggaggaaaggtcggaatgaagatatccgatggttttgatgctcgtcgcttgcgccccaagggccccagcaactggcgtctgcgcctggtagccggcattgccgcgttgctggccatagtaggcgtgctgttggcgggcgctggtggcgccggcctgtttgggcattcaccggcactgggcgaactgaatgccagcccgggcggctcggcgatcctgttagtgattggcctgctcgtaatatggctgggtgtatggctgtggcgccgcagccgtcggcggatgcgccagccattgtcgttgaatatcgcctcgcacctgatgaaaaagcacgactgatggcgcttggatagcgtttcctgcgccctggccgccgcgatttaggtaaactgcccgcccttcgcggaggctgacatgcaagacgacgatttttccctgttcaagaacgagctgcgcggcgtcaagccgatcaagcacgaccgcgccgacaccggcaaacccaagactgaccgagcgcagatcgccaagctgcgccaggccgcgaccgtgcgcaccgatgccaccatggtggatggcctgtcagaccagttcgtcatcgacgtcggccccgaagatgagctgatgtgggctcgcgacggcgtgcaggaaagccagatacgcaagctcaaggccggccagatcccgttcgaaggcagcctcgacctgcacggcatgaacgtggaaaaagcccgggaaactttgtgggccttcctcgccgaagccacccggttcgaaatccgctgcgtgcgcgtcacccacggcaaggcggtgcggctggacggcaaacggccgatgatcaagagtcacgtcaacacctggctgcgccagcatgcccaagtactcggctttgcctcctgccagccccgccatggcggtgccggcgcggtgtatgtgatgctcaagcgcaccatgctggaggggcgcgacgagtaacaagtgccatcgtcaggcttgcagcgatgtgtccgccaccgtaaccttgcactttgcgaaaatcccacaggtagtttcatgtccctggaacagaattacacagagattctcggccaactcggcgaggatgtctcccgcgagggcctgctcgacacgccaaagcgtgccgccaaggcgatgcagtatctctgccgcggttatgcacagaccctcgaagaagtcaccaacggtgccttgttcagctccgacaacagcgaaatggtgctggtcaaggacatcgagctgtactcgttgtgcgaacaccatctgctgccgtttatcggcaaggctcacgttgcctatatcccaagcggcaaagtgctgggcctgtcgaaggtcgcacggatcgtcgacatgtatgctcgccgcctgcagatccaggaaaacctcagccgccagatcgccgatgccgtattggaagtcactggcgccctgggcgtggccgtggtgatcgaggccaagcacatgtgcatgatgatgcgcggtgtagagaaacagaattcgtcgatgatcacctcggtgatgctcggtgagttccgcgacaacgccgctacccgcagcgagtttctcagcctgatcaagtaacaggcctcgcttgaaaaaaccggcgttcatcgccggttttttttcgcctgcagaaatcaggtaagctgcgccccctcagttatgggcaagaggtaacagccatgttcgtcaaagcacttcgagtgggcctcggccaaatcatcatcgcaggcgatttcctgacccgcccacgcaaaaaacagcgccccgccgaacaacaggcactcgtgaacgaagcggccaagagcctgacgctgtatcagttccacgcctgcccgttttgcgtcaagacccgccgtaccctgcatcgcctaaacgtgccggtcgctctcaaagacgcgaagaacaacgagcaggaccgccagactctgctggagcaaggtggcaaaatcaaggtgccgtgcctgcgcatcgaagagaatggccagaccacctggatgtacgactccaaagtgatcatcgattacctggacaagcgcttcgctgcagtctgaagcacgctgcagtcaatgtaggagcgagcttgctcgctcctacagaaatcaggtcggtgttgtcaggtccagatccagcagtgccgagcccaggcacttgccgtgggcgtccagggccagtgagcgggtcacgcccccacgcaagatccccggcaacacgaagttcagcgcctgcacattcggcaattcataacgccgaacgggggccgctaacgggtccagcaaatccttgaaaaacgctgtgacgcgctccaccgtaagctgttcgcacagcaacgggtagtcttgtgcgcgataggcaatgatcgagatgttcgacgtgtcgcccttatccccggtgcgggaatgggccagcgtgtgcagtttcatacttcaatcctcaccttgaccgactcacggggcagcaataacgaggctaccgccaccacctggcgcacgttcttgctcgcgcctccaccaccgctagggccgttggtatagagggtttccacttcattgccgacgcgcacggcttcactgcggtcctcacaacgagccgccacgcgcagacgtacttcccagggctcaacactgctgcgctggccgtgcagcgcgtccatgccgaccaactcggcgcgcacctcctgcatcttcacgcccatcaactccagacgtttgagaacaacgtcccgcgccagtttggcccgtgcgacagcacccggaccgccgtaggacatctgcccctcaccgatccagccatccagataaccgacgctgaccttcaactgttcaggccgggcacggccatcagcgccctggacacgcacccggtcgacgttctcctcgacaaaccccacctgggaaaaatcggcggtcacatccggggtcagataggcggcagggtcatgcacttcgtagatcaattgctcggcgcatgtggcccggctgacccgccccccggagcctgcgactttggtgatcaaggcgtggccatccgcatcgacttcagccagcggaaaacccaggcgcgccaggtcatccacatccttgaaacccgggtcggcaaaataaccgccactgacctggcctgcgcattcgagcaaatgcccgaccaaggtgccgcggcccaggcgttgccagtcatcaaaggcccaaccgaactcaaacatctgtggcgccaggaacaacgaagggtcggccacacgcccggtgatcaccacatcagcgccgacacgcagcgcctcaagaataccgtccacacccaggtaggcattcgcggaaatcagccgctcgccgagggaaccgacggtctggccgttatccagcaactgctcgccaggcaaggcatgcagtacatcatcgcccaccacggccaccaccttgaggccaaggccgagttcggcggcaatacgccgtacttcaatggcagccgccagcgggttggccgcgcccatattggtgatcacacgcaggcggcgacgccctgcaagccgtccgacaaagggcaagacccggcgcatgcgctcacccagcaacgggtcgtaaccgccctgcgggtcgctgatacgcacctgctgcgccagggcaatggtgcgttcggccaggcattcgaacaccaggtaatccaggtcgccctgttcggccagttccacagccggttctatgcggtcgccggaatagccagcgccggaaccgatacgcaatgtattcatctcaaatcactcccaggagcaatgccgtcagggtcatcaacaccgaggcggcaaacaggaaaggaatggtgaagcgctggtgatcggccagttcgatcttgcacaggcccaccaacaggaaggtcgcgggggtcagcgggctgaccgggaaacccgtggtgtgcacgcccagcaacgaggcctgggccacttgcagtgggtcgacgcccaaggccttgccaacttcggcgatcaccggcatcacaccgaaataataggaatcgggatcgaataacatgctcaggggcatggataaaaagcccaccactgccgggatcaacttgccgtgacccgccggaatctgcgccaccgccacttcggcgatggccttgagcataccggtgccttgcatgatgccggtgaacaccccggcggcgagcaggatactggccatcgtcagcgcggttttcgcatgggcgtcgatgcgtgcacgctgggcgtcgacgttggggtaattgatacacagcgcgatcacggtgccgagcatgaacatcaccaccggatcgacccaaccggcgatcatcaccaccatcaccagcacggtcaaaatcaggttgagccagaacaatcgagggcggcgcagcttgatatcttcatcactgagcacccgttgcggcaccgcatccaccgtcgaaccagcgcccaggccgaggcgtttttcttcacgatggcccagccaccaggcacaggcgaagacaaagatcagcccgacgatctgcaccgggatcaacggctggaacaagtcagcgacaggcacgtgcagggctgccgacgagcgtagtaccggcccggtccagggcagaaagttgacccccgccgccattgcgcagacgcaggcgaggatgcgcttgtcgatgcccagccgcgtatacaacggcagcatcgccggcacggtcaccagaaaggtgactgcgccggaaccgtccaggtgcaccagcagagccagggtggcagtaccaacgacaatgcgcgtaggacgcgtccctaccgtgcgcaggatccgatcaatgatggggtcaagcatgccggcgtcggtcatgatcccgaaaaacaggattgcgaacacaaacatgccgaccacgggggcgacgttcttgatcccggtaatgatgaaggcactggtctgcaggccgaaaccacccagcagcgcggcgatgatcggcaaggcgatcagggccacaagcggtgagaggcgtttgctcatgacggcagcgagcaggcagaggatggtgatgacacccagggttgcgagcatgggttactccagggcggcctggttggccggttattgttttccctggagtattggaagcgggttagtctttgtaaattggaatattcggcctagcacgttcggaaaaacagaatgaaaaactcgatccagcacatccaggctttccttgccgttgcccgcaccggcagtttcaccaaggccgccaacgagctgcatctatcgccgtcggccctgaccgtgcaggtgcaacaactggaagactggctcggcgtcgccctgctcgaccgcagcccacgccacgtgagtattaccgctgccggccaggaggcccgcgggccgatggaaaaactgctgctggacctggacaacatcgtcaccggctcccgcgacctggccgccctgcgcaggggcgtggtgaccatcgccgccctgccttcggtatgcgccggcgccctgcccccggccttgcgcctgttccgcgaacgcttcgccggtattgaggtgcgcctgcatgatctggtggcccatcgcattcatgcccaggtccgcaacggcgaggtggatttcggcgtcggggtacgtgcgcgcttgagtcacggcctggaattcgtgccggtgctgaatgatcgtttgtgtgcttttgtgccgcagaatcatgcgctgactcgctttcgatcactgaccctggaacaactggcagaccaaccgatcatccttaccggacgcgacagcagtgtgcgcgaacaggtggacggcctgtttgacgagacccggctgacgctgaacgcgggcatggaggccaactacatgtcgacggtattggcgttggtgcgccagggattgggcatcagcgtgctgccggagtcagcggcagacagcctggaaggattgaagcggatcgacatcgagcatcccggggtaaatcgagagattggcttgatcagtcgcagtgggatgacgttgagtccggcagcacaacgctgctttgaactgctcaatgaagaattatctgatacgccgctgcgctgaatgtgggggcttgctgcctggcagcttatcgctatctaactgtgggagggggcttgctcccgatgggcatgggtatctacacaactctgacatgcgaccgtcagtaaccacgatgcgaagcgagccgctcttgatcttgatcttgatctgcttttgatcttaggcgccccgttaaaccacgctggccgcaattcgacagggatttggggggcaaaccggcagggatgccggtttagccgccccgcgccatggatggcgcgtggcggcggccccccaaatccctgtcgaattacgggcacaccgagcctaagcgaggtgccgagtggtggggcaagagcgttttggttacttttgcgcttttcaaaagtgacccgccgtaagggcggaaccaatagcggccgttacttaaataatggatatgtactcgatccaaccgaacatcctggtcggctgtgaggccgccatcgggggccccctcccacatgggccggcggcgtaccagaagttgtgtagatacccatgtcccgatgggggaataacagtcataaattattaactgacccaccgctatcgggagcaagccccctcccacacttggatcgcggtgcatcagtcagatagctgtacgctgtcaggccgctagtaggagtaagccctcctacctttgcgcccgtgtttaatccaccatcgtcacatgtttcggatgcctggccacgcgctgcaaccacgcctgtaccgccgggtaaggcgccaggtcgaagcccccttcatgggccacatgggtgtaggcatacagcgcaatatcggcaatcgaatactgctcacccaccaagtacggcgtggcttgcagctggcgctccatgaccctcaaggctttgtaaccgcccttgtgggtggtcttgtattcctcaaggcgatcttccggcatgttcaggtagaactggataaaccgcgccaccgcgatatacggctcatggctgtactgctcgaaaaactgccactgcaatacttgggtacgcaggcgtggttccgtgggcaagaactcactgccatcggcgagaaagttaagaatcgcattggactcccacaggcaggtgccatcttccagctccaataccgggattttgccgttggggttcttggccaggaattcagcggtctcggtgtcgccgttgaggatgtcgacatcgatccattgatacgggatgcccagcagattgagcatcagtttgattttgtagcagttgcccgacttgtaatcgccataaaccttgtacatggggctccccttatgctgcttgtgcgctctgaccgaatgcttgcgccgataaggtgcgggtgtcgagggattgtttcaaggtaacggccagaataaatagcccacacgcctggaaatccgcctttcatccccttttgcccagacaatcgaaaacattatttgctttatttgtatacaaaagcataattcgcttcgtgcgagttcctgacctactggtcaacaaacccgccagtacctcaaagcgccgttgcccacttaaggtgcccggcgctggacataacaataaaacccttgaggagtactcgctgtggatagccgcaaaaccgaagcccctacgcttgacctcgccgcgccgcaaggtggctggctggaacgcctgttcaaactgcgtttgcatggcaccacagtgaagaccgagctgattgccggcctgaccacgttcatcaccatggcctacatcatcttcgtcaaccccaatatcatggccgatgcaggtatcgaccatggcgcggcgttcgtcgccacctgtatcgccgccgccctgggttgcctgctgatgggcttgtacgccaactggccggtgggcctggcgccgggcatgggcctgaacgcgtttttcacctacaccgtggtcggcaccatgggctacacctgggaaaccgcgctgggtgcggtgttcatttccggcgtgctgttcatgggcctgacactgtcgcgggtgcgcgaatggctgcttaatagcattccggtgagcctgcgccatgccatgggcgcaggcgtcggtttgttcctcggggtgatcggtctgaagaccgcaggcatcatcgtcgacagccctgcgaccttgatcaagctcggctccctgcacgaacctgcaccgctgctggcggcggtgtgtttcctgctgatcgccattctcagttaccaccgggtattcggcgcgatcctgatcagcatcatcgccgtgaccctggccggttggggcctgggcttggtgcactacaacggcattctttccacgccaccaagcctggcacccacctggatggcgatggacatcaaaggtgtattcaatgtcagtatgatcagcgtggtatttgcatttctttttgtacacatgtttgataccgccggtacactgatgggcgtcgcgcaacgcgccgggctggtgaatgccgatggcaagatcgataacctgtcgcgggcgttgaaggccgacagtgcgtccagcgtgtttggcgccatggtcggcgtgccgccggtgaccagctatgtggaaagtgcggcgggtgttgccgcaggaggtcgtaccggcttgaccgcggtgaccgtgggcgtgctgtttgtggcggcgatgttcttcgcgccgctggctggcatgattccggcatatgccaccgccggcgcgctgatctacgtcgcgatgctgatgatggcgagcatggcccatatcaattgggatgaagccaccgacagcatcccggcgatcgtcaccgcgatcatgatgccgctgacgttttcggtcgccgatgggatcgccctgggctttatcacttatgtggcgctcaaggccggcaccggcaagtaccgcgagatttccgtcagcctgtgggtgctgtgcgcgatctttatcgccaagttcatcttcctgtaggtcgggaatagctgaaagaatcgcctcacctccgggtgaggcttttgcaccaatggaggactgtaaatgcccctggaaacctggctgctgttcagcggcgctgcattgattgtgatcctgatccccggcccgctgtcgctgctgatgatcagcaacagcctcaactacggcctgcgccgttcatacccggcgtttctcggcggcgtgattgcctcgatctgcctgctgagcgcctcggccctgggcctgggcgcgctgttgctggcatcggagcagtggttcagcgccttgaaaatcgtcggcgcactgtacctgttctatcttgcctggcagagctggcagcaagcgcggcaaccggcccacgtggcccagtcctcgcaggcaccggcagtgccacgctttcgcgctctgtttggccgggcttttgtgttgggtgccagcaaccccaaggacatcctgtttttcgccgccttcctgccgcaatttctcaacagtcagcaagcgttctttccacagctgctggtcatgattgccacctgggctgtgctcgacctgctgtgcaagctggcttacggcctgggcgcccatggcaccgcgcggtatctgcgcagcggcaatggccaaagctggttcaaccgggtgagcgccgcactgttcggcggtgccggggtggtgtcgctgcttaagggacagtagccaatttgatgaagtaaacactggcaggcactcgtccaaagactggccattgaatgccggccatgatcgaaaccaggcgcccttgctccagcgcaagtttaacctcggcgtctgctgacgcacttttgcgcagccaacgctccttgaacttgcccaacatcctgatgctccccttctcaagccactgatatgccacgtagtacagtcggtttggagaattgggatgagttgcgatcaaatccggtatcacacccgccctgtcgcgtgctaccgggagctcccgcacagtgaaaccctgatcattgagtaccctctgaattgccactcgttgcgtagcctgtctagctgcaaccaggtgcttgtctctctggagcctggcctctaaagggacggccggagtgaagtctacccgcgtaaaaccaggcgctttaccatcgaaaccgatgtgtatgtacgcatcgcccaggtcatggggacgcaacatccgcagcaagtcatccgtctggccaggccgcgcagggggttggggtatccattcgtcgagcgccgcccgcaggttgagcagatgagtggccgttgcagggcgctccgggcctgataactcaatcaaccttgcgacggtgaactcccggctgtgggttgtcatggtggggaacgcagtgcccacagagtccgtcaaaggtttgtcgaacaggggggcatggaaccgccattcactggcttgaacatgggttaccggaacaggctgctcaagcgtttgcgtaaccgtccaacgctcaatgtcagcacgggccaacgaaaccagcggctcattcctgtggataaactgaatgccctgcaggggagcctggttgccctcgggaagcatcctgtaatagctgctcaacggatacatcagatgggtattggcaggtgccacccggatgacattgtggggaaaacctcgagcatccggatcaatgtaaaacaccccggcagacggagaccgcgatatttgccccacttccccgggtgggatgcgccaattttgccaatgggtagccgttgagcttgattgcacaattctggtttgtgtagcagtacgcacaatcggcggttgccagtcctgcaccgtctgcgcttgcccgcgccacgggttgagcacgcccgaactgggccccggttgtggtgcatcggcccccagcaaccactccctgggctggtcgatgttcaagagcaattcatcttgcccatcgccctgggttttcttcaggcgcagcgccgattcattcttacgttgatacaccgagtaggcctcttgcccctcggtaaccatctgttggccattcttcacataccgccccttgccttccggccacttcaactcaacggcgccctccaacccactcaaggatttgaaatgccccagcagactgagcggtttgccaggtgacactctcaggccggcgaatgcgccactggcgaacccatggtggcgatgcaaatgcgacaaggagggccgcgcaacacgcatacccttgggagcagggagaaaggacaacaacacatcgaggaacgccatcagggtaaggaacgctacatccacggcgtcatgggcatcgccgctgaaatgatagcgccgtgccgcgagcagcatttcatacaagctgatacccacgcccaacaccggcacgaatgacaacagcccccgaatgctcgcggcgtgctgttcgcccaggcgttgctcgcgatatgcctctaatacctgggaagaattggactgggcctgggcacggcgttgcagctcgaacatccgcgcgtgggccagcagcgccctggcgttgccctgggacgtggtcaccatcgccagccaagcatcgggcgccagcgcaatctgctcgctgatttgtacctcgacactgctttggtctaccgctggaaccttgtgtcgcaccgtgaaaaaacggaagagctgcctgacaaaacgcgcaaccaccggtacataaacccggcgtataaataattggcggggttccatctgcggatcttcgtcgggatagctgttgacggcctggacctcccagtcgggcgccacctggcccgccaacgccttcaggttcagggacaaggcgccgaccttgttcaaggcttgctcggccagggccacgctggcgtactcggcgatgggtgggctttccagcgcggcgggccaatacacgacacacagcccggaaaggctgtcgtgcatgaccagtatcccggcgatatggcgatcatgttccagggtatggcccaccagacgcaccaagcccaattgcacatccaacccatcacctttcagatcgctcgccacctgcgccgccatgacgcggctgaacacacgttgcgcctgatcgctcaagccttgccggatcgcgctgtacacctgcatctgggccctttgctgcaaggcccgataaaccaaggcctgggacaggcccggggcaggcacctgggtcgatgccgacgggtagaacgcacgccggatcagcttgtcgtattccccgcccacgtccagggacgcaagggtcttgatcaggtaagacacactcagccggtctttccatgccgagtccagccagcgtgcccggttcaagcgccagcgggtccagggggccttgggatcaaggttatgcagcgccagttgcagcaggctgaaggtggtgcgctgctgactgacggtgattttcgcattgcgatctcctaccgcgcattggcttgaccagctacacatttgggaactcacatcatcaggcatatcgagcagcggtttatcgatatccagttgcgggtaaaacccgtctttgctcaaacgggcgatcagtgcctggcgagcaaaggattccaggtcaggcaactccagccacagtttttgttcaaccgcccaggcattggccaagtagcggcgacacaggcccctgtagtgctggcgttgggcgcgggttgccgtggccagccaggcgggcagcttgctcgcctggctggctgccaactgcaacaggttgagattggccacggccagggttcgtgcatcattggccgggaccagcaggccgtcgaacaattcctgggccaataacaggcggctcagctgccggtcactcacctcgctgaacaaccgctttccctgatcaatcagcttgttcatcgcgacgtgatgttgcatatgcttgataaacaggtccttgatcacggcgcgcttgatcatttcatagctcaccaccagggatgcccccgtgggcaacgcgctgatcgccgtgcgtgcctgttcccgctggtgccgcccgatacagcgccacagcatagagccatcgcggcttttcaggctggcttcaagcgcctcggcaaaagcattcagggaatcaaacgctaccagccctccgtagcggccggtcatatatagcagcaccgggtacgagtcgccggggttggcttgggccgcgttgccggtcaccagcaccgcgccgagcagcgggtacaaggtagcggcatcgccgcccaccgcgacttgcagcacgcaggtatccgtagccttttgcccaggctgccaagcttcactcaacgccgcttccaggtgcacaaggtgggcatcgctgatcaggttcaggcgctgctgcatctgtgcctcatacagcaacgcactcagctgtgccgcacccagcaaggagccacgattgcgcgagccctcgggttgctcctgccaataatcttttttgaacacgcgatccgacggcccccgggcccatttgcgcgctgccgctacctgggcctgccattggcgctcaagactgaggaaatcctggtaggccacgctgcccttgcccacgtccgtcgcgtcgagcaggcccatcagggctttttcataacgtttgagctgcgcctcgcgggttttccacgcaagctccggcgccaggtgccctgccacaatctcgccgctgcggcgctgccgatcccactccagcaagatctgcagggtatgtcccaagcgcgggaaggtgaccaggcgccggcgccctttctcgataaatttgagcaagcgccacacatcgggcgccgcagacgcgttcgcgccctgaaggcccactgcggcgtgattgatcgacaaggcgcacgccagttcgttatcccattgcccgtccagcacctcgctggcgctggcgaacagcgcgtcgtcacgcaacaggctcccgcgctgagggatgaacggcgtgggggtaacgctgggcgcctcacacagttcatgccaacgccgcaacggcaggcactgccacaacacacgactcagcgggccattgaccagtatcggcaggtcgcacaccaattggtgccaggaaccgaactcgtagaactggcgaaacaggccgggcagatacaccacgtggggcgaatccccctcaccgccctcgcgatagatatgcaaggcccctggaaccggcacgctgcgctggttggtgccgggccacatgaccctgcacacatggacattcgcccattcgccgccggcccgctgacgctggtcgccgtcgggtatttcgagcaatttgcgcagcatgtcaaagccgctgtcagacagttgatacaagcgatgggccagcaacgcattggcggcgaacaacgacgtacgcaattgcgcccagcgcccgcgacgggtcaaccacgaaccatgggccagctgttgccagtactcacgggtcgcctgttcgatgcgcccgagcaaggtcaaccccttgactcgcacaagcgcatcccaggccgtatagggcaaggtacgggccggatcgtccttgatgctcagcgtggtgaagtggttgatattgaccggcacatagggctggatcagcaaagccagtgcgcgctcggtcaggctgtcgatcttctgggccggggccggtggccgcggttcggtgaacagcacggtgtccgggtccaggccaaacgcctcctgcagcgcgctgcgcacgatgcccagcaccctgggcgcgcgcccgagcaaaccactgagagtcttggccgcttcgctggcgctggcctgtgcttcgtggagccgattgatttccaggctgggttgcgtgactgcgttgagccgacgggtcagcagcgtgcgcatcgcctcgtcgcggtctgccgatgtagtgtgcgggtcatcgaagtcgagcttatcggcccaggtggaggtggtgtcagtgctcatggcgggctttcccgtacagaaaaagccgagcctaggcaccccggccacccagggtgcgttacatagttgggcgcggcgcacgggccgcgggcaaaaaaaagcccgcagtgtgcgcgggcgaaaccaacgaagagcattgggggtaaagcgcggtgacgactcagctaccgcggtaggtggagtagctgtaaggcgaaatcagcaggggcacatggtaatgatcctgttcggcgctgatgccgaagcgcaacaccaccacatcgagaaacgcaggctccggcaattgcacaccacgggctcggtaatagtcgccggcactgaattgcaactggtagacaccgctgcggtagtcgtcaccttgcagcagcggcgcgtcgcaacggccgtcgctgttggtccgggcgctggcaaccagttgcagctgtgtaccttcgacacggtacagctcgaccttgatcgcgctgccggggcagccgtgcgcagcgtccaaaacgtgtgtggtcaaacgtcccatggcgtttacgcgcctcctgaagtcagtagaagagaaaacccgcactttttcagggcagtgaaaaagtcggcgatggtcgattaagacacttttcaaaaaaattgtacacaataaattcagcctactcatcgcgtctcttgccctgccccctgtaggagcgagcttgctcgcgaaaatcgccaacgataccgcgggtcttcaggagaaacgcggtgactttaagttcttcgcgagcaagctcgctcctacagttctatgcacctacgcagacagcgcaattattttgcttaaattgaccagtcaggcaggtttcttgcaacccttgtaaaccgaccgttcagaaaaaatgcagaaatgcacacttacaaagtggcgaataagttgtatacaatcactcatcgccacctcgacgaacaagaaggaagactgcagtgagcgctgactacccacgcgacctgatcggttacggcagtaaccctcctcacccccattggccgggcaaggcacgcatcgcgctatcgttcgtactcaactacgaagaaggcggcgagcgcaatatcctgcatggcgacaaagagtccgaagccttcctctcggaaatggtctcggcccagccgctgcaaggcgagcgcaacatgagcatggagtcgctgtacgaatacggcagccgtgccggtgtgtggcgcatcctcaagctgttcaagcaattcgatattccgctgactatcttcgccgtggccatggccgcccaacgccacccggatgtgatccgtgcgatggtcgatgccggtcacgaaatctgcagccatggctaccgttggatcgactaccagtacatggacgaggcccaggaacgcgagcatatgctcgaagcgatccgcatcctcaccgagctgaccggcgagcgcccactgggttggtacaccgggcgcaccggccccaacacccgacggctggtgatggaggaaggcggcttcctctatgactgcgacacctacgacgacgacctgccttactgggaacccaacaaccccaccggcaagccgcacctggtgatcccctacaccctggacaccaacgatatgcgctttacccaggtgcagggtttcaacaagggcgatgattttttcgagtacctcaaagacgcgtttgacgtgctgtatgccgaaggcgccgaggcaccgaagatgctgtccatcggcttgcattgccgcctgatcggccgccctgcccgcctggcctccttgaagcgttttattgaatacgccaagagtcacgaacaggtgtggttcacccggcgtgtcgacattgcccgccattggcagcaaacccacccctacacgggagcggcgaaatgactgcattccagaccttgaaaccttcgaccttgagccgcgacgctttcgtccaggcctttgccgatatttacgaacactcgccatgggtggccgaaaaggccttcgagctgggccaggatgcttcgatcgaccagatcgaaaccctgcaccagcgcatgagcgatatactgttgagtgctgatcacacccgccaattggcattgatcaacgctcacccggacctggccggtaaagccgccgtccagggccaactgacccaagccagcaccgatgagcaagctggcgcggggattcaccaatgcacggccgaagagttttctcgcttcaccgagctgaacgacgcctacaaggccaagttcaagtttcccttcatcatggcggtaaaaggcagcaaccggcatcagatcctcgccgcgttcgaaacgcgcatacacaactcggtagacaccgagttcaagtgcgcgctggacgagatcaacaagatcgcgttgttccgtttactgaccctctaaacgaccatccccagccactctatctaaggcagacaagaagaatgaaagcttacgccgtacctttcgagaagttcgtcaacctggccgacgcccgcctgggcaccaagatcatctcggtgaccgatgactggttcgccgacgccaaccgactgttccagccgaccccggccgtgtggaaggagggcgttttcgatgacaacggcaagtggatggacggctgggagtcacgccgcaagcgcttcgaaggctacgacagcgcggtgatccgcctgggcgtgccgggttcgatcaaaggtgtggacatcgacacttcattcttcaccggcaacttcccgccgtcggcctccctggaagcctgcttcctggcctcgggcgagccggacgccaatacccagtgggtggaagtgctgtcggcggtagagttgcaaggcaacagccaccactaccacgaaatcaataacgaccaggcgttcagccacctgcgcttcaacatttacccggatggcggcgtagcccgtctgcgtgtgtacggcgtgccgttccgcgactggtcttcggtgggcgacaacgaacaggtcgacctggctgccgcgctcaatggcgggcgtgccctggcctgctccgacgaacacttcggacgcatgagcaacatcctcaacccgggccgtggcatcaacatgggcgacggctgggaaaccgcgcgtcgtcgtacacctggcaatgactgggtgatcgtcgccctcggccacccgggcgagatagagaagatcatcgtcgacaccctgcacttcaagggcaactacccggacacctgctcgatccagggcgcgttcgtgaaaggtggcaccgacagccagatcgaaacccaatcgctgttctggcgcgaactgttgccggcgcagaaactggagatgcacgccgagcacaccttcgccgagcagatcacggcactggggccgattacccatatccgcctgaatgtgttcccggatggcggtgtgagtcgcctgcgcgtcttgggcaaagtatcgaagtaatgctgagactgtaggagcgagcttgctcgcgaagatcgtcaacgataacgcgcccatcctggatacacgcggtgttgttgagtttttcgcgagcaagctcgctcctacactgatccaataacaattcaagattaagaagacagccatgcgcacactgatgatcgaacccctgaccaaagaagccttcgcccctttcggagacgttatcgaaaccgacggcagcgatcacttcatgatcaacaacgggtcgaccatgcgctttcacaaattggcaacggtcgaaacagcacagcccgaagaccacgccatcatcagcatcttccgcgccgacgcgcaggacatgccgctgaccgtgtgcatgctggaaagacacccgctgggcagccaggcttttattccgctgctcggcaacccctttctgatcgtggtcgcgccacttggcgatgcacctgtatcaggcttggtccgcgccttcgtcaccaacggcaggcagggcatcaattaccatcgcggcgtctggcaccacccggtgctgacgatcgaaaagcgggatgacttcctggtggttgatcgcagtggcacaggcaataactgcgatgagcattttttcaaagaggatgagcggttgatcctcgccccccaccaataagagaaggccggatcacccgacaacaagggtgacaggcgagaggtaaagactgtggaagcacatttgatggaatggctgaacctgagcgtgcgctgggttcacatgatcactggcgtcgcctggatcggcgcttcgttctactttgtctggctggaaaacaacctcaatcgcgtcaaccccaagagcggcctggccggtgacttgtgggcgatccacggtggcggtatctaccacctggaaaaatacaaactggccccaccaaccatgccggacaacctgcactggttcaaatgggaagcctacttcacctggatgtcgggcgtcgcgctgctgtgcgtggtgttctactggaacccgacgctgtacctgctcgcccccggcagcagcctcagcggcaccgaaggcgtgttgctgggcatcggatcgttgttcgccggctggttcatctactccttcctctgcgactcggccctgggcaagcgccctgccctgctcggcttgatcctgttcgtgctgttgattgcggcggcctacggcttcagcaaggtgttcagcggccgcggtgcctacctgcacgtgggcgcggtgatcggcacgatcatggtcggtaacgtgttccgcatcatcatgccggcgcaacgcgcactggtggcggccatcgccgagaaccgcacgccggatccagcgctgccggccaagggcctgctgcgttcgcggcacaacaactacttcaccttgccggtgctgttcatcatgatcagcaaccacttcccgagcacctatggcagccaatacaactggctgatcctggccgggatcgcggtagcggcggtgttggtgcggcactacttcaacacccggcacaacagccagaagtatgcgtggaccttaccggtgggcgcgttggcgatgatcagcctggcgtacgtgaccgggcccaagccggctccggcagtagccaaggcacctgcagcgatcgagtaccagccactgccggaaacggcattgggcggtggtttgaagcccgcagcgcctgccgctccagctgctgaaccggcaccggcccaggccaccaccgatttcggccaggtgcaccacgtgattgagcagcgctgcactgtgtgccattcggccaagcccaccagcccgttgttcagcacggcgccggcaggggtgatgttcgacacaccggcacagatccagcagcaggccgcgcgcattcaagcacaggccgtggccagccagatcatgccgttgggcaacatcacccagatgacccagcaggagcgggatttgattggttcctggatcaaccagggggcgcgtaccaattaactatgtacatcacccactgtaggagcgagcttgctcgcgaaggacgtcaacgatatcgcgcacatgctgaatgaacgcggcgctcttgggttcttcgcgagcaagctcgctcctacaggaattgcgaacagcgctaatggcaattgaatgccaaacaacacaaaaataaaaagatccgaggtgttgcatgaccgagttagtcgaaccgcagattcctgccgcgcccgccatggtgcggctgcccctcttgcaactgattctggttggcctgcaacacgtcttgctgatgtacggcggcgccgtcgccgtgcccctgatcattggccaggccgcgggcttgagccgtgaagaaatcgccttcctgatcaacgccgacctgctggtggccgggatcgccaccatggtgcaatcgttcggtatcggcccggtgggcatccgcatgccggtgatgatgggcgccagttttgccgccgtcggcagcatggtcgccatggccggcatgcccggcatcggcttgcagggcatcttcggcgcgaccatcgccgccgggttcttcggcatgcttatcgcaccattcatgtccaaggtcgtacgctttttcccgccgttggtgaccggcaccgtgattaccgccatcggcctttcgctgtttcccgtggccgtgaactgggccgggggtggcagtgccgccgccacgttcggctcaccgatctacctggcgattgccgccctggtactggccaccatcctgctgatcaaccgcttcatgcgcggcttctgggtgaatatctcggtgctgatcggcatgggcctgggttacgggttgtgcggtgttatcggcatggtcgacctcagtggcctggctcaggcgccctgggtgcaggtggtgacgccgttgcacttcggcatgcccaggttcgagctggcgccgatcctgtcgatgtgcctggtggtggtgatcatctttgtcgagtccaccggcatgttcctcgccctgggcaagatcaccgatcaggaggtcacgccgaagatgctgcgccgcggcctgctgtgtgatgccggcgcgtcgttctttgccggtttcttcaacacctttacccactcctccttcgcgcagaatatcggcctggtgcagatgaccggcgtgcgctgccgttcggtcaccatcatggccggcgcatttttgattgtgctgagcctgctgcccaaggcggcctatctggtggcttcgattccacccgcggtactcggcggcgcggcgattgccatgttcggcatggtggcggcgaccgggatcaagattttgcaggaagccgacattgccgaccgccgtaaccagctgttggtagcggtgagcatcggcatgggcctgatccccgtggtacgcccggagttcttcgcgcagttgccgctatggatgagcccgattacccatagtggcatcgctatggccaccctcagcgcgttgtcgctgaacatactgttcaacatcctgggcggcgctgagcgcgttgccgttgagcacgtccacacctgaagcatgctccattgtcgtcctgcgcgcgctgtaacggcgcacttgagccaggacgtgggagccagtattctccgcgcccgcttgaatcgacggtttttaaccgccttggcgcggcttttgctgtaagcataaaagctgaccaatcagatgattttttcagcgaatccaaaggcgccacatcagagcgccagattagaaaaaacataaaaaaactttaactcgggagcaaccgaatgaaacctatgttcaagggcctggtgctggcaggatccctgctggccgccggccaagccggagccggcgacttgttgcaatggcagaacaacagcctgacctacctgtggggcaagagctttaccgtcaacccgcagatccagcaaaccgtcaccttcgaacatgctgacgcatggaagtatggcgacaacttcttcttcctcgaccgtatcttttacaacggcaaggaagacggcaacgtcggccccaatacttactacggcgagttcagcccacgattgtcattcggcaagattttcgacaaggacctgtcgttcggcccgatcaaggatgtgttgctggccttcacctacgagttcggcgaaggcgataacgagtcctacttgctcggtcctgccatcgacttgaacattcctggcttcgactacttccagctgaacttctaccagcgccagaccgaaggcaaccgcccgggtgacggcgtctggcagatcaccccggtgtggtcctacaccattcccgtaggcaactccgacgtgttgatcgacggcttcatggactgggtggtggacaacgacaagaacgcccgtggcacttatcacgccaacctgcactttaacccgcaggtcaaatacgacctgggcaaggcgctgcattggggcgacaagcagttgtatgtgggttttgaatacgactactggaagaacaagtacgggattgaagacagcggcgcgttcaagacgacccaggacacagcgagcttcctggtcaagtaccacttctaataaacactgctggacaaaatgtgggagggggcttgctcccgatagcggtgtgtcattcaaagtatctgtgactgaatcgccgccatcgggagcaagccccctcccacattttcagctctgcgtcaggccgaggaatcgcgacaactcctcacgtttggccagcgcatccttgcgccccaactcgatcaattcgctgcaataccccgcctcgaacagcaagtaacttaatacccccgcgccactggtcttggtcgcccccggcccacgcaagaacaaacgcaacgccgccggcaattcctggcgatgccgcgcagcgatctcgtcgatcggctggctgggcgcaatcaccagcacttccaccggcgccaggccctgtaccgctgcatcagcaggcacgacgcggctgaactggttcaaacgctccagcagttcgatatcgctttccaggctgtcgatgaacgtgctgttgagcatatgcccgccaatttgcgccagggtcggctcctggccggtgtaggtgcgttgcaccgaaggctcattgccccgtgggttgccgctcacgccgaccaccaacacgcggctggcgcccaggtgcagggccgggctgatcggcgccgactggcgcaccgcgccatcgccgaagtactcctgatcgagcttgaccggcgcaaacaacagcggaatcgccgaactcgccagcaggtgctccaccgtcagttgggtgggcacgccgatccgtcgatggcgcaaccaggcatcgatggtgccgccgccctgatagaaggtcaccgcttgcccggattcataaccgaaggccgtgaccgccaccgcctgcaaatgcttgcagcgaatggcttcgtcgatgccgtccaggctcaggcgttcttgcaacaattcgcgcagcggcgagctgttgagcagtgccactggtacctgtgcgcccaggcccaataggctgtggatgaggaaacgactggcctggcgtatcacccccggccagtcgctgcgcagcacttggtgactgcgaaagccctgccagaacgccgtcagtcgctggatagccgcacggaaatcggtggccccgctggccaggctcaccgcattgatcgcaccagccgacgtgccgacaatcaccggaaaaggattcggcgcccctggtggcagcaactcggcaatcgccgccaatacccccacctgatacgccgctcgcgccccgccgccagaaagaatcaagcctgtgaccggttcaactgggcgcattgcgtcactccatgtgggaaaagccagcgcttatcggcggcgtttttcgtacagcttgggttcacccgccggtcggctcttgaagcggcggtgggtccacaggtattgctcggggcattcgcgtaccgaggcttcgacccattggttgatgcgcaggcagtcgatttcgtcggtttcgccggggaagtcggtcaacggcggatggatcaccaagcggtaaccgctgccatcggccaggcgttcctgggtgaacggcacaaccagcgccttgcccaggcgcgcgaacttgctggtagcggtgacagtggcggcctggatgccgaacagcggcacgaagatgctttgtttggcgccgtagtcctgatccggtgcgtaccagatggcgcggccggcgcgcagcagcttgagcatgccgcgcacgtcgtcgcgctccacggccagggaatcgaggttgtggcgttcgcggccacggcgctggataaagtcgaacagcggattgccgtgctcgcggtacatgccatcgatggtgtgtttctgcccgagcagcgccgcgccgatttccagggtggtgaaatgcaaggccatgaggatcacgcccttgccttccaactgcgcctgcttgaggtgttccagcccttcgacatgggccaggcgcgccaggcgcggcttgggccaccaccagctcatggccatctcaaagaaggcgatgccggtggaggcgaaattttccttgagcaggcgtttgcgttccttggcggacttttccgggaagcacagctcaaggttgcgcgccgcgatacggcggcgatcgccggccacgcggtacatgcccgcgcccagcaagcgaccaatggtcaacagcgcccggtacggtaactgggtgaccagccacagcaggccgagccccagccacagcagccaaaaacgcgggtgaagaaatacagctcgaaaacgcgggcgatccattacagattccggtaaagacaagggccgcgcattctacaacggttcgactcggcttgcggcgggtgagtgttctcgttataagtctcgacacttttcgtgacaagccgctttcgccgaccatgagccaaaccgaaccgctagaccaagatcccgtgttccagctgaaaggcagcatgctcgccattaccgtgctggaactggcccgcaacgacctcgatgccctggaccgccaactggctgccaaggtcgccttggcgccgaactttttcaacaatgccccgctggtactggccctggacaaactcccggccggccaaggggcgattgatttgcccgggctgatgcgcgtatgccgctcccatggcttgcgtaccctggcgattcgcgccagccgtatcgaagacattgccgcagccatcgccattgaactgccagtactgccaccgtccggcgcccgtgagcgtccgctcgaaccattggtcggtgaagagaagaaaaaaccggaaaaaccgcccgagcctgcgatcaagccaacaaagatcattacctcgcccgtacgcggcgggcagcagatttacgcccagggtggtgatctcgtggtgatctcctcggtcagcccgggggcggaacttcttgccgatggcaacatccatgtatacggcccgatgcgcggacgcgccctcgccggcatcaagggtgataccaaggcccggattttttgccagcagttgaccgctgagctagtgtccatcgcaggccagtacaaggtttcagaagatttgcgccgtgatccgctgtggggggcttcggtgcaggtcaacctgtcgggcgatgtgttgaacatcatccgtctttaacggatactgccgcattttccaagcatctctagactctgatagcaaagcgaaaccggcaagacttgtgtaggaatatttggaagttggtgtttccctgcggaaactgcatctttttcctacaaaggctgtccgcctgcagcgagttccaagagatgtttttcagggactgaaaagtcctttttccttaggggtgaaacaccttggccaagattctcgtggttacatccggcaagggtggtgtgggtaagaccaccaccagcgccgctatcggtaccggcctcgctctgcgcggccacaagacagtcatcgtcgacttcgacgtcggtttgcgtaacctcgacctgatcatgggctgcgaacgccgcgtggtgtacgacttcgtcaacgtagtcaacggcgaagccaacctgcaacaggccctgatcaaggataagcgccttgaaaacctgtacgtgctggccgccagccagacccgtgacaaggatgcgctgaccaaagagggcgtaggcaaggtcctcgccgagctgaaagaaactttcgaatacgtggtatgcgattccccggccggtatcgagaccggtgctcacctggcgatgtacttcgccgatgaagccatcgtggtgaccaacccggaagtctcctcggtacgtgactcggaccgcatgctcggcctgttggccagcaagtccaagcgcgccgaagaaggccaggacccgatcaaggaacacctgctgctcacccgctacaaccctgagcgcgtcagcaatggcgaaatgctcggcgttgaagacgtgaaggaaatcctcgccgtgaccctgctgggcgtgatcccggaatcccaggccgtgcttaaggcatccaaccagggcgtgccagtgatcctcgacgaccagagcgacgccggccaggcgtacagcgatgccgtggatcgcttgctgggcaagaccgtggaacaccgcttcctcgatgtcaagaagaagggattcttcgagcgtatctttggaggcaactaaacaatgaaatttctcgacttctttcgcgccaacaaaaagccaagtaccgcgtcggtagcgaaagagcgtctacagatcatcgtggcgcacgaacgcggccaacgcagcacgccggactacctgccagccttgcagaaggaactggtcgaggtgatccgcaagtacgtcaatatcggtaacgatgacgtgcatgtcgccctggaaaatgacggcagttgctcgattctggaactcaatatcaccctgcccgatcgttgatcgaaagggcggtcgccacggcggctcggtcaccttgatccctcttcgggagccaggtggtcgagccgccgttggcgtttgttacgaggctgtttaatgccgctgtccaatattcatatcctgcatcaggacgatgccgtcctggtggtgaacaagccgaccctgctgctctcggtgccgggtcgcgccgacgacaacaaggattgcctgattacccgcctgcaggaaaacggttaccccgaagcccgtatcgtccatcggcttgactgggaaacctcggggatcatcctgctggcccgggatgccgacacccaccgcgaactgtcccgccagtttcacgaccgcgaaacagaaaaagcctacaccgccctggcctggggccagccggaactggacagcggcagcatcgacctgcccctgcgctacgacccgccgaccaagccacggcatgtggtggaccacgagttcggcaagcacgccctgaccttctggaaagtgctggagcgttgtggcgactggtgccgcgtggaactgacgccgatcaccgggcgctcgcaccagttgcgtgtgcatatgctgtccatcgggcatccgctgctgggtgatggcttgtatgcccatgaacaagcgttggctgcctggccgcggctgtgcctgcatgcaagcatgctcagtttcacccatccacaaagcggcgagcgcttgcgcttcgagtgccctgccccgttctagaattggcaatacaatcaaaactgtgggagggggcttgctcccgatggcggagtgtcagtcactgtatttgctcactgacacaccgccatcgggagcaagccccctcccacatttgttctgtgcacttctggccatcgaacggtaaactccgcgcattgctgtctggagctatttatgcgcgaagcgttgaatcaaggcctgatcgacttcctcaaggcctcccctactccttttcatgccactgccgccctcgcccaacgcctggaagcggccggttaccagcgtctcgacgagcgcgacacctgggccaccgaggccaacggtcgctattacgtgacccgcaacgactcctcgatcatcgccttcaagctcggccgtcactcgccgctgcagggcggcatccgcctggtcggcgcccacaccgacagcccatgcctgcgggtcaagccccagcctgagctgcaacgccagggtttctggcagttaggggtagaagtctacggcggcgcgctgctggcaccgtggttcgaccgcgacctgtccctggccggccgcgtgaccttccgccgtgacggcaaggtcgaaagccagctgatcgatttcaagctgcccatcgcgatcattcccaacctggccattcacctcaaccgtgaagccaaccaaggctgggcgatcaatgcccagaccgagctgccgccgatcctcgcgcaatttgccggtgacgaacgcgtggacttccgcgccgtactcaccgagcagttggcccgcgagcatgggttgaacgctgatgtggtgctcgactacgagctgagcttctacgacacccaaagtgccgcggtcatcggcctcaatggcgatttcatcgccggtgcgcgcctggacaacctgctgtcgtgctacgccggcctgcaagccttgctgaccagcgagaccgacgaaacctgcgtgctggtgtgcaacgaccacgaagaagtcggctcctgctcggcctgcggcgccgatggcccgatgctggaacagaccctgcgccgcctgttgcccgaaggtgatgagttcgtacgcaccattcagaaatcccttctagtatcggccgacaatgcccacggcatacaccccaactacgccgagaagcatgacgccaaccacggcccgaaactcaacgccggcccggtaatcaaggtcaacagcaaccagcgctacgccaccaacagcgaaaccgccgggttcttccgccacttgtgcatggccgaggaagtgccggtgcagagttttgtagtacgcagcgacatgggttgcggctcgacgattgggcctattaccgccagccacctgggcgtgcgtaccgtggatatcggcttgccgacctttgccatgcactccattcgtgaactgtgcggcagccatgacctggcgcatctggtgaaggtgctgggtgcgttttatgcgagccgcgacctgccctgatttgatgggcgaaatgtgatcgaagtgtgggagcaagtcgaatcgtcgcaccgcccctcccacattgggttctgtgtactgccaaactgacttgcatcacctgcacttcctgcaatcgcgcctagacttgtcaaaacttccactgtgacaaggctattgctcccatgatctcaatgtcctccttccacgccatgctgattcccatcgtgatcggcatgatcatgctcgcggtcggtttcaactttcgcgacaagcccctcggcgtgttcggcatgtggatcggcatgctgttgatcctgggcaccgtggtgtacaagattctcgccaaactggcggaatgataaatgcgctcgcattgggcatagcggcctcgtacactcggtcaattcgtcgttttcaaggttgaccgcctcgtgttctcccgtctgtttgccctgccctgctacctgctgatcgccctgctcacactgctgccgttcacgtccgcccaagccgtaggcttgcccggcatgctgggcggctccagcaagacccaaccccaggccgaagtgccgctggggcagtcgctggacgaggtgatcaagactctggaaaacgatcagcagcgcacccaattgctgagcgacctgaagaaactgcgcgccgctacgcaaaaggcccagcccgccgccgaacaaggcgtgctcggattgatcggcagtacgctgtcgggctttgaacagcagttttccggtgccgacagcccgctggggcgctggtcgaatgaagtcgatctggccaaggatgaactgggtgcgctgatgctgccggccaacgagtggctgccgatcatcttcggctttgccgtgatcctggcggtgtggagtctgctggccgccgcgttgatctggctcagccaccgggtacgcgagcgcttcggcctgcccgaggagttgccgcaacacccgcggacctgggacatgctgcgctttgccctgcgcaagcttgggccctggctgatcgccctggtgatcacggtttacctcagctacgccctgccgtcatccctgggtaaatcactggcgatggtgctggcctatgccttggtgatcggcacctgtttctcggcgatctgcgtgattgccttctccgtgctcgacggcccacaccgccaccgcgccctgtatatcctgcgccaccaggcgttccgcccgttgtggtggatcggcagttttgccgccttcggtgaagccctgagcgacccgcgcctggtcgaggcgctcggccaacaccttgcccataccgcggcgactgtggccaatgtgatggcggcgctgtccacaggcgtatttatcctgcgtttccgccggccgatcgcgcacctgatccgcaaccagccgctatcgcgtcgcctgacccgtcgcgccctcaccgacaccctgtcgatcatcggcaccttctggtacatcccggccttgctgttggtgggtatctcgctgttcgccaccttcctgtcggccggcgacaccagcaccgccctgcgccagtcgctgctgtgcacggtgctgctggtgttgtgcatggtgatcaacggcttggtgcgccgccacgccctcaagccgcaacgcgggcacaagcgccatgcgctgtactccgagcgcctcaaaggctttgtctacaccctggtgcacctggtggtgtggctggtgtttatcgagttggggctgcgggtgtggggcctgtcgatgattcgctttaccgaaggtgacggccatgaaatagccgtgaagctgttcggcctcgcaggcaccttgctgtttgcctggctgatctggatcctcagcgacaccgcgatccaccacgccctgacccgctcacgcaaaggcctggccaacgcgcgtgcgcaaaccatgatgccgctgatccgcaacgtgctgttcgtgaccatcttcatcatcgccgccatcgtggccctggcgaacatgggcatgaacgtcacgccactgctggccggtgcgggcgtgatcggtatcgccatcggctttggtgcgcagtcgctggtagccgacttgatcaccggcttgttcatcattatcgaagactccctggccatcgacgactacgtagacgtcggcggccacctcggcacggtggaaggcctgaccatccgcaccgtgcgcctgcgcgatatcgacggcatcgtgcacaccatcccgttcagcgaaatcaagagcatcaagaactactcccgggagtttggctacgcgatcttccgggtggcgatcccctacaacatggaaatcgacgatgcgatcaagctgatgcgcgatgtcgggcatgccatgcgcaacgacccgctgcaacgccgtaatatctggtcgccgctggagatccagggtgtggaaagcttcgagtccggcagtgcgatcctgcgcgcacgtttcaagaccgcaccaatcaagcagtgggaagtgtcgcgggcgtttaacctgtcgctcaaacgccacctggatgaagccgggctcgacctggcgacaccgcgcttgagtgtgcaggtggtcaccgccggcacggtgcaggagaaagaaccagaacaataaagaaggagaggcttgtatgcgtttgaacggtttgacacatcaatgggtgttcggcttgctctgcggggttgccagcagcgcagtgattgccgccagcagtggtcaggatagcgcccgggaggaaattgccgcccaggcgaagatccttgaaccgagcctgctcgaaacccgccgcgacatccacgcccatccagagctgggcaacgccgaaacccgcaccgcagaattggtcgccaaacagctgcgcgagttgggccttgaggtcaagacgggcgtggcgcgcaccggcgtcgtcgccgtcttgaaaggcgccctgcccggcccgaccgtggctctgcgcgccgacatggatgcgctgccagtcaaggaaatcgccgacctgcccttcgcctccaaggccaagggcacctacctgggcaaggaagtcgacgtgatgcacgcctgcggccacgacgcccataccgctatcctgctgagcactgcgaaaattcttactggcatgcgcgagcgtttgcctggcaccgtggtgttctatttccaaccggccgaagaaggccccagcgacttcagccccgacggcaagaacacctggggcgcgaagatgatggtgcaggaaggcgtgatgaaagcgccgaagccggatgcggtgttcggcctgcatgtgtgggccggcgtaccggccgggcagatcgcctaccgcccgggcccgaccctggccagctccgacgacctgcgcatcaagatcctcggcaaacagacccacgcggggcagccctggaacggcatcgacccgatcaccgtcggcgcacaaaccattgtcggtttgcagaccgtggtcagccgccgcaccaatatttcgtcatcgccctcggtggtgagcatcggcactatcaacggtggcacccgctacaacatcatccccgagtcgctggagatgaccggcaccatccgctcctatgactacggcattcgccagaagctgcatgcagatgtgcgccagaccgtagagaagattgccgaaagcggcggcgccaaggccgaagtgacgatcatcgagaagtacgaccccaccatcaacaacccggcactgaccgagaaaatgctgccgagcctgcgttgggcagcccgggatgacgtggtgcaaggcccgttggtaggaggcgcggaagacttctcgttttatgccaaggaagcgccgggattgttcgtgttcctgggggtaacgccgagggaccaggacatgagcaaggcggcgccgaatcacaacccggggttcttcgtggatgagtcggcgttggtggtgggggtgaggacgctggcgtcgctggcgacggattacctgtacacccacacccccctgtagcagcgagcttgctcgcgaagtacttcagagcgccgcgtttactcagggtgaccgcggcgttcttgcgttcttcgcgagcaagctcgctcctacagggtattgtggtgaatcagttgaccagctcagcgctgtccatcttctggcgcaggctcaacgggcgcatatcggtccacacttgctcgatataggccaggcactctttcttcatgccgctcttgcctacggtgcgccagccttcgggcacggccttgtagtcaggccagatcgaatactgctcttcgtggttgaccactacctgaaacaggatgtcatcgcggtcaaatactgaggtcattgctgttctccgtcgctcaaaggctggctgcgcaccacgcgcagcactgatatctgtagaaacgtatcaagggcctggaaaattagacgccggcaaccgccgccgccaaggcgcgcccgaagatctcggccacttggtcgatttcgccggcggtaatcaccaacggtggcaggaagcgcactacgctgccatggcgcccacccagctccaggatcaggccgcgcttgaggcactcacgctgcaccagcggcgccaactggcgatgcaccggtgggtggccctggacatccggcgtgcctgtcgggtccaccaactccacccccagcatcagcccgcgaccacggatatcccccagttgcgggaagtcgcgctgcaagatgcgcaggtgttccgccagacgttcacccatggccgccgcatgactcgccaggtcgtgttccctgagataacgcatgaccgccgagcccgctgccatcgccatctggttgccccggaacgtaccggcatgggcgcccggcagccaagtgtcgagccattcgcgatacaccaccacagccaacggcaggctgccgccaatggccttggacatgaccaccacgtctgggatgatgccggcgtgttcgaaggcaaacatcttgccggtgcgcccaaagccactctggatttcatcgacgatcagcgccacaccggcctgctcggtgatacgccgcaggccgcgcaaccaatcgaggtctgcaggaattacacccccctcgccctgcaccacctcaacaatcactgccgccggtagcaacacgcccgcctccggatcgttgagcaggttttccaggtaatgcaggttgacctgcacaccttgcgcgccgcccaaaccgaacgggcaacggtagtcatacgggaacggcaggaattgcacgccattgccgagcaacgcgcccaggggttttttcggccccaggctgcccatcaggctcaaggcgccctggctcatgccgtgatagccaccctggaacgacagcacagtgctgcgcccagtggcggtgcgcaccagcttcaatgcagcttctaccgcatcggtgccagtggggccgcagaactggatcttcgcttcccgcgccaattcagagggcagcaagccgaacaggtcctgcacgaactgatccttgaccggcgtggtcaggtcaagggtgtgcagcggcagttcgtcgctcagcacttgccggatggcctggatcaccaccgggtggttatgccccagcgcgagcgtcccggcaccagccaggcagtcgatgaaacgacgcccttcgacgtcttccacataaataccattggcgcgcttgagcgccagagggatgcgccgcgggtagctgcgggcgttggactcctgctggcgctggcggaccagcaacgggttttcgtcgaactgatagagcgtttccgcaggcgccgcggcgtcttcggtacggctggtagcgactgacatctctggatccctcgatacgcgggtgatggtgaccaaactgccgatccgttggcgtctggcccaagggcatgcgcacggatttcctgttctggagacgcatcagcgagatgaggatttagggaacgggctggttaactgatgaatgaagatccaaatgtgggagggggcttgcccccgatagcggtaggtcagtaaaaaatatgctaactgacacactgctatcgggggcaagccccctcccacatttgaacagcgttcgaatcaaattccgcggtatttttcgttcagcgcatacaggatcgcgcaggtctgcgcatccaggacgccgcgataatcctgtgaccgaaagtgcatctggaatgcccgggttcgcagctcgaacgcctggcgattctgcgccggcttatacccatagcgctggaaagcccgctccacctcgacctcgggtggcatcctgacactgaaccggcgctggtacatcgcgcgcgtggcctcatcaaaccaggcccccagccccgcttcatgcaagcgacaccaggggaaccgcggccccggatcactcttgcgccaatacgccacgtccgcgtgaccgacgatgtcagtggcggtgatctgcggatagcgtccaaggatgtctcggatcaaggcaatgagcatatcgacctgcgcgttgggatacgccggaaaattgaatacgcccttgtcgtcgcgcgccaggttgacgatctcgatgccaatcgaccggctgttgaggttgtcaatcccgtcccagtcgctcacccccgcatgccaggcacgcttgtcctcatccaccaggcggaacacgcgcaactcttcataaccggcagcacggtaactgggctcatccgggtcgggcaacaaatagtgagcgctcacgccaccctgggtcagggtgcgcaaggccgaggcaaagggcccggcggtgtaatgcaggatcacctgccgcacgctttcgccgtcgcggtcattgaaatccctggcaggaaaactggtatcgattaccaacataaaaagagccgtccttttcatttcggaccgaatcattcggcccgttcaagcgcaaaaaattaccgccatcctgaaggtgtcaatgtcaggcaggcggtaattatttggcacgtgaaaaaacgattcagcgacgcagcggcatgcccaggtcaacccgcagcccatcgggctggctgtcgaatgccaacgagcaggagcagcgctgcacaatcgcctggacgatcgccaggcccaggccacagccttcgctgttgccgttgcgccagaaacgctgggtgaggcattgcaggtcttcgctggagatctgcttgccatggtcacgcacgcgaaacagcacctgatcgacactgctggacacgctcaactccacccgggtatcggccggagtgtggcgcaaggcgttgtccagcaagttgcgcaaggccgcgacagccaggcccacgggcatctccaccgggctggcggcaagatcgtgggccaggaccaggtcgatccgacgattgtcgccagcgttggcatcctggatcgccaacctggcgacttcctcggcactggactgcaagccgtcgtcaaacgacaggctgccttccacccgcgccagcagcaataactgctccagggtgcgatgcaagcggtcggcgccttcctcggcgtgggccagggactggtcgcgggccgcaccctcggtcatgcgcgccacttgcaggtgggtcttgatcgccgtcagcggactgcgcagctcatgggcggcatcaccggtaaggcggcgctcgcgctcaatagtcttggcgatgcgttgcaacagttggttctgggtgtcgagcagcggcttgagctcgctgggtaacggatggatctgcagcggttcgagagagtccgcactgcggcgcatcaaggcgtcacgcatgcggttgagcggcaccaggctttggccgatgcccagccacaacaggcacaggcaacccagcaaggccacgccgacgggcaccgaggcggcgagcaggatcgacaggttcagcgcctcgcgctccacctggcggtcggcggtggtgatcagcaagtcgccacgggacaaggtgaaagtgcgccagcccacgccatcgatcatctgatcgcgaaaaccgctcctgcgcgactccagcccttcctcaggcgtggtgtggctgcgcgccaggatctcgccgcgcagcgagctgacctggcacgccatgcctcccggcacattcagctgttcggtgcgcagatgtgcgccaccgctgacactggccaaccccggcatctgctcggtcagccccgccaccatgcgcgccgaggccaccaggcgctggtcgagggagaacatcatctggttgcgcaaatcgttgagcatccaggcggccgccagcacccagatcagcacaaaggcggcgcccagcttgaacgtcaggcgcaggcgcaggctcttcacttgctgttctctccagcatccgccgggcccaggcgatagccaaggccgcgcacggtctcgacgatgccgttgcccaatttgcgccgcaggtgatggatatgcacattgagcgcattgctttccagttcgtcgctgaacccgtagacgctgtccttgagctgctcgctggacagcacgcggcccttgttgtgcagcagcgcctgcaacagcgcctgttcgcgacgtgacaggtccaccggctggccacccaggaaggtttcacggctgctggggtcgtaggccagtcgcccgtgttcgatcaggttgacgctgcgccccgccacccggcgcaacagggtttgcaggcgggcggcgagttcgcgcaggtcgaagggcttgagcaggtagtcatcggcgccggcttgcaaaccatcgacgcggttggtcaccgagtcccgcgccgtgaggatcagcaccggaatctccaggccttggctgcgctgttgttgcagcagcttgaggccgtcttcgtccggaaggccgaggtcgagcaccatgatgtcgaaggccgccgccttgagcatcgcccgcgcagcgccagccgtggccacgcgctccacggtaaaaccctgggcggtgaggccggccacgatgccgctggcgatcagttcgtcgtcttcgcagaccagtacgtgcatgctgagcccttcataaaagatgcgggtgattagaaaaggcacggattaagcgcgcattatgcggtcaaagttcacaacatcagattttccctacactctagaatagcgtccggttaatcatcggttaatcagcgccacacattgtgtgcctcacttgcatcgaactaaggcttgaccatgcggcatctgtttatctttctgctggtgttgttcgcgggattcgcccaggcagcgccgggtaaccccttcgaaaccaaacctgattttctcccggtgggcaaggccttcacttttacctccgaacgtcttgaaagtggcgaaacccaactgtattggcagattgccgacggttactatctgtaccagcagcgcatgaagttcgagggtttggccgagcaaccggtactgccccagggtgaagcccatagcgatgagttcttcggcgagcagcaggtatatcgccaaggcctggaagtgaagatccccgccggcgccaccggccaggtcaagctgggctggcagggctgtgccgatgcgggcctgtgttatccgccgcaatcgattaccgtggacctgggcggcaacccggccgtcgccgctaccgcgcaggcccaggaccaaagcctggccagcggcttgcaacagcgcagcctgggctggagcctgctggtgttctttggcctgggcctgctgctggcgtttgcgccctgctcgctgccaatgctgccgattcttgccggcctggtggttggcagtggcgccagcccccggcgcggctttgccttggccggcagctacgtggtgtgcatggcgctggtgtacgcggccctgggggtgatggccgcgttgctcggcgccaacctcgccgcgttactgcagaccccttggatcctcggcagttttgccgcattgttcgtgatcctcgccttgccgatgttcggcttcttcgaactgcaactgcccgccttcctgcgtgaccgcctcgacaacgtcagccgccagcaaagcggcggcagcctggtgggtgccggcattctcggcgcgttgtccggcctgctggtgggcccgtgcatgactgcgcccctggccggcgccctgctgtatatcgcccaaagtggcaatgcgctgcacggtggcctgatcctgttcgccatgggtatcggtatcggcattccgctgttattgctggtcaccgtgggcaatcgcttcctgcccaagccgggcacttggatgaacgtgctcaagggcatcttcggcttcctgttcctgggcaccgccgtgctgatgattcgcccggtggtcggcgacagcctgtggatcggcctgtggggcgccttggccctggtaatggcctattgcggctggacgctggcccgtgagtccggcccggcagccaaggtgtgtggcgcaggctccctggtactgggcctgtggggcgcggtactggtggtgggcgcggccggtggcagcgatgagttgtggcaaccgttgaaggtctacagcggctcgcgggtcgccgatgcgccgagcgcccacgacgcgttcaccaccctcaacgacccgggcgcgctgcaaagccagctcgaaagtgccaaggcccagggccaatgggtactgctggactactacgccgactggtgcgtgtcgtgcaagatcatggagaaacaggtattcggtaaacccgaagtgatggacgcactgaaaggcgtgcgcctgctgcgcctggacgtcaccgccgacaacgccgccagccgcgaactgctgggccgctacaaggtgccggggccaccgagcttcgtgtggatcggcccggacggtgacgaacgccgtgcccagcgcatcaccggcgaagtggatgccgctgccttcctgcaacgctggacccagacgcgggacgctctctgatgctgactttcaccatcggcaccttcgccatcgccctgaatcacctgctgctgatcagcgcgttgatgctcgccaccctggtgggctggcgggtggccaagcgtggcggtgagaacccggagtcggtgctgttcagcctgttcctgctgggcctgctcgccgcccgcgtcagctttgtgctgatgtactggagttattacagcgacgactgggtcgagatggtcgacctgcgtgacggtggctttctcgcctggcccgggatcatcacgctgattatcggctcgctggtctacggctggcgtcgcccggccctgcgcaagccgctcagcgccggggtgatcactggcctgctgttctggggcatgaccagcctgtccctcagcgtctacgaaaaaggcacgcgcctgccggatatcaccttgcgcaatgccaacggcgaagtggtgcaactggcggactaccagggcggcccgctggtgatcaacctgtgggccacctggtgcccgccgtgccgccgcgaaatgccggtgctggaaaacgcccagcgcatgcgcccggacgtgaccttcctgttcgtcaaccaggccgaaagcatgcaaagcgtcagcacctacctggccacccagggcctgaacctcgacaatgtgctgttcgacgccagcggccgcctcggccaggccgtgggctccatggccctgccgaccacgctgttctaccaagccgatgggcgcctgatcaacagccacctgggcgaactctccgatgccagcctggcccgtgccatggaacccttcgacaacacccagacaaggaaaccgacatgcctcgcctccgccacctgctgaccctgctgcctttgaccttcttgtcactcagcgcaaccgtcaccctggcccaggccgaagactggccggcaccgatcaagcagatcgaagccaagggcgccaagatcctcggcaagttcgacgcccccagcggcctcaccggctacgccgcccagtaccagaaccgtggcatggccctgtacctgacggccgacggcaagaacgtgatcgccggcagcctctacgacgcccaaggcaatgacctgagcagcgcgcccctggaaaaactggtgtacgcgccgatggccaaggaagtctgggccaagatggaaaaaagcagctggatccaggacggcgataaaaacgcgccgcgcaccgtctacctgttcagcgaccccaactgcccctactgcaacatgttctgggaacaggcccgcccatgggtcaaggccggcaaagtgcagttgcgccacatcatggtcggcatcatccgcgaagacagcccgggcaaatccgccgccctgctcgccgccaaggacccacagaaggccttgcaggaacacgaagccgccggcaagggcagccagctcaaggccatggagaagatcccggccgatgtcgaggccaagctcgatgccaatatgaagttgatggatgaactggagttgtcggcgacgccagcgattttctatctggatgataaaggcgggttgcagcagcagcagggggcgccgtcgccggataagttggtgaagatactcgggccgaaataagcgctgcctgaactgacgccatcgggagcaagcccctcccacactttgaactgtaaacacattcaaaaatgtgggaggaggcttggctggtaacgactattacaagccctccagctccgccatcagatcactcaaccggtccaccttctcggcactgatctcgttagccgccaacccgtcgatatactcggccaattccgccaccgtgctgcattcgaacatcgctcgcaacggcacatcgcgctgcagggttttctgcacccgcgaggcgatctgcgtagccagcaacgagtgcccgcccagttcgaagaagttgtcctgtaccccaacccgctcaaccttcaacacctcggcccaaatcccggccagggtggtttccagttcattgcgcggcgccaggtagtcctggctgtgcagttggccgatctccagggccggcaaagccttgcggtcgagcttgccgttggcgttgagtggcaggctctcaagccagagccagtgcagcggcaccatgtattccggcagttcggcccgcaggcgttgcttgatgcggtccaggcgctcgctcgggttgagcgttgcaccggcggccaccaggtagccgaccagatgcttgccattgacgccctcttgcacccccaccgccgcatcgcgcacttcgggctgttcgtgcagacgcgcttcgatttcacccagttcgatgcggtagccgcgaatcttcacctgatggtcgatacgcccgacgtactccagcacaccgtcactgcgacgccgtgccaggtcgccggtgcggtagagacgctcgcccggcgcaccaaatgggttgggcacaaaggcctgggcggtgcgcagcggatcgctgacgtatccgcggccgacaccggtgccggcgacgcacagttcaccgaccgcgccctggggcaccaactcaagtgcaccatcgagcaggtacaaacggttgttgtcggtcggtgtgccaatcggcaggtaagtgccacgggtcgaggccagatcgacgcggaagaacgccacatcgtccgagcactccgccgggccgtaggcattgaccaggccaatctgcgggtaacgcaacagccactggtgggccaactcgggtggcatcgcctccccggtcggcagcatccagcgcaggccgtcgaggctgatgtgctcctgggccaacatgccctggatcagcgacggcacactctccagcaccgtgatgccgtgggcttgaacatgttccaacaaaccttgcggatcgtgggcaagggcgttcggcacaatatccacccgcgcaccaaacagtggcgcggcgaggaactgccagacggaaatgtcgaaactttgcgaagcggtctgggcgatcacgtccgcatcagtcagatccaggtacggcaccttgctcaactggttattgagcatgccgcgctgttcgaccatcacgcccttgggcaggccggtggagcccgaggtatagatcacgtaggcgaggttgtcggggccgctgtagacacctgggttctcaccacgggcgggcacttcctcccacaccagcaactggcaatcaacaccttcgagcaactcgatggcctgttcgcggcacgcctcggtgcacaccagcaacggtgtgcggctcaagtcgatgattcgactcagacgttgactaggaagacccgggtccagcggcaagtaaccggcaccggccttgaagctgccgatgatcatgcccaacaggtcgaggttacgctcagccagcaacgccaccggttgatccaggccgacacccgccgcgatcagcgcgtggcccaggccgttactgcggcggttcagctcgtcgtagctccattgctggtcgaggcagctggcggcgatacgttgcggatgttgcgccacctgttcttcgaacaactcaacgtagctgcgttccagcggatagctacgctcgctctggttgcagccgtccacgaggaattcacgctcctgctcaccaatcagcgccagctcggccatgtcaccatggaagccctgcatcagcgccagcagcaggcgcttgaattcgccgagcatgccttgcacggtgctttcgtcgaaatagcgctggtcataagacaggtgtaagccgaggtcatcgcccggataacacacggcagtcagcgggaagttggtgtgggtacgcccggaatcggacgtagcattcaggctctgcgcacggtccagcaccgagacttccaccggcgcgttctcgaacacgaacaggctgtcgaacaacggctggcccttgggcaactcgctgtgttcctggatagtcaccagcggcaggtattcgtactcgcgcagctgcatgttgctgtcgagcaagccgctcaaccactggcgcacgctgcaacgctggtcatcctcaggcagcttcacccgcaacgcgatgctgttgataaacaggccgacagtgcgttgcatctgcggcatgtctaccggacgcccggccacggtgacgccgaacagcacgtcacgctcgccgctcaaacgccgcagcaccaaggcccaggccgcctgggcgaaggtgttgacggtgagctggtgggcctgggccaattcacgcaattgcgcaccgtcacaggcatcaagacgggtgtggcaatcacccaccaccatgccgccgctgccaccggcatgttcgcgcaggaacgggcggtcgctcgggatcggtgtggtgcgctcgaaaccttgcaggttgcgctgccaccattggcgcgcctcatccaggtcctggcgttgcagccaggcaatgtagtcgcggtagcgcggcggcgtcgccagttgcgcgtcgcggccctcgcccagggccgtgtagatatcgaagaagtcattcatcagcagcgaacggcaccaggcatcgatcaggatgtggtggttgctcatcatgaaccagtagcgcgactcgcccacacggatcaggcgcaggtggaaaggcgcctggttgagcaggtcgaaaccggcttcgcgttcggccttgagcaaggcttgcaggcgcggctcctgctcggcttcggggtcggcgctccagtccaggtactcaatcggcgtgctgccgggtttgtggatcacttgcagcatgtcttcgccgacgttccagcagaacgacgcgcgcaaggcttcatgccgggcgatcaccgcttgccaggcctgggcgaaacgctcggggtccagggcgctgttgatgcggtagcggtcctgcatgtaatacaggccagtgcccggttccagcagggtgtgcagcagcaggccctcttgcatcggggtcagcgggtagacgtcttcgatggcgcaggccggcaccggcaaggcatccagttgcgcctgcgtcagacgggccagggggaagtccgacggcgtgaggccgccggcatcatcctgcaggcaatgggcgatcaagctgtgcaattcggccaggtaagcctcggccagatcgcgaatcacctgttgatcatgacgctcacggctgaaggtccaacgcagcaccagctcaccgccatacacctggccgtcgacgctcaactcattgggcaacggcgcatcaggatcatgggccaggccggcggactcctccagcggatggaacagtgcgtcggagccaaagctctggtcgaactggccaagatagttgaaggtaatcggcgcgctcggcagtgcggccatgctctgtttgcacaggtcatcgcccaggtagcgcagcaccccataacccaagcctttgtgcggcagggcgcgcagttgttccttgatcgccttgatcgagtcgccctgcccggcctgcggtgtcaggcgcagcggataggcactggtaaaccagccgacgctgcgggtcaggtcaatgtcatcgaacagggtttcgcggccatgaccttccagttggaccaatgccgagtcgtgcccgctccagcggcacagcacgcgggccagggcggtcagcagcagatcgttgacctgggtgcgataggcgctcggcgcctgttgcagcaactggcgggtgtgttcggcgtccaggcgcacgctgacggtctcggcatcgcgattacgccgtgcaccttgtgggcgctgcaccggcaaggccacggccgggccggccaactgcgcctgccagacgctcaactcttcgcgcagggattcgctatgggcataggcctgcaagcgcgccgcccaatcgcgcaacgcgctggtcttggccggcaggctgacagattggccttcactaagttggcggtagacgttttgcaggtcttccagcaacacacgccaggacacgccatccaccaccaggtgatggatcgcgatcagcaagcgttgctggccttgcggcccgtccaccaacagggcacgcaacaacggcccgtgttccagatcgaggctacgctgggtgtcggtgaacagtgcggtgcactgttgcatatcacccacctgggcctgcatcagcacgccgccttccggcacggccaggtgttcggcgtgccactgcgcgtcgcgccgggtgaagctcaggcgcagggcatcgtggtgttccagcaccgccagcagggcttgctccaggcgatgggggtcgagcagttgcaggggcttgagcaccaacgcctggttccagtgctggcgtgccgggatgtcagtgtcgaagaaccagtgctggatcggcgtgagccccgagctgccggtcaatacaccttgctcggcggtgacctgctccgaacgagtggcgacggcggccagggtctctacggtctggtgctggaacagatcgcgggggctgaaatgaatcccggcctggcgtgcacggctgaccacttggatcgacaggatcgagtcgccgcccaactcaaagaaattatcgtcgaggccgacttgctgcacgttcaacaccgcgcaccagatcgccgccagggtgctttcaagcgcgttgcgtggtgccacgtagtgttgacgattggcctgcggatccggctcaggcaaggcgcggcggtcgagcttgccgttggcggtcagcggcatgctgtccagcacgatcaaatgcgctggcaccatatagtccggcagttgcgccttgaggtgcgccttcagcgcttcgcgcagcgcgccgtgttcggcgtcgctgaccaggtaggccaccagctgtttgccactcggcgcatccagcgccaacaccaccgcctcgcgcacgtcgggatgttccagcaggcgcgtttcgatctcgcccagctcgatgcggaaaccgcggatcttcacctgatggtcgatgcgccccaggtattccaccaggccatcggcgcgttggcgcaccaggtcgccggtgcggtaaagacgcccgccattggcggcaaacgggtcggcgacaaaacgctccgccgtcatgcccgggcggcggtgataaccctgggccaggccggcgccgccgatatacaactcaccgctggcgccttggggcaccagcgccaggtcggcgtcgagaatgtaggccacgcgcgcaccgatgatgctgccaatcggcacgctgccggcgccctcctccaactgctgcggcgccaggctggccaagggcatcaccaccgtttcggtcgggccataagcgttgaaaaacacctcgggcatgaacgccgcccggatgcgctgcaggtgctccccggtcaatgcctcgccaccggtgatacacatgcgcaccggcaaggtctgctgctgggtcgccagccactgggccaactggctgccgtagctgggggtgaaaccgaggatattgatgcgatgggtgcgaatcagtgtgcagatctcttcggcatcccactgcccctgggcgcgcagcaccacctgcgcaccactgagcagcggcaccagcaaacgctcggtggcggcatcgaagttgatcgaatagaagtgcagctcgcaatcatcggcacgcatgccaaaccgctcgatcaccgcctggcaatgcatggcgatttcagcgtgggacaccaccacgcctttgggcttgccggtggagcccgaggtgtagatcaggtacgcctggtgttgtggcaggctgacaaagggcagcgtgtcggccgggtaattcgccagcaccggcaggtcatcttccaggcaccagcacgccaccgtcgccggcaattcgccgagggcttcgaacatcgccgcatcactgagcagcaggccgatgccgctgtcctcgatcatgtagtgcaggcggtccagcgggtattccgggtccagtggcacgtaggcgccaccggccttgaggatcgccagcaggccaatgaccatttccagcgagcgcggcagcgccaggccgacacgcacctgcgggcccacgccacgttcgcgcagcatccaggccaggcggttggcgcgggcgtccagctcagcgtaagtcagggtcaccccggcaaaggtcagcgctggggcatcggctcgctggctggcctgctggctgaacaactgatggatgcactggtcgaggcgatgctcgcccttttcaaccccgaggctgtcttgcagcgcacgctgttcatctgcgctcagcaacggcaattcgctgaggcgctgttgcggattggcgatcaagccttccaaaaggttgcgccaatgctcggccatgcgcgcaatgcgcggctcgtcgaacaggtcggtgctgtaggtcaggcagcagcccaggcgatgatcgaggtcggtgacttccaggttgaggtcgaacttggtcgcccgtgcatcgttggccaggtactcgacggtcatgcccgccagttggcggcgctgctggaactcccagcgctgcacgttgcacatcacctggaacaacgggttgtacgccgcgctgcgcggcggttgcagggcttcgaccagatggtcgaacggcaggtcctgatgggactggccctcgatcaccgtatgacggacttgctcgaacagctgggcgacactcatctgcccattgagctggcaacgcagcacctgggtattgaggaacgcgccgatcagcccttcgctttccgggcgaatgcggttggccaccggggcgccgatgcgcaggtcggtctggccgctgtagcggtaaagcaacacggccagggtcgcggtcatggtcatgaacagggtcaggccgcgctcggcattgaaggcgcgcacacgggcggccaactcatcactcaggtcgaagcggtacagctcgccctggtggctttgtaccgctggccttgggcggtcgccgggcagctccagcaacgggtgttcagtgcccagttgcgcggtccagtaatccagctggcgctggcgctcgccggactccagccactggcgctgccacacgctgtagtcgaggtactgcaccggcagcggcgccagcggcgagtcgcgttcgtcgataaaagcttcgtacaaggcgctgagttcacgggcaaagatgtccatggcccagccttcggtgacgatatggtgcaaggtcagcaccaggtagtgttcctgctcgccggccttgaccaggcaggcccgcaacagcggcccggtttccaggttgaacggcgtgtgcgcttcttgatccgccagttgttgcaaacgctgttgacgctcggtttcgctcagcgccgagaagtcctgccagtccatgcgcacagcagtctgcggcgaaaccttctggtatgccacgccgtcgacgctcgggaaggtggtgcgcagggtttcgtggcgcatgatcaacgcctgcaacgccgcctcgaaacgccccacatccagcacaccacgcaaacgcgccataccgccgacgttgtaggccgggctgtcgggctccatctgccagaggaaccacatgcgctgctgggaataggacagcggcaccggttggctgcggtcgaccttggcgattgccgtttgttggttgcgttggcccgcggcctggatcagccctacctgctcgacaaaggcgcccaactcgctggcttcgaacaaggtgcgcaacggcagctcgacgtcacacgcctggcgggtgcgcgagatgatttgcgtggccagcaacgagtgcccgcccaaagcgaagaagtcatcgcccaggccgatgcgtggcaggccgaggacctcgcgccaaatcgcggcgatttgcagctgcaacgctgtgtgcggttcgatgtgttcgcgggtttgccagacaggctccggcaaggcgcggcgatcaagcttgccgctcgggctcaggggcatggcatccaggcgcatcagcagcgccggcaccatgtattccggcaactcggcggccagggtggtcctgacttgctgttcgtccagtgcgctgtgggcagtgtagtaaccaatcaactgcgcatcgcgtaccagcaccacggcttgggcgatgccatcgagggccagcagccgcgcttgaatttcttctggctccacacggaaaccacgcagtttgacctgctgatccagacgcccgaggtattcaagtacgccatcggcattccagcgcgcacggtcaccggtgcgatacaggcgtgtgcccgccgcgcccaaggggtccgcgataaagcgttcagcggtcaagccggcacggccaaggtaaccgcgggccaggccgatgccgccgatgcacaactcgcccggcacaccggccggcaacgggttgagctgctcgtcgagcacgcggcagatcacattgcccaagggccgaccaatcggcgagcgctcgccatcggcggcggtgcaatgccaatgggtgacgttgatcgccgtctcggtggggccataacggttatgcaattgcaccgcaggcagctgggccaggacgcgattacgcaactcggcgggcaaggcttcgccaccggagaacaggcggcgcaggctggtacattcggccaccaacggctcgtcgataaacacctgcaacagcggcggcacgaagtgcagcgtggtcacgccatgttcctgcaccaactgcgcgatgcgctgcgggtcgcggtgctcacccggccccgccagcaccaggcggcaaccggtgatcagcggccagaagcactcccacactgacacgtcgaaactgatcggcgccttttgcatcagcacgtcggtttcattcagttggtaagtggcctgcatccactgcaaacgttcggccagcgcgccatgggtgttgcccacgcccttgggttggccggtggaaccggaggtatagatcacgtaggcaaggttgtcgccatgcaggtgcaggcccggtgcctgggttggccagctgtcgaggtgcaggctgtccatggcgatcacgcatacgccttcggcagtcggcaactgcgccagcaacgccgtttgggtcagcagcaggtgcacgccgctgtccttgagcatgtaggccaggcgctcggcggggtaatccgggtcgagcggcacgtaggcaccaccggccttgatgatcgccagcaggccgaccagcaattgcggcgaacgctcggcggcgatggccacgcacacgtccgggccgacgcccttgtcgcgcaagtaatgggccaggcgattggcctgggtgtgcagttgggcgaaggtcaggctgccgtcctgccagaccagcgcggtggcgtccgagacctgttgattgagcaggtcgggcagccattgccgggccggttcacaaggtgctgcgctccaggcgtgctgttcgtcggccagcatcaacggcaggtcgccgagggcttgctggggttgcgcgcacacagcttgcagcaggtggatgaaatgctcggccatgcgctggatggtcgcggtctcgaacagctcgtcggcgtagtcaaacgacaggctcaagcgcccgttgcggtcttcttcgctgtgcaattgcaggtcgaacttggcttcgcggctgtgccatggcagttcatcggcgagcaggcccggcaggcgacgcaaggcgctgaggtcacgttgctggtggttgaacatcacctggaacaggccctgttcgcgggcctgggggaaggcttccagcagttgttcgaaaggcaggtcctgatgggcctgggcggccattgccgtctcgcgcgtgatcgccaacagctggttgaacggcaggcgcccatccagttcggcacgcagcaccagggtgttgataaagaacccgatcaggccctgggtttcatggcgcgggcggttggcactgggcacgccgatgcggatatcgcgctgcccgctgtagcgataaagcagggtctggaacgccgccaacaacagcatgaacggcgtcgactcgtgggcctgggcggtctggcgaatcgcggcgctgaggcgcgcatccaggcgcacgctatggcgcgaagcactgtgccgatggagcgcggaacgcgggtgatcggtggccaggtccaaggcaggatgctcttcacccaactgcgttttccaatacgccagttgtcgctggccctcgccttcggccaaccattggcgctgccaactgccgtagtcggcgtagtgcaagctcaacggcggcagctccaggctctggccttggacggcagcggcgtacagccgtgagaattcgtcgatgaggatattcagcgaccaaccatcagcgatgatgtggtgcagcgtcaccagcagttgatggtcttcatcatccaggcgtagcagggtgacccacagcagcgggcctttttccaggtcaaactgggtatgcgcctcgtcttcgcggatctgttgcgcacgagcttcgcgctcggcgtgcggcaggtcgctgaggtcgatgacttgcagcgcgaaatccacctgcggttctacacgctggaaggcttgcccatcgcgttcgtaaaagcgtgtgcgcagggcctcgtgacgctggatcaggtgctggaagcttgagcgcagcgcgtcttcatccagctcgccgcgcaggtgcaaggcgccgggaatggtgtaggcgctgctgtgtgggtccagttgccaggtgatccacagacggttctgggccagggattggggcaggtcttcgtggcgcgacagcgcatggatcgcgccctgggcaacgccgccgtcctgttgcagttgcgccacgccggcggcaaacgctgacaacgtgggggcttcgaacagcaggcccaggttcagctccaggcccagggtttcgcgcaggcgggcgaccacctgggtggcggtgatggagttgccgccaagcaggaagaagtgatcgtcggcggccacgctggtcagttgcagttgctcacaccagatcgccgcgatctggttgtgcaggccagactccagcgccacctcgctcgcctgcgttggcaagccggggaattgcgcgtagctgtcgaggctgccatcggcgtggcgaatcgcgcacgccgagcgctgcaccttgccgctggaggtcttcggcaaggcaccggggttgagcaacaccactacgctcggggcttcttgataagcctcggccacggcttggcggatcgccttgatcagcgcttcgggtggcaggattttctgcacgctgcggctgatttccgccgcgataccgatgccttccacacccaggtcattcaccgcaaaggcggcgacccggcccttgcgcaccacttccacctcgcgctcgatggtctgttcgatgtcctgggggtagaggttgtgaccacgcacaatcagcaggtctttgaggcgaccagtgatgtacacctcgccgtcgcggataaaacccaggtcacccgtacgcaaccaagtgcgcccagcgtgctggacgaaggtcctggcgctggcttctgggttgcgccagtagccgtgggcgatgctcgggcccgtggcccagagttcaccgatgctgttgtcggcaagctccatgaggctgtggggatcggcgatcagcacggcgtggtccggctggctggtgccacaactcatgatcgcactgccctgcccgggttccgcgcggttggcggccagggcctgttcgtccatgtgcatcgcggggatgccgcggccacggatgccgccggcaacaaacagggtcgcttcggccaggccgtaggaggcaaagaaactgttcgaggtgaaaccgcaaggggcgaatttttctgcgaagcgttccagggtatcgaggcgaatcggctcagagccggaataggccacgcgccagcggctcaagtccaggcgctccagggccgattcactgacccgttcgctgcacaggcggtaggcgaaatccgggccgccgctgatggtgccgccgtattcgctgatcgcttccagccaacgcgatgggcgcccgaggaagtaggccggcgacatcaacacgcagggcacgccactgaaaatgggttgcagcaggccgccgatcaggcccatgtcgtggtagagcggcagccagctgacgatcacgtcatcagggttgaggtcgatgccgaaaccacgtcgaatcaatacttcgttggcgaccaggttgccgtggctgacctgcacgcccttgggcaaggcggtagagccggaggtgtattgcaggaaggcgatgtcgtcagcttgcagctcgggctcgagccagtgctcggcctgctgtgcatccaggctgtccacgctcaataccggcggtgcattttcgatctgcgccaggccttcgctgagactggcaatggtcaatagcaggcgtggctcggcgtcctggatgatcgacagcaaacgctcctggtgatgacggcgcgtggactccggcggataagccggcaccgcgatcaccccggcgtacaggcaaccaaaaaacgccgcgacgtagtccgggccgctggggaacagcagcaccgcacgctcgcccgggccggcattggcttgcaaggcggcggcgatggtgcgggcgcgcaggtccagatcacggtagctgagcaccacgctgtgctcggtcgactcggccaggaagcgcagagccacctggtccggtgtctgcgcagctcggcgttgaagggactggaccaaagtgcgggggagttcgaaggcgtccatcatggggttcctgcctgaaatcggcttacgggaaattcggcttgcttgaaaatcaataacggcgagcaatcagaccgcgagccgttgccgcgccgcgtcgatgcgccagcgcgccaggtgttcgtcggcatagcggcgcacacaacgcagcacggcgctttcgtgctgcacgaggaagaagtggtggccgtcaaacatgtccagggaaaaaccgctggcggtgtcgagctgccagtcgagcagctgatcggcgcgcacgctgtcctgcttgccgccgaacacatggatcggcagccccaggggcttgcgctcgccataggtgaagctgccgcacaacaggaagtcagcgcgcaaaatcggcagcatcaactgcatcaactccgggttggccagcgcttcttcagctgtgccctgcaattggcgcaagcgggcgatcagttcggcatcgtttttttcgatggcgtattcactgacatcgcgtcgcgccggcccggcggtgccggaagcaaacagcgccaggggcgccggcacatcgcgcgcactcaaggcatgggccaattcaaaggccagcaacccgccaaggctgtggccaaacagagcgtaggggccgtcgaggtcgcggctgatttcctcggccaactgtgccgcaagggccttgatatcgcgctgcaacggctcatccatgcgcaggccgcgcccaggcaattccagcgggcacacctgcagccaatccggcagggcgcgacgccagcgagcgtaaaccgaggcgctggcgcctgagtggggcaggcaaaacaagcgcagccggattggcgtactcatgaggcgaggactccaaactgcaacatgccgattgcacgataaaaacccatctggtcctcctgcgggtgctgatccttggccgtttgttaacaggcctgtcacccagaagaacggacggccccggcaaataattagtcgcaggcggcgagcgagacgtggttcacaccttccacaaaggcataagattagttcgccttctcatttgacaatcattatcattcagcataatttgttgcccgatgtgtaggaggcctcagcagggacgccctcccctaacctaatagcagtaaggtgatttccatgacggaacaagtatccacaggcaggtgcgactcaccccttctccaggcgtttgtcgacaatcggctgatgttggtgaagatcgcggcacgtatcaccggttgccgctcccgcgccgaagatgtggttcaagacgcctacttccgactgcagtctgcgccaaccatcacttcatcgttcaaggcccagctgagctacctgttccagatcgtgcgcaacctggccatcgatcactaccgcaagcaggccctggagctcaaatactccgggaccgaagaggaaggcttgaatgtggttattcacggcgcttcgccggaaacctcccacatcaatttcaacactctggaaaacatcgccgacgccctgacgcaactgccccaacgcacccgctacgcgttcgaaatgtaccgcctgcacggcgtgccgcagaaggacattgccaaggaactcggggtttcgccgacgttggtgaatttcatgattcgcgatgcgttggtgcattgccgcaaggtgtcaggcagccatagcgatacgtttgcgcgcagggtttgaacgcggcgcaaacacatgtggaaggagcggcgcggggattcaactggtctctgataacagatgtcgaactcgatcaatgtgggagggggcttgcccccgaagacgtcagcccagcaaacattgacgttggctgacccaccgctatcgggagcaagccccctcccacaggggatctgcgcttaactgaccggcatcagggcttgccccggtgagcatgggtatcaacacaactctgacgtaacgaccgtcagtaaccacgatgcgaagcgagccgctcttgatcttgcttttgatctgaggcgccccgttaaaccacgctggccgcaattcgacagggatttggggggtaaaccggcagggatgccggtttagccgccccgcgccatggatggcgcgtggcggcggccccccaaatccctgtcggattacgggcacaccgagcctaagcgaggtgccgagtggtggggcaagagcgttttggttacttttgcgcttttcaaaagtgacccgctgtaagagcggaaccaatagcggccgttacctaaacaatggatatgtacacggtccaacatcctcgtcagccgcaaggccgccatcgggagcaagccccctcccacattttgttgccctgagatctcagggcagcggtgttacatcaatgcgatacggctcaaagatcttcagcatctggccattgtcccgcagtcccttgagcaatgctgaaaacgcatcacccgtgatcggtgccttgggacgcagcaacgcgtaatggtgatacacctggtcaatgcgctccgacaccaggaactgcctggccatgctctcgttgcgcaccatgaaatcactcaggtaagaacgggtgaccagcgcgatatccgcacgcccacgcgccaccatcagcaagttgctgtcatgggaataggtcaacgtggcgttgaagtgttcggccatgtttttggggtcggggttgaagttggcgaaggcgtagtgatagccgctgaataccgccaggcgtttgccggagagatcggcgaagtaactctggtcgcgcccgacctggcgttgggcgacgaagatttctgcgtcctccaggcccatgtcgacgctggtatgggcaatctcccgccagccccacgacgggttttcgaagatcgccatatcgacccgaccttgctcgaagtcgcgaaaacgccgggggatagaggtgggtaccagtacaaactgatagtcggtttgctcagcgttcagcgcctcgagcaattgcggcagcaaaccggtgtctgccccttgctcgggacgcacggtgtagggcggaaagtgcgccgcacccactctcaccaattgcgcagcgcccgcctgcgtccacgcggcgctgctcagtgcccataatgtcaatcctgcagccagccgccatggcgaaaacatcgaggcacacaccgttgaattctttgatgccgataagctaggcgtttttatccggagagacaactttcgccatcaaatttaataacttgcgcctcagtctgacttaagcaccatcagcaacgcctcttcagccaactgctcaagggtcaagctgccctgggcgcggaaccaggtggtggtccaggacagcgcgccagtgaggaagcgccgggtgataaacacgtcgcccttgatatagccagcggccttggcctcgcccaatacctgcagccagatctgttcgtacacgtcgcgcagggccagcacctgggcctgaccttcggccgacagcgagcgccattcgtacaccagcaccgccatggcctcgccactgccgcccatgatcgactgcaactcgcagcgaatcagcgccagcacacgctcgcgcacgttattcgcctcctccagcgaagcacgcatcatcgcagtgttgtaatggatggtttcctccatcactgcccgcaggatctcatccttgctcttgaaatgatgaaagatgctgcccgactggatgcccacggcgctggccaaatcccgcactgtggtgcgctcaaagcccttgttgcgaaacaggtgagctgcggtttgcagcaattttccccgcgcactttccggatcagtcaattggccaccgtcgaccatggtgcgcatcacccccagggctttgtgctcatccacgctactctccttcactctactgacgtcttgggcggcaatttaggccgtggctgtcacccaagcaagcgcttgggtcaaacttgtttcgacagtttacaaaccaagcgcttgcttggtagtctcgacaccagccattggagcagggacttctcatgagcaagacggttcgtatcggctgcgccagcgccttctggggtgacacctgcaccgccgccgcccagttggtacacggcggcgccttggattacctggtattcgactacttggccgaagtcacgatgtcgatcctggccggtgcgcgcatgaaagaccccaaggccggctacaccacggattttgtcgaggtgctcacgcccttgctggcggatatccagcaacagggcatcagggtgatcagcaatgccggcggcatcaacccccaggcgtgcgccgccgccctgcaagcggcctgcgaccaggctggcatcggcctgaaaatcgccgtgttgctcggcgatgacctgcacccccaactcaaacacctgcccacagccaacgacatgttcaccggtgccccgctgccgcccgtgtgtgtgtccgccaatgcctatctcggcgcgccaggcattgcccaggccctggggttgggcgccgatatcgttatcaccggccgggtggtcgacagtgcagtggtcagcgcagcattggtgcacgaattcaactggtcatggcaagactacgatcacctcgcccaggccgccctggccgggcatatcatcgaatgcggcgcacagtgcaccggcggcaacttcaccgattggcgcgacgtacccgactatgagcacatcggtttccccatcgtcgaagtcagcgccgacggccaattcaccgttaacaaggtcgagggcagcggcgggctgatcagcgaactcagcgtggccgaacagctgctgtatgaaattggcgacccgcgtgcctacctgctgccggacgtgatctgcgatttgagccaagtcaaattgcagcaacagggcaaacactctgtacgcctgcatggcgccaggggattgccacccaccgatcagtacaaggtcagcgccacctaccccgatggctttcgctgtaccgccagttgcctgcttgcaggcattgacgcggtagccaaggccgagcgggtcagccaggcaatcatcaacaagacctcggaactgttcagccaacgcggctgggcgccctacaccgaagtcaacatcgaactgctcggcagtgaagccacctacggcgcccaggcccggcgtgaggattgccgtgaggtggtggtcaagctcgccgtacggcacccgagcaagcaggcgctggtgctgttcgcccgcgagatcgcccaggccgccactggcatggcgccaggcttgaccggcatcgtcggcgggcggcccacggtgtatccgctgatccggctgttttcattcctgatcgacaaggcgtgctgccaagtggtcatcgactaccaaggccaacgccatgctgtcgagctgcccgcctctgccgccatgctcaccccagccgcacccattgaccccgtcaaaccccaaggccgcgccgacgccagtgtgccgctggtgaaactggccgtggcacgctccggtgacaagggcaaccacagcaatatcggcgtgatcgcccgccaccccgactacctgccgtggatcgccgaagcattgaccccggaggtgatcgtcgactggctgggccatgtgctcgacccggtccatggccgtgtcgaacgctggtatttgcccggcagccacagcctgaatttcctgctggaaaatgccttgggcggtggcggcatcgccagcttgcgcatcgacccgcaaggcaaagccttcgcccagcagttgctggaaatccccatcgccgtgccgcagcacattgccgatcaactcagctaaaggaccgtcgccgtggccttcaactcgatcttcaaagccgacctgttccaggggcaaaccgtgatcgtcaccggtggcggcagtggcattggccgctgcaccgcccatgaactggcggccctcggcgcccgtgtcatcctggtggggcgcaagccggaaaagctgcagaaggtcgcggcggaaattgccgaagacggcggcattgcccattggctggcctgcgatatccgtgatgaagaggcggtgaagacgttagtcgcccaggtcatgcacgatcacggcccgatccatggcctggtcaataacgcgggaggccaatatccgtcgcccctggccgcgatcaatcaaaaaggctttgaaaccgtactgcgcaccaacctggtgggcggtttcctgatggcgcgggaagtgttcaaccagtcaatgagccaacacggcggcgccatcgtcaacatgctcgccgacatgtggggcggcatgcccggcatgggccactccggcgcggcgcgttcaggcatggacaacttcaccaagaccgctgcgtttgaatggggttatgccggggtgcgtgtgaatgccgtggcccccggttggatcgcctccagcggcatggacacctatgaaggcgcgttcaaggcggtgatccctaccctgcgcgagtatgtaccgctcaagcgtatcggcaccgagtcggaagtcagcgccgctatcgtgtttctgctcagcccggccgcggccttcgtcagcggcagcaccctgcgcatcgacggcgccgccagcctgggcagccgggcgtggccgctgcacaaggcgcaagcgcccagtgaacccttcaacggtttccaccgtgcgtacctgccggatgtgctcaaggcggagcaataaccccatgccgacaattgaaagcctgatcgacgcccacagcccgcagttcgcgcaaaaccgcgaagccatgctggccgccatcgcccagttgcgccagctggaacacaccctgcttgccaaagcccaggaagccaagcccaagttcgacaagcgcggccaattgctgccccgggagcgcctcaatttgctgctcgaccctggcgcgccgttcctcgagctggcaagccttgccggctacaaactccatgacgacaaggatggcagcgcggccggtggcgggttgatcgccggcatcggctatgtcagcggcgtgcgcatgctggtagtggccaacaacagcgcgatcaagggcggcaccatttccccctccggcctgaaaaaatccctgcgcctgcaacagatcgccatggaaaacaaactgccggtggtgaccctggccgaaagcggcggcgccaacctcaactatgccgccgagattttcgtcgagggcgcacgcagctttgccaaccaggcgcgcatgtcggccatgggcctgccgcaaattaccgtagtgcatggctcagccacggcaggcggtgcgtatcaaccgggtttgtcggattacgtggtggtagtgcgcggcagggccaagctgttcctcgccgggccaccgttgctcaaggccgctaccggcgaaatcgccaccgacgaagcactgggcggcgctgagatgcacgcgcaaaccgctggcactgccgaatacctggcggaaaacgatgccgacggcgtgcgcatcgtgcgtgaaattgtcggcttgctggcgtggaatcagcgtctgcccctcgcgcccaaacgtgcctacgcagagccgctatatcccattgaagagttgctggggctgattcccgatgacccgaaaaaaccctacgacgtgcgcgagatcctcgcacgcctggcagacggctcgcactttcttgaattcaagggcgagttcgacgcccacaccgtctgcggccacctgcagatccaggggcgcgccgtcggcgtgatcggcaacaacggccccatcacgcccaagggtgcgagcaaggccgcgcagtttatccagctgtgcgaccagagccgcacgccgctgctgttcctgcataacaccaccggtttcatggtcggcaccgagtccgaacagcaaggggtgatcaagcacggcgcgaagatgatccaggcagtggccaatgcccgcgtgcctaaactcacccttgtggtcggcggttcctacggtgccggcaactatgcaatgtgcggccgcggcctggacccacgctttatcttcgcctggcccaacagccgcacggcggtgatgggtggcgcgcaggccggcaaggtgctgcgcatcgtcaccgaggccaagcaattgaaggacggcctggtgcccgatcccaaggtactggacatgctcgaacaggtcaccgcgcagaagctcgacagccaatccaccgcactttacggcagcgccaatctgtgggacgacgggctgatcgatccacgggatacccgtaccttgctcgggtttctattggatatctgtgatgaagccgaacggcgacaactgcaaccgaacagctttggtgtagcgcgtttctaacgacggccaggagaactataaaaatgatcttcacccaggaacatcaggaactgcgccgcaccgtgcgcgctttcgtcgaccgcgagatcaacccccatgtggatgaatgggaaaaagccgggcgttttcccatccatgaaatcttccgtaaggccggcgacctcggtctgctgggcatttccaagccggagcagttcggcggcatgggcctggactacagctactccatcgtcgccgccgaagaatttggcaccattggctgtggcggcatccccatgtccatcggtgtgcagaccgacatgtgcaccccggccctggcccgtttcggttccgatgagctgcgcgacgaattcctgcgcccggccatcagcggcgaacaggtcggctgcatcggtgtttcggaaaccggcgccggctccgacgtggccgggctcaagacccatgcgcgcaaggacggcgacgactacgtgatcaacggcagcaagatgtggatcaccaactcgcccagcgccgactttatctgcctgctggccaacacctccgatgacaagccgcacatcaacaaatccctgatcatggtgccgatgaacagcccgggcatcagcgtcagcccgcccctggaaaagctcggcatgcacagctccgagaccgcccaggtgttcttcgatggcgtgcgcgtgccgcagcgcaaccgcatcggtcaggagggcgcgggcttcatgatgcagatgctgcaattccaggaagaacgcctgtttggcgcggccaatatgatcaagggcctggagtactgcatcgacagcaccatcgcgtactgcaaggagcgccagaccttcggcaaagcgttgatcgacaaccaggtgatccattttcgcctggccgaacttgcgaccgagatcgaatgcctgcgcgccttggtctaccaggccaccgagcaatacatcaagggccaggacgtcactcgcctggcgtcgatggccaagctcaaggccgggcgccttggccgcgaggtcagcgacagttgcctgcaatattggggcggcatgggtttcatgtgggacaacccggtagcccgcgcctatcgcgatgtgcgcctggtgtcgattggcggcggcgccgacgaaatcatgctgggcatcatctgcaaactgatgggcaccctgcccggtaaaaagccatgaacaccctgctgctcgaagcccatagcggcgtgctgcatatcaccctcaaccggccggagtgccgcaatgcgatgagcctggcaatggtcaaggaactgcgtgcggtattggcacagttggacagccaggtgcgcgccgtggtgatcagtggtgcgggcgggcacttctgcgcgggggccgatgtgaaggacttggttggcgcaggcgctcagttgcaagcgttgaaccgggcatttggcaccttgctgcaagaggtagaagccgtaccgcaggtggtgattgtgttgctgcaaggcgcagtgctgggcggcggctttggcttggcgtgcgtgagtgatattgcgatcgccgaccaccaggcccagttcggcttgcccgagacccgcctggggttgctgccggcgcagattgccccctttgtggtcaagcgtattgggctgacccaggcacgccgactggcgctgacggcggcgcggttcgatggggttgaagccgagcggctgggggtggtgcattttgtcgagcacgatgcccaggcactggcccagcgcctggacgaagtgctggggcaggtgttgcagtgcgcgccgggggcgaatgcgcgaaccaaggcgttgttgttggccagcatggatgagccgcttgatgcagtgctggaccgcggggcgcagtggtttgccgaggcagtcgcgagcgaggaagggattgagggcacacaggcgtttgtgcacaagcgcaagccacggtggtgcgaatgacgccttcgcgagcaagcccgctcccacaggttggaatgcatttcaaatgtgggagggggcttgctcccgatgaggccagaacagccaatccatccttcaaggaatagaccaatgcccgccttcagcaaaatcctgatcgccaaccgcggcgaaatcgcctgccgcatccaacgcaccgcccaggcattgggttaccgcaccgtcgctgtgtacagcgacgccgacagccacgccctgcacgtgcagatggccgacgaagccgtgaacatcggccccgcccccgtccatcagtcatacctgaacatagccgccatcctcgacgccgcccaacgcaccggcgccgacgccatccaccccggctacggctttctctccgaaaaccccgacttcgcccgtgcctgccagaacgccaatatcaccttcatcggccccagcgtcgaagccatcgaactgatgggcagcaagcgcctgtccaagctcgccatgctcgatgccggcgtaccttgtatcgccggctaccaaggcagcgcccaggacgatgccacgcttcaacaagaagcccagcgcatcggcttcccgctgatgatcaaggccagcgccggtggcggtgggcgtggcatgcgcctggtgcaccaacccgaacagttgctggagcaactacgcaccgcacgctcggaagccatgaacgccttcggcaacgacgaactgatcctcgaacaggcgctggtcgacccgcgccacgttgaagtgcaactgttcggcgacagccatggcaacctgatctacctcggcgagcgcgattgttcgatccagcgccgccatcagaaaatcatcgaagaagccccttgcccggtgatgaccgccgagttgcgccaggccatgggcgaagccgcgctcaaggctggacgggcggtgaattacgtcggcgccggcaccgtggagtttctgctcgaccgcaacggccggttctatttcctggaaatgaatacacgcctgcaagtcgaacacccggtgaccgaactgatcaccggcctcgacctggtggcctggcaactgcacatcgccgcaggccagccccttccgttggcacaggccgatgtagccctcaatggccatgccatggaggtgcgcctgtacgccgaagacccggcccagggtttcctgccgcaaaccggtgaagtgttgcgttgggtgcccgcccccggcgtgcgcattgaccatggtttgtgtgaaggagaccaagtcagcccgttctatgacccgatgctgggcaagatcatcgtccatggcgccaaccgtgaagaggcccgacgtaagttgctgcgggcggtggaagacacggtgttactcggcgtcaccacgaatcagcagctattggctgatttgctcaagcatccgggttttatcgccggcgatttcagcaccgcctttatcgcagaacacttcggcgaaataccgccccaggtgctctcaaacgaacagctcagcttggcagcagcgctgttttatagacacagcgccgaccagcatccccaaggactggcaggatggcgcaacaatgccaatgctccgtgcacctatcgcctcgaggccaatggcaaaatccacaccgtgagtgccgacgcccagcaactcaccaccgacgggcgttgggccacacaggtactcaatggcatccgccggcgtatcgcctaccacctcgacgacacccagttgtggctgcccggcatgacggtgatcaaccgcacccagcaagccgccagccgccaggtcgacgccagcagcggcacggtcaaggcccccatggacggcgccatcgtcgacatacgcgtcagcgtcggcgagcgggtcagcaaaggccaactgctgctggtgctcgaagcgatgaaaatggagcacccgctgaaggctggcatcgatggcatcatcaagggcgtgcaggtcttgacgggtgatcaggtgcgcaatcgccaggttttgctggagatcgaataacggccctgggcggaactacaaggccgggctacgctctatccccatcagaaagggacgagtacgggaacctgcaccatgcctcattggctgattattgaccttgaagccacaacggatgacggcggttggcccgtgacggagatggaagtcatcgagattggcgccagcctggtcaaccgccagggccgcgaactggatcacttccagcgctttgtgcggccactgcgacggccactgctgacgcccttttgccgcaaactgacccacatcacccaggccaatatcgacgcagccgcaccgatcaccgaggtgtggccgctgttcgagcgctggctgggccagcatcaggctcgcctggaaggctgggccagctggggtgattacgatcgcgtgcagcttgagctggaatggcaacgccatgacctggccagcgccttgggccaaacaccgcacgtgaacctcaagcagcgctttgccaaggcccggcgcctggacaagccgctggggctcaacggcgccctgcaattggcggggatgcagttccatggccagcagcatcgcgcgttggaagatgcacgcaacaccgcacgcctgttgccgttgattttgccggtctaggcagctctcgtagggttgggcatactggccggcctttccagacccttttccgaggattcacccatgttcaaagtcaacgagtacttcgacggcaccgtcaagtcgatcgctttcggcaccgcagaagggccggcgaccatcggtgtgatggccccgggtgaatacgaattcggcaccgcccagcgtgaaatcatgcacgtggtttccggcgccctgaccgtcaagctgcccgacagcagcgagtgggaaacctttgccgccggcagccagttcaacgtgccggccaacagcaagttccaattgaaggtcgccgtggacaccgcttacctgtgtgaataccgcggctaagcatcaccggcaaacaaaaatgcccgtctccagcgagacgggcattttttattccagcaccgtcaccggcatgccgacttccaggcgcccgatgccgtcgttgaccaggttctggccaaacatcgcgcccttctcggtcttgcgataggtctccagcgtggcgaaaggctcacggtcgggactgcgctcgccggtctgcgggtcaatggtggtgaggatgcagcgcgagcacggcttgaccacccgaaactccacgtcgccgatgcgcaagcgtttccagccatcttcggcaaaggcctcggcgccctcaatcaccaggttgggccgaaagcgcagcatttccatcggccggccgatatgcgcgcacaggtcgtccagggaagcctgcccgatcaacagcaatgggtaaccgtcggcgaaccccacctgatcgtgatcctggccataaccggagtcggtagaacgcgcacgctccaagggcatatgcaccaggcgtgtgggtttgccgatgaacgcactgacccaggccgccgctgcatcgcctgcatccggtacgcgcaaggtgtcgcgccagatggtgacaccgcgtaagtcctcgtcgccgggcaaagccacctccagcggcgcatgaccgggcgaactgagggtcaggccgcccatgctgttccacagcgccgacagttggctcatcttcgccaccgcccgctgcgtcaggaaccgcccgctggcttcgtccaccagcatccagcgtcgatccccctgcaacccgagtttatccaggccgatctgctgcaaaagttcgcccttgccggatttcaacgggtaacggtacaacgcactgagacgaagcatgggcctgcattcctaggacacaaagtgtcatcctaacctcaggcaggcacttcgtccaacatcagtcgttggcgcaccacatctaccagcttgtccggctggaatttggagaggaaattgtcacaacccaccttcttcaccatcgactcgttgaagctgcccgacagtgaggtgtgcagtactacgtagagcccacgcaggcgcgggtcattgcggatttcggtggtgaggcggtagccgtccatctcgggcatttcggcatcggtgaagatcatcagcagcttgtcggtcatcacctggcccgtgtcagcccaggccttgagcatgttcagggccttgaggccgtcactggcgatgtgcatcttcacgcccaactggccgagggtgtcacgcaactgcgacagggccacgttggagtcgtccaccagcagcacttcgcggccacgggcacgctccaggatcgggtcttcaagtttttcccgggagaccttggcgttgtagggcacgatctcggcgaggactttttccacgtcgatgatctccaccaactggtcatcgaccttgctgatggcggtgaggtaatgctggcgcccggcgctggtcggcggcggcaggatggcttcccagttcatgttgacgatgcggtcgaccccgcctaccaggaacgcctgcaccgaacggttgtattcggtgacgataatggtgctgttgggccctggcaccagagggcgcatgccgatggcctgggacaggtcgatcaccggcaaggtctggccacgcaggttgaccaccccgcacacgaaggggtggcgctggggcatcagggtcagcttggggagctgcagcacttcctgcaccttgaacacgttgatggcaaacaattgccgcccggccaggcggaacatgagaatttccaggcgattctcacccaccaattgcgtgcgttgatctaccgtgtcgagaatgccggccattgaaagctcctggtgtgctgagggaatgtgccactgatgcgagcgtggcgcgctctcgaggttgtcgcgagccaactcgcgcctgtagtgggttatcggcggcaaacgccagaccttgacctgagtaaaatgccatgtaaattcattgatgtcacactgacatcatgctttactgcaacggctcctgcataggcagagaccatgaccttgcgcgacatccaaatcgacgcgaggttccgctatataagggattcccctaggcacaatcgggcctaacctgatattcgcgatatctaatagccattaatgtgacgccattctcattgcatgaatggagtcaggcttttgtttgccatcccaagccctcggcccaccggcctttcaggcacttacatgtcggctactaaaggtgtgcaagcagtccggataatgaggacgaagcacggcctttgtcggcatttcaataaacgtcctacagcaacatcagaagcgacctacagattcccgtcaaatttcagcgctagttttaagctattcgcccggtgcgacatctcatcacccgacctaaagttgtggagacttgcatgatgaatagcgcaaacgaatggcaaacagcacttcccgattttctgctggaagcggaaatgctgctggccaagtctgaagaatgcctgaaccacctgcatttgatccgcaacgacagcgatgccatcgactgcatgaaggcaagcctggctaaactggctgaaaaagccgacggcctggccttgcaggcgatcagcgagttctcacgacatatccagtacctgatcgccaatgccgtgagccccgtgcaactgcatgaccaggcactggatgcgctgcatgactgcctgacgctactggcttggcagttggagctgatcgacatgcgtaccggtgagttgagtctggacgacagtgaacagacatcgctgattgcaacggtgacctcgcagatcccgcaaaaagattatgcacctgacctgcagtctcgcttgcagcagggatcttgaaccgcaaaggtcgtatttaatacctggctatctgaaaacgaccgcttttgctcaaaagatgaaacccacttagcctgtcattcaatagttgtacaaactactctaattaatacaactggctatctttgaactctgggactattgctcagagcgctgacgtggccaacacatccaacagggaaagtgccaggcgaccaacggtaatagtggtggtactatgccccgctcgaagtgactcaacttcatcatggataaccacgattcggcaccgcattcccaacagagcccagtcaaccgccgtgaccggtcttcccgcagcgaaccctcattggctccatccgctatgtacgccagtctcaagtcactcatcgcaaggtccgtgtcccgcagtcatgcacctcgcatagtccttgccctgtgcctgtgcgcaacgctggccagtctatgggcctacctgcatggcgcgtcgctgccgttattgatcctgctgctcaacttcgccacgctggtggtggtgggcctgtaccagtggtgctcgcgcaaagccatcaagttccagccccaggaactggccgaccgcctgctgcaagtccaggaaaacgaacgccaccgtctcagccgcgaactgcacgacgacattggccaactgctgaccgccgccaaactgcaaggcgaatggctgcaacgtcgcctgccccaagacctgcaaaaccattgttcagtgctgtgcaacacgctcaacgaaaccctggctaaggtgcgcgacgtgtccgcgatcctcaaccctcgccagctggcaagcctgggcctggaagccagcctgcgcgcgcacctgctcaagaccttggagaacacccaggtatgctggagcctggagtgccagcaacgactgaccggcatccccgaggaaatggccgtggcggcctttcgcatcacccaggaagccgtcaccaacatgcttcgccatgcccaggcgcacaatctgctggtgcgcctgcaacgcctgcccgaaggcctgtcgctgatgatctgcgatgacggcctgggtttctcgcccgccaccgaccccggccgggaaggccagcggggcatggctggcatgagcgaacggatagatcagttgggaggcactttgtccgtcagcagccagccaggcaaaggcacacgcatcgacgcacttttcccctgggcgccccgcgccctcaaacgggccagctcccctaaggttctcgagtgacctgcaccttactcctggtcgatgaccacgcactgattcgcgccggcgtacgggcgctgatcctggatatccccggctacagcgtgatcggtgaggccagcgatggtgcgcagttgctggagcaattcagtgccctgcagccggacatcgtgctgctcgacctgtcgatgaaacacaccggcggcctggatgccttgcagcaactcaaaagcgcctaccccacgtgcaaggtgctgatcctgtcgatgcacaccgaccccgagctgatcatgcgtgcgctggaggcgggcgcccacggctacctgctcaaggacaccaccgccaacgagctggaacacgcgctgctggccctgcgtaacaacgaacgctacctgagccccgcaatcgcccacacggtgatcaaccaagcgctgatccgcagccagggcccgaacgcacccgtcgccaacggccataacctgacagcgcgacaactggaaatcctgcgcctgatcgtgcgcggcaagtccacccgtgaaatcgcccaaggcctgggcctgagcatcaagaccgtggaagcccaccgctcgcagatcatgaagcgcttgcagattttcgacgtggcgggcctcgtgctatttgccgtgcgtgagcagatcatcagcctggacgactagcggcgaccccagcggcaggtgcacgcgcagggcctttggcaatgcttcgaaatgcagatcatcgccttccagcggctcaccatcgaggttgatatacaagccttgggcgaccttgatattgacccatggcaggcgtgcgcgaacgaacatggtgtccaggccccagccgttgttcatcaactcacgtagcgtaccgaccacctcttggggggccggcaggatgctgacgtcgagcaatccatcatcggccaatgcgccagggcacaggacatgcccgccaccggcctgacgcccgttgccgatacccagtgcgagcagctcgcctttccagtggaaatccgggccttccagctccccgtaggcggccttcaattcactgaagcgcgataaaccggtgaacaggtaggcggcgccgccgaggaccttcttcaggtcttcggaggtgttggccgtgacctggctgccgaaacctccggtagccatgttcaggaagatctgaccgcccacctggccaaggtcgatagccctgggttgaacgtccagcaacgccagggcgccagccggttccaagggcacaccggcggccttggcgaagtcattggcggtgcccaggggcatcagtaccaggctggcatcggtcttggccaacgccatggcctcggccacatcgcgcagggtgccgtcaccgccaccggcgatgatatgggtatagccgttatccagtgcctcgttgaccagacgctgggcatcgccgccctcccaggtcacccgcaccgccaactcccaaccctgcttgcgcctggcctgcacggcgctgcgcacgtcctcgttgagggcttgcttgccgtggaggattaacagggccttgggggttgtcatgggggaatctcctggttcaaaggtgcttgaaggatgttgaccctgaaacagcaggaaaaagtcactggggattggaaattagtgacgaacttactctgggctcaaagatttcgtacacggccccaggacattgcaccttcgtaccgtggccgcactccctcaacctcatcgtgcacgcacctctccagacttcaaccaaaacgagcggcgaacatgatgaagatagaaccccaacatacaggtcactcgacacccctcgaactgatccccattgccaacttgatcaactcagcgcatgaggacgactcaacactcagccctttgcagcacatcgcacgctggtccagtgaatacctgtgcaagcccagcgcggacatcggacgccccggcgtagtctgcccctggacgcccaacgcgatgaaacgagaaacgttctggctgaccgaactgacgacgcgcgaccgttgcgaccaggccgtatgcgaagacatgctgtcgttaattgaccacttcaaccgggcagcgccgacagaaggtgataaaacccaattcaagactattgtcgccgtctttcctgatattcatccggaacataaagtcgacgagttccacgccatgttgaagcccgcctttcttgacgcgggtctaatgcttggcgagttctattccacctgcaaaaaacctggcctcaggaatccggagttccggccactgacctcgcccataccgctactggtggtcagggagatggtggatttcgacattgtatttcttgcagattcgcaggcctacgttaacgcctacttgaaacgccacggcgctgcggggttggacacactcgaacggacgctcaaacaccgcgaacgttttggcctggatccggaccaggttgtcatccttgaacgcaccctggctgaacaccgcaccaccgactcgagggtgagctagcgacaggactggcattggcgggcgaggcgcaatgggtgcgcgtgtgctgcctggccggtgcctgtcggacaaacaggctcagctcttgtgcaacttgctcatcaactgcgcctcggcctgggtcaacccgcaagactgcgtcaactcatccacggtcgcgcccatgcccaccagcttggcggcctgggcaaacgacaggttcgaaggatcgcgctgctccaactgcaccaacttgtccggcaacggcgcaagtatcgcgcgcagttcatgcacttcatccccgacccgcacggcactttgctggaagtggtcgacacgcttgaccagttccaggatgcgccggtcgcgcaccgcatcgcgttcggcctgttgcagggccaactcccgttgctggcgtacatagcgcagcacaaacgccaaggtcccggcccataacagggccaggacaatcaccgctgcctcaaggaacaatcagatgctctccagttccgaccattcttcttcgctcatcattttgtccagctcaaccagaatcaacagctcgttgttcttgttgcacacgccctggatgaacttggccgattcttcgttaccgacgttcggcgcggtttccacttccgattggcgcaggtagaccacttcggccacgctgtcgaccatgatcccgaccacctgcttgtcggcttcgatgatcacgatgcgcgtgttgtcgctgacttcgaccgtgtccaggccgaagcgctggcgggtgtcgatcacggttaccacgttgccgcgcaggttgatgatgcccagcacgtagcttggcgcacccggcactggcgcgatttcggtatagcgcagcacttcctgcacacgcatgacgttgatgccgtaggtttcgttgtccagtttgaaggtaacccattgcaggatcggatcatccaaaccttgtgcggacgctgacttgttcatctctctgaccccttcaagtgccgttcgacacggcgtataggctgctctgaccgcactcgcgcacggaccttattgttcaatcaactgcgtttgttctgcggcatcgccttgaccgccccgctggcgatcaactcggccagttcggcgacatccagcaaggcgcacatgtgttcgatcacggtgcccgccaaccatggccgctggccacgatggctgcgccatttgatttcattcgggtccaggcgcaacgagcggctgacttgatgcactgccagcccccactcgtagccctgcaccgagatcacgtattgcaaaccctggcggaagtcgtcgcggtagcggtcgggcatcacccagcgcgcggtatccagcaccttgaggttgccggcctggctgggcaggatgccgaggaaccactccggctggccaaacagcggcgtcagctcgtggccttccaacgaatagatcgagcccaggcacaccagcggcaccgccagggtcagcccggcgacgtcgaacagcaggcactcgaacggctcggcagcccatgcagggcggccatcgccggtcaccggcggcggcgtgatgctcggcggcaaatgcacttcaaccaatggctcgaccaccacgggcgcaaccgggtctggcgtgaccggcaccacaggcgcagcctcggcaagtgcatcgcgggcctgctcctcgagcaccgccagctggaactcatccagcgtgccggggggttcgacagcaggctccagcaccaggatcggttccggcagctcttcctcggtcgcgtcctgcagcaaggcatccaggtaggattgcagtgccagttgcggccgggtcttgaggtcgacgggtcggttcatcacgccacctgcgccacaagctgctgcgacagcagatgcttgagcaacgcacgatacgccagcacgccacggctcttgccatcgaactgcgacggcgtgagcccggcgcggctggcgtcacgcaggcgtgtgtccacggggatatagccattccagatcgtctccgggtaggcatcacgcaatacccgcagggtgccgagggacgcctgggtacgacggtcgaacaacgtgggcacaatgctgaatggcagcgcctgcttgcgcgagcggttgatcatcgccagtgtgctcaccatgcgttccaggcccttgaccgccaggtgttcggtctgaaccggaatcaccagttgctggctggccgccaaggcattgaccatcagcacaccgagcaacggcgggctgtcgatgatcgcgtagtcgaactcctgccacagctgcgcgagggtcttggcgatcaccaggcccaggccactttgccccggcgactggcgctcgagggtggccagggcggtgctcgacggcaacagcgaaatgttgtcgttgctggtgggcagcaacagttgcccaggcaaatccgccgccacgctgcccttgtgcaggaacaggtcatagcagctgtgttccagcgcatccgggtcatagccgaaatagctggtcatggaaccgtgggggtccaggtcgaccacgaccacgcgcttgcccgcctcggccagcaagccggctaaggcgatggaagtggtggtcttgccgactccacccttttgattggcaactgcccagactctcattcggttggttcctcccggtgggcacaggcgcgaccgagacattgcataaggttattgagccggtgacggagaattgacgttactcgatctgaccggcgacttgactacgggcggtgcagtttgtgtgccagcacgcctcaacgccgcatccggggttgcattggcggtgccggtaccggtcaggctgcggcgtacatccaggttgcgcgacaccaccagcaccacccggcggttgcgtgcacggccttccaccgtggcgttattggccaccggctggaattcaccatagcccaccgaagccaggcgctgggggttgaccccctgcatggccagcatgcgcacgatgctcgacgctcgggcggatgacagttcccagttggtcgggtactgcgcggtgctgatgggaaaattgtcggtgaagccttcaacgtgaatcgggttttcaaatggtttgagaatcgacgccaccttgtcgatgatggtaaacgcctggtcgctcggcagcgcatcggcgctggcgaacaacaggctggagttcagctcgatctccacccacagctcgttgccgcgtacggtcatctggttggagctgatcaggtcgccaaacgcggcgctgatgtcatcggcgatgcttttgagcgggtcgctggtgccaccgacgccggcggcggtttcatcgctgtcgttgaccagtggcttggccggggtcacggtcttgggccgctcgtcgccaatgggaatcggcttgagggcacgctcggtatcgttgaacacacccaccagcgcctgggaaatgatcttgtatttgccttcgttgaccgacgagatggagtacatcaccacgaaaaacgcgaacagcaaggtgatgaagtccgcgtaggacaccagccagcgttcatggttgacatgttcctcgggctcgcgacggcgacggctcactggcagctccttcccatcaatccatgaagccctgaagcttcaattcgatggagcgcgggttctcaccctcggcaatcgacaggatgccttcgagcagcatctcgcgataacgcgactggcgcatggcaatcgacttgagtttgcttgccactggcagcagcaccaggttggcactggccacgccgtagatggtggcaacgaatgccacggcgatgccgctgcccagttgcgaggggtcggccaggttgcccatcacgtggatcaggcccatcaccgcgccgatgatgccgatggtcggcgcgtagccgcccatgctttcaaagactttggcggcgttgatatcacggctttcctgggtgtagaaatccacctcgagaatgctgcggatcgcttccggctctgcgccgtccaccagcaactgcaagcctttgcgtgcgtagttgtcgggctcggcatcggccacgccttccaggcccagcaggccctccttgcgtgcggtgaggctccagttgaccacgcggtcgatgccgcctggcaggtcgacccgtggcgggaaaatgatccacaccagaatctgcatggcacgcttgaacgagctcagcggcgactgcaacaacgccgcgcccacggtgccgccgatcacgatcagcgccgccgggccattggccaaggcgccaaggtggccgccttccaggtagttgccgccaatgatcgcgacaaacgccatggtgatgccgatcaggctcaagacatccatcagaggcaggcctccaccagatgcttgccgatgtcgtccaggctatagaccgcgtcggccaggtcagccttgacgatggccatgggcatgccatagatcacgcaactggcctcgtcctgggcccagatggtgctgccaccctgcttgagcaggcgtgcgccttcacggccgtcggcgcccatgccggtaagcaccaccgccagaactttgtcgccgtaggacttggccgccgaaccaaaggtgatatccacgcacggcttgtagttcaggcgctcgtcgcccggcaggatcttgatcgcgccacggccatccaccatcatctgcttgccacccggggccagcagcgccaggccagggcgcaggatgtcaccatcctcggcttccttgacggtgatgcggcacaacttgtccaggcgctcggcgaatgccttggtgaacgcggcgggcatgtgctgcaccagcacgatcggcgccgggaagttggccggcaattgcgtcaacacccgctgcaaggccaccgggccgccggtggaggtgccgatggcgaccagcttgtaagccttgcgcttgggcgctggcgaatgagcactcggtgccgctgcggtacgtaccggcgccaccgcaggccgagccacgggcgcaggcgccgggcgtgcaaacgacgagccaggcgcaggcgctgtgggcgcaggtgcggctgccggcgccggtgcgctgaacaggctgcgacggttactgcgggaaatgctgtgcaccttctcgcacagcatctgcttgaccttctcgggattgcgcgagatgtcttcgaaattcttcggcaggaaatccaccgcgccggcatccagtgcgtcgagggttactcgcgcgccttcgtgagtcagcgaggaaaacatcaataccggggtggggcagcgctgcatgatatgacgtacggccgtgatgccatccatcatcggcatctcgtagtccatggtgatcacgtccggcttcaaggcaatagcttgatcgatcgcctctttgccgttggtggccgtgccgaccacctggatcgttggatcggcggaaagaatttccgagacgcggcggcggaagaaacccgaatcgtccaccaccaggaccttgactgccataaacactccgttaggcggggcgggcatgaccgccctgccccaccagaatcaaatacgccgtgcggcgtaacgcttgagcatgctcggaacatcgagaatcagcgcaatgcgaccgtcaccagtgatggtggcgcccgacatgcccggggttccctgcagcatcttgcccaaaggcttgatcaccacttcttcctggcccaccagttggtcgaccacaaagccgatgcgctgggtgcccacggacagaatcaccacatggccttcgcgctgttcttcatgggcagccgaagccaccagccagcgcttgaggtaaaacagcggcaacgccttgtcgcgcacgatcaccacttcctggccgtccaccacgttggtgcgcgacaggtcgaggtggaagatctcgttgacgttgaccagcgggaaggcgaacgcctggttgcccagcatcaccatcagggtcggcatgatcgccagggtcaacggcaccttgatgacgatcttggagccttggcccttggtcgagtagatattgatcgagccgttgagctggctgatcttggtcttcaccacgtccatgcccacgccacggccggacacatcagagatctcggtcttggtcgagaaacccggggcgaagatcaggttgtagcactcggtgtcggtcaggcggtcggcggcgtccttgtccatcacgccgcgcttgacggcgatgccccgcaggatgttcgggtccatgcctttgccgtcatcggtgatcgacagcaagatatggtcgccttcctgctccgccgccaggatcactttgccgttgcgggacttgcccgaggcttcgcgttcttccggggtttcgatgccatggtcgacggcgttgcgcaccaagtggaccagcgggtcggccaaggcctcgaccaggttcttgtcgaggtcggtttcttcgcccaccagttccaggttgatttctttcttgagctggcgtgccaggtcgcggaccaggcgcgggaaacggccgaagactttcttgatcggctgcatccgtgtcttcatcacggcggtctgcaagtcagcggtgaccacatcgaggttcgacacggccttctgcatggcttcgtcgccgctgttcaggcccaggcgcaccaggcggttacgcaccagcaccagctcgccgaccatgttcatgatgtcgtccaggcgcgcggtgtcgacgcgcacggtggtttcggcttcactggcgggcttttc
